United States Patent 12,642,819 (COMPOSITIONS AND METHODS FOR TREATING INFLAMMATORY BOWEL DISEASE) - sequence listing, part 71

SEQ ID NO: 34 - DNA, 3058354 bp, Clostridium sp. (residues 1-1,529,177 of 3,058,354)
  modified_base (246614)..(246712): a, c, t, g, unknown or other
  modified_base (380006)..(380015): a, c, t, g, unknown or other
  modified_base (408873)..(408983): a, c, t, g, unknown or other
  modified_base (506638)..(506737): a, c, t, g, unknown or other
  modified_base (619520)..(619618): a, c, t, g, unknown or other
  modified_base (996811)..(996906): a, c, t, g, unknown or other
  modified_base (1573758)..(1573767): a, c, t, g, unknown or other
  modified_base (1602122)..(1602131): a, c, t, g, unknown or other
  modified_base (1622352)..(1622450): a, c, t, g, unknown or other
  modified_base (1705391)..(1705498): a, c, t, g, unknown or other
  modified_base (1722606)..(1722676): a, c, t, g, unknown or other
  modified_base (1926207)..(1926349): a, c, t, g, unknown or other
  modified_base (2001456)..(2001551): a, c, t, g, unknown or other
  modified_base (2066144)..(2066180): a, c, t, g, unknown or other
  modified_base (2160595)..(2160604): a, c, t, g, unknown or other
  modified_base (2208858)..(2208895): a, c, t, g, unknown or other
  modified_base (2230563)..(2230572): a, c, t, g, unknown or other
  modified_base (2287816)..(2287885): a, c, t, g, unknown or other
  modified_base (2393930)..(2394015): a, c, t, g, unknown or other
  modified_base (2460390)..(2460397): a, c, t, g, unknown or other
  modified_base (2478222)..(2478231): a, c, t, g, unknown or other
  modified_base (2500004)..(2500100): a, c, t, g, unknown or other
  modified_base (2509968)..(2510100): a, c, t, g, unknown or other
  modified_base (2626186)..(2626284): a, c, t, g, unknown or other
  modified_base (2679690)..(2679759): a, c, t, g, unknown or other
  modified_base (2704310)..(2704316): a, c, t, g, unknown or other
  modified_base (2895461)..(2895470): a, c, t, g, unknown or other
  modified_base (2912241)..(2912248): a, c, t, g, unknown or other
  modified_base (2928449)..(2928524): a, c, t, g, unknown or other
  modified_base (2968980)..(2968989): a, c, t, g, unknown or other
  modified_base (2970187)..(2970228): a, c, t, g, unknown or other
  modified_base (3043629)..(3043666): a, c, t, g, unknown or other
catgtatttggatacaataattataggttggtaaaagagataaaaagcatcatgcttaatgataatataaaatccatatctaatgatgacttaaaagaaaacaaagatatagataaatatctaaatattataagagaaagtgaattaaataaagaaagtataaaactattaatacaaaatattgaaatttattatcttaaatctattgaaaataaattattaaatataagttctgagaatgataagtacaaaatattaagtattaccaaagaattaatggaaaaagatgtaataaataaatataatgaaggtattttacacgggataacacagaaaattaataaaaaagcgtggaaaaacgataaaatgaacatatagtatagaatgattgaaaaaaagatgatataattataaattgtatttaaatttagaaataaaggagtgaaagtaacagtgttagggagaaacgagttatgcccatgcggaagtgggaagaaatataaaaaatgctgtttaaataaagatgttgtgtcggagagagctagtagaaaaattgtactttcacaaaaacaatattcacaactgtactcaaaactgtatgaatattcaagacagccaaaatttaatgaagagtataaaaaagcacaagaaatgttttatatattagaagatcaaaatataaatagcaagtttgaaagtttctttaatacatactttatacaagatcatataatggaaaataaaaaagttataactgttgacttttttgaagaaaataaaaatagcttaactaaagcagaagtagatacattaaagagtttatttgaatcttatgtaagtgtatatgttataaaagaaaaattagaagacaaaattttattaaaggatgctataacaggtgatgagatatacactgaagatataaatctattaaatggatttaatcaaggtgattgtataatagctagaatagttgaagtaggaggttcacatttattattagatgttacagtaagcatatcagaagctgtaaaggatataatagtaaatgatataaatcacttctttaagcaatatgaagatttatataaagatataaaaactttcttaatatatcatactcatatattatacaagtatattcaacaattattagatccaaagattgctgaatatcttaaagatcaaaaagaagctagtgctaaaaagcaagaagaagtaaaagaaatgatagctgaagatgaatgcaaagtatcagctttacttaaatctcaagttgaaagtgatatcttagaaaaatgtttagatttctggaacacttataaagcaaataataatgaaataaaaggttctgaaaatggatgggctgcagctgtggaatatcatattaaaaaagaaaatggacaagctgtaactcaatctcaaatatctaaaaaatacgatataagtccaagtactttaggtaagagacataaagacttaaaaatgtagtataaaacttaattttaaaatatacagaaagaggtatacacatgggtcttaatttaggaaaagcaattgctgtatcaacaagttatataaaatctaatccagcagtaccagtatataagggggaggaaactccagaaaacttatatgcagtaatataccatattgagatagggtataatgaaaaaagtttagaaaaggcaatgcaatacataataatagattataaagagtttgaattatgtgatagtgccaaggctgagttaatggatgtagctaaaaaatactgtgaacaaaatggtataaaagatgatgagcaaactcaaatagcattactagataatgaagaggcagagaatttcttagaaaaagtatttaacaacatgaaagttataagagggttaataactcaaagagattaagtaacaataaaattagaatttaactataaagctaggccctataaagcctagcttttgttttaaataaaattttaattatgaaagggacataaagatgttaagagtttctaatataaaattagatataaatgaaagcatagacaatataaaaagcttattattaaagaaattaaaaataagtgaaaaagagttagtaagttacaatatatacaaagaatctatagatgctagaaaaaaaggaaagatagattttgtttacactgtagatgttgaattaaaaaatgaaaaaaatatattaaaaaaatcaagattaaaagatgttgttgaagttaagcaaaataaatataaagatattaaaagtggcgaagagaagttatgtaatagacccgttatagtaggtagtggacctgctggattatttgcatctttattattagctcaaagaggatataatcctattttattagagagaggattagatgtagatacaagaactgaagatataagagagttttgggaagatggtaagtttaatcctaaatcaaatgtacaatttggtgaaggtggagcaggaactttttctgatggaaaattaacaactagaataaaagatattagatgtagaaaagttcttgaggaacttgtaaactttggtgctccagaagaaatattgtattcacataagccgcatgtaggaactgatatattaaaagaagtagtaaagaatataagaaaagaaataattagattaggtggagaagttaaatttgattctaaagttacagacataagtataaataatgaaaaaatagaatctataactataaatgataaagaaatattaaaaacagaagtagttatacttgctataggtcatagtgcgagagatacttataaaatgctttatgaaagaggagttaaagttattcaaaaaccttttgcaataggtgctagaattgaacatcctcaaagcttaataaataaatctcagtataaagagttttataatcatcctagactaggtgcagctgattatagattagttgaacatacttcaaatggaagaactatatatacattttgtatgtgtccaggaggtagtgtgatagcttctgcatcagaagaaggacaagttgttacaaatggtatgagtgaacatgcaagggataaagaaaatgcaaatagtgctgtattagtaaatgtcactccagaagattttggcagtgagcatccattagcaggtatttacttccaagaaaaatatgaaaaattagcttttgaatgtggtggaagaaactataaagctccaattcaattagttggagacttcctaaataatagagtaagcactaagctaggaagtgtaaatccatcatataagcctggatacaaatttgttgatttaagacagtgtttacctgaatttgtatgtgaaactatgaaagaaggactaattttattagataataaattaaaaggatttgctatggaagatgcaattttaacaggagttgaaacaagatcatctgcacctataagaatagttagggatgaggagactttagaatctgctaacgtaaaaggtctttatcctagtggagaaggagcaggatatgcagggggaatagtaacagcggcggtagatggaatcaagtgtgctgaaaggataattacgaaatattctgaaataaatatttaacacaaatttaataaaaatttaatatatttttaatatttaacacgaatttaacaaaaatatgacgatagtttgataaaatgattaaggcaatatatttaaagactaatattataaatattcaaggaggaaatgaaattggatatagtaattagccttatgggagggctaggtttgttcttatatggaatgaacttaatggcagaaggcctagaaaaatcagcaggctctagacttaaaaagatagttgagctccttactagtaatatatttatgggtgtacttgtaggggcatttgttacggccattatacaaagtagtagtgcgactactgtaatggtagttggatttgttaatgcaggtataatgaatttaacacaagcaattggagttataatgggtgctaatataggaacaactgtaacagcacaacttgtatcatttaatttagatggaatggcaccagttgcattaggaattggtataattttatatttatttgcatctaagccaaagactaagaatatagcagaaatacttataggttttggtatattatttactggtatggattttatgaaggaagcagttgaacctttatcaaaatatcaaggattcacagatatgttagtaacttttggagattatccattacttggacttttactaggattcggaataacagctatagttcaaagttcaagtgcatctatgggtatgcttatagcattagcatctcaaggtttaatacctttaagtgcagggttacctatactatatggacaaaatataggaacttgtgttacatcactaatatcaagtgttggagcatctagtaatgcaaaaagagctgcagtaatgcatttaatttttaatgttttaggaacaatagtattcttattagtattaaataaacctgtggttagttttgtaactagtatgaatccaggagatgtagcaagacaaatagcaaatacacatacattatttaatataatatcagttataattttattaccatttactaaatttataataaaacttgcaataaaacttgttccagaaaagcaaggtgaagatgatgatcataaggctataaaataccttgatgatagaatggttgagactccatctatagcagttgcaagtacattaaaagaaactttaagaatgggtaaaaaagctaaagaaagtttagattatgcaatgcaagggattatggaaaaatctcaagaaaaaattgataaatcatttaaaagagaaaagactataaatgaattacaaaaaggtatattaaattatttattaaaattatcaaaagctaaattagatgatgattctagagatctaattgattcactattcaatacagttaatgatatagaaagaattggagatcatgcggaaaacatcgcagagttagctcaagatataatagatgttgatttaaaattatcagagcaaggaaaagaagaagttaaagagttatataacaaagttatatcaacatattcatatgctcttgaagctatgaaaaataatgatttagatttagcttatagagttataaagatggaagaacaagttgatgcgatggaaaaatcatgtagagctaatcatatgcataggttaaataacaatttatgtagcatcgatactggaataattttcttagacttaatatctaatttagaaagagtttcagatcatgctgttaatatagctcaacaagtcatagctaatagaacagattcaaaataatatgataagtgacaaaactcctgtataaaaaatatacaggagttttgtatatataattatttaaatgaaaatattataattatattataaaaaatacttacaattaattggaaaaagttttattgtttgatataatttttattgtataataaaattttaacaatgaggaagggatatactatgaaaaagttaagttttgattatagcaattctattggtttctttaatcaacaagaaatcgattgtatgagtgaatatgtaaaagttgcacataacatgatacataataaaagtggggaaggtaacgatttcttaggatgggtcgatttgcctaatgattatgataaagaagaatttagtagaattaaagctgctgctcagaaaataaaaaaagattcagatgtattattagttataggtataggtgggtcttatctaggagcgagagctgctatagaaatgttaggtcattcttttagaaataacttagctaaagaagatagaaaatctccagaaatatattttgtaggtcaaaatataagctctacttatatgcttgatttattagatgttataaaagataaagatgtatctataaatgttatatcaaaatcaggaactactacagaacctgctatagcatttagaatatttaaggatttcttagaaaagaaatatggaaaagaagaagctagtaaaagaatatatgctacaactgatgctaaaaaaggagcattaagaatgttagctgatgaagaaggatatgaaacatttataatacctgatgatgtaggtggacgtttctctgtgttaactccagttggattattaccaatatctgtagcggatatagacatagatgctattatgcaaggtgcaaaagattctatggatgattttaataatcctaatttatctgaaaactatagctaccaatatgccgtaactagaaatatacttcatagaaaaggcaaagatgtagaattaatggttaactatgaaccaagcttacattatgttggtgagtggtggaaacaattatatggagaaagtgaaggaaaagataataaaggtatatatccagcttcagtagatttttcaacagacttacattctatgggacaatatattcaagaaggaaaaagaatattatttgagacagttttaaatgttgaagaacctagaagagaaataactataaatgaagaaaaaatagatttagatggattaaattatttagctaataaaacagtagattttgtaaataaaaaagcatttcaaggaactctattagcacatacagatggatcagttccaaacttaatagtaaatataccaaaattaaatgagtataactttggatacttagtatatttctttgaaaaagcatgtgctttaagtggatatttattaggtgtaaatccatttaaccaaccaggagtagaagcatacaagaaaaacatgtttgcacttttaggtaaaccaggatttgaaaaagaaaaagaagagcttgaaaaaagattaaaatagttaaggtttaattaaggatagtataatataattaacactatatagagtaattcctatatagtgtttttattttaggtatattgaagtaataattatcaaataatatcattaaaatttgggtataacttaaaaagaaataaaaatcaggagggaagcatatgagtgaaaatggaaagaagacgagcatagcgctgattgtaattgtgagtataataagtgcaatgatcggaagttttatgacagtatttgtacttggagatagaattggaaaagaacaaagtgaagctagtaaacaaaatatagttgttaatgaaagtggtaagagtcaaaatgtatatcatgcggttacagataaagccatgccttcagtagtgggaataactacaactactgtagatacaaacaatatgtttgcaataccacaagaatcacaaggagtagggactggatttattgtagattcaaaaggatacatattaactaactcacatgttgtttcagatgggaaagcttctgatgtaaatgtattatttaatgatggatcgactacaaaaggtaaggttttatggaacgacccaactatagatttagctattgtaaaagtagataaaacaggacttactgcagctgatttaggaaatagtgataaggtgagaactggagatatatctatagctattggaaatcctttaggattagaattccaaaaaagtgtaactcaaggtataataagtggacttgatagaagcattgatacaggtaaaggaactagtatgacaggtcttatacaaactgatgcaagtataaatcctggaaatagtggaggaccattattaaatgataaagggcaagtaataggaataaatacagctaaagcatcaggggctgaaggtttaggatttgcaatcccaataaatacagcaaaacctatagtggatcaaataataaaagatggtaaatttgaaaaagtaacattaggaattaaaggaatagatgttcaaacatttgaagctatgactggtacagatttagaagcaaatgaaggtgtttatgtagcagaagttttagataatacaccagctcaaaaagctaagatacaagcaggagatgttataactaaagtaggagatacaaacataacatcaatgagtgatttaaataaagctttatacaaatactctgtaggaaatactacaaaggtttcaataaacagaggtggaaaagatataagtgtaaatgttaaattctaatgttaacataaaaaaagatgggaattaattcccatcttttttagtctgtaattttacttttgctgctaggacaagatccttgactagaacatcctgaacaaccagagcatccattgcttttagctttcatattcttataaagtattataagtgctataagtattattataccacctacaactaattctaataatgaagatatagatgaaccttcaaatattaatgaacctacaatcttaactatgaaagcagcaacccaagctactgcaaattgataagttgcagatataaacatcattttactaccatattcttttctcattgtagaaagagctgctatacatggagtgtataatgcagagaatactaggaaaccataagcagttacacttgtaaatgattgaggtaaagtcgtatttaaatttccgtaaactatttccattgtacttataacaacttcttttgcgcttataccagttaatatagaaactccagctctccaatcaccaaatcctaaaggagcaaatataggagctattaagtggcctaatgaagctaagaaactttcatttatattttcagtaaatcctgagaaattaaatgatgataatgcccatataacaacagacatagcaaacattattgtacaaacttttattaagaaacctttagctttattccaagtatttttaagtaatgcattaagtgttggcattttatattctggaagttcaagaacgaaaggttctatttcagttttataaactgttttatttaatactaatgctattattatagcaactactatacctaataaataaagtgatgtagttacaattgctgcatttttacggaagaatatagaaacaaataatgcataaactggtaatttagcaccacaagtcataagaggtgcgataagtgcagttatttttctatctttttcactttctaaagttctagtagccataattgctggagaagcacatccaagacccattatcataggtatgaaagctttacctgataatccaacttttttcataacattatccattaagaatgctgttctagccatataaccactgtcttcaaagaatgacatacctaagaataatacaaatattaatgggaagaatggtaatgcaccacctaatccacctattaatccatcaactattaatgaatggaaccaagggctagaatttgcaaataaagcatcagcaggtgtagctatataagtatctattaacgtttctgttaactcttgaagcggtccacctacccagtcaaaagtaaacttgaataatattaataaagcagctacgaatacaggataagctaatataggatgtaatattatattatctattttgctacttaatctttctttattctcaaatcctgatttcatagatttacttaatattttttctatttctctgtatgtgttaatttcatttccgaaatcttttttataactaaatttagatgataaagttgattttatatcattttctatattttctaagccttcttttttcttggctattataggaattactttaacccctaactctttttctaatttttttgcatctatatgaatacctttagcttctgcaacgtcaatcatattaagtagtaatataattggtttattgtattgcataagttgtgtagttagatataagtttctatctaaactagatgcatcaacgatgtttaatattaaatctacattttcattttctaaaaattgcttagaaactttctcttcatttgagaatgtatccattgcatatataccaggaagatcgactatttttatatcttcacttataaatccttcttttttttcgatagtaacaccaggccagtttcctacatattgtttagaaccagtaagtaggttaaatactgttgttttacctacatttgggttaccaaataatgctacattaatcaaggtaatacctccttattttaagctaatattttttgcgtcactttttcttattgctaaatcaaaacctctaaaacgaactaatataggatctcctaaaggagctacttttcttacttctatttcagtttcattggtgcatccaagagctaataatcttttcgctaatttttcgtttccgtatatattatcaattatgcctttttggccaacttttaaatcgtaaacagtcatcattaacacctcctaatgagtttcattctcaattaattatactataaatatatcatttaatgttcaaaaagtcaataaatagtgaattatttaataaaaaaataagtaatctaattatcttattatgttaatatataattaaaacgtttatctcaaattggggagggttattaatgaatacaaagaagatgacttatatgtcattgatggttggatatagtttgatattatatataatagaaggatatatacctaatcctttaataacaatttttccaggagctaagttaggacttacaaatataattaccttaacttctttagtgatattcggtataaaagatacctttattattgtttctgttagagtattgatgtcatctatatttgcaggacctatatcttatctgatgtttagtatatcaggggcatatttaagtttactatttatgatgatagcattaaaagtagataaattttctattataggggtaagtgttataggagctataggacataatataggacagttaattgtagctagtttgattattaaaaatgctatgatgtttggatatttaccatatatgttaattgcatctgtaattactggaatattcgttggtattacatctaaatatatgataaataaactaccatatattggcaaaaaccgttattgacatggtggtgaaaaccttgttaaaatataagtggatacataaaattttaactgtggtgatgatatgactaataatgaattggctttactaaaaaaagaaatagaggtattaagagaagaaataaatacctatatagaatacccagatatatttaaagaagaattagttagtaccagtgctaaaattgatgaggcaataaataagtatatacaattaagtgaagagtcttctaaataataagaaggctttttttatttaagttaaatatttatagtgagtatattatttaaatattaagttaataatttatgattgaggatatatattaattgttgaaagaaaggtattaatcatgattttagcaaaaataataaactcaattattataattgtttgtgcttatattttattaaatttaataaaatattttctaaagaaaatatttgagttcacaagatttgacgttaggtatgaaaatactttaaacagtcttttatgctcaatggcatattatattatatttatttttactataatacttttgcttaaagaatttggtatagttgatgttactaaatttgggactttagtaacaggagctagtatagtagggcttatagttggagttgcctctcaaagtatattaaaggatatatttaacggattttttattatattcgagaaacagatacaagttggagattttgttataataaatgaagaattcagaggtacaatagaagaaattgggttaagaagtgttagcttaagggattgggacttaagaagagtaactcttccaaatggaaatatatctagtattaaaaattatagtaaaactaaaatgagagtcgttgcaagtgtaagaataccttatgaagaagatcctagaaatgttataaaagctttagaacaagtatgtgatatattaaatgaaagacataaggatattctatctataaaaaaaggaaaagaagcattagggtcatttaaggtatatggaataactgatatagaagagaatcctattggtgcaaaatatacgataacgggaactgttcaatctaataagtattttaaagtcataaaagatgctagacttcaaatacttattacacttaaagaaaatggtataaacatagcatatcctactcatataaatattattaaaaatgataaagatgaataaaaaaaagaactattttaaatagttcttttttttatttcaattaaattctagtcgtaataatgactagctcacacaaatataaataaatatatctatctatgagagggggggtaattatagcagctaaagaaattataacgagattattaatagctcttattataggaggattaacgggacttgaaagggaaaaatcatatcaatttgcaggatttagaactcatatattagtatctatgggttcatgcattacgtctgtaacatctgtaatattatttatggattatggaagtaaaacaagtgtagacccatcaagattgacagctcaggtattatctggaattgggtttttaggtacgggagcaataattaaaaattcaagtggtataagaggacttactactgcagcgggtatatgggcaactgcatgtatagggatagctataggttatggtcaatatatattaggaataactgcttggatttttgtaatggcaactctttatatattaaagaatatagataagattgtttttagaaaaaagcaaaatatacttactatacaagtagataatatcaatattatatctacaatttataacaaattagaaaaatctcagataaaaataagtaatattgatgtagtaaatgacgattattgttatattatcaatttttttattgtttatgataggcgaattatggtagaaaaaataatattagagttaaatgaactaaaaagtataataagtatagattatttacattaaaatatataaaataagaggtagctataaaaaagttgaggtgtatgaattgaagacaaacatgagagtaataatagaaggatctacagattttcccaaagaacttttagataaaatgggggtaaaggtcgtaggaataaacatagcatttggagatgaaaattatataggtggagtagacattagtgaggaaacgttttacgaaaaaatgaggggctgtaaggagttaccaaaaacatctagcccatcgcctgagaaatttatagaaatgtttgattgtgaagaagaagaaatattaattataacattaacttctaaattatctagtacgtatagtagtgcggtactagctaaaaatatatatttagaacataatccaggggtaaataaaagaattgcagttgtggattctctaagtggatctataggggttggattgatggtttataaagctaataaattaatacaagaagggaaatcgttaaaagaggtagctgaatacctagaaaatataaaaacagacttagcattttatggggtattaaatacccttgataatgctataaaaggtggaagagtaaatccaatagcagggaagttaataaatgcacttaattttaaagttattatagagatttcagaaggagtagttaaacctatagataaagctagaggggaaagtaatagtgtaaaaaaactacttgaaatagttaaaaataatgttaatgatacaacaaacaagacattagttataggtcactcaaattgtgaagaaaaagcttataaaattgcaaaacaaatagaagaaaattatgaatataaggatataataatatcaagtataggtccagttatgggaacatacacatcagaaggggctatattaatagcagtgctttaataagctaaaaaaaggagtgaagtaataatggtagatagagcttcgatagaagataaatttaaatgggacattgataatatgtataaaaccccagaatcaataaaagaagatattaaaaagatagatatgtttatatctgagttaaaaagttacaaaggtaaacttgcagatagtaaagaaaatctttacaaggtacttagtgattctgaaaatgcatctagaatacttcaaaacttatatgtatacactcatatgaaacaacatgaagatactagaaaaaatgaaaatcaagctaatgctacgaaaacagaaatgctttcaactgaattagctatggctacatcatatatggtgccagagataatagctatggatgaaaataagttacaagaatatttaaaggataataaattaagtttttataagaaatatatagatgaaattttaagagaaaaaccacacactcttacagaaaaagaagaagaaattctagctgcagcatctgacttaagtggagtagctgaaaatgtatatgaaatgttctcttttgcagatttaaaatttcccgaaataaaaggagaagatggagaaaatataagaattactcatggtaattattcatcacttttaaagagcaaagatgatagagtaagaaaggatgcatttgaagctgtttattcaacttatgatgaatataaaaatacttttgcatctactttatatggaggtataaaaagtgaaattttttatgcaaaaatgagaaactataaatcagctatagaaagttctttatttcaagatgatataagtgtagatgtatacaacaatcttatagatgcagttgatgaaagtttagatgctttaaataaatatatagatataagaaaaaaatatcttaaattagaaaaaatgcatatgtatgatttatatgtacctataacttctaattttgatatgaaaataacttatgaacaagcacaagaaataattttaaaagcattaaaacctttaggtgaagaatatttaagtatagtaaaaagagcttttagtgaaagatggatagatgtgtatgaaaatgagggtaaacaaggtggagcatattcatggggaagttatgattcatctccatatatattaatgagttataaggatgatttaaactctttatttacattaatacatgaattaggacactcaatgcatagttattactctagaactaaccaagaatatttatattcttcatataaaatattcgttgcagaggttgcttcaactttaaatgagttattacttgtacattacttattagaaaattcaacatctaaagatgaaaaaatatatctattaaattattacttagagcaatttagaactactgtgtatagacaaactatgtttgcagaatttgagaaaataacgcatgaaagagttgaagctaaagaaccattaacagctaaagaatttacagatatttattataaattaaatgaaaagtattatggtaagtcttgtgttgtagatgagcaaataggattagaatgggctagaatacctcatttctattctaatttctatgtatataaatatgcaacaggattttcagcagcaagtgctttaagtgaaaaaatattaaatgaaggcgaaagtgcagttgaaaaatacttaaacttcttaaaaagtggaggatcagaatatcctcttaaccaactaagagcagcaggcgtagatatggaaaagaaagaatcaatagagaaagctttaggagtatttaaggaattagtagaagaattagaaagagaatgttaattaacattctctttttttatttcttacaattagaatttaatatgtagtgttaaattctaattgtaaaagtatactttactttcttttaatactaatttacttttatttaacccaatttactttcagttaacatatatctaatttgaatttaacattaaaaatttattattaaagtataaagtagataacaaaaataataataaaggtcagcaattataaataatattaaaaatttggaggagatattatgttaagaaaaaggataggagttttattattaagtgcggtaactacaggattattaacagtaggatgtggatcatcagatttaagttcagctaaattatcaatatcaggatcaacttcaataggaccagttatagaaaaagaagcagaaggatttaagtcaataaacccagatgtatcaatagaagtaaaccaattaggttcatcagctggaataaaagatgcgataaatggcgtagcggaaatagggatggcatcaagagatttaaaagatgaagaaaaaagttcaggtatttcacaatcagagatggctattgatggtataggcgttataactcacaaaaacaatgatgtaaaatctcttactatagatcaggtaaaagatatatatacaggaaaaataactaattggaaagaagttggagggaaagatgctccaatagtagtagtttcaagagaagatggttcaggaactagagatgcattccaagaaatagttggatatgattcaacacaattaacaaaagaagctcaaataagtgatggaaatggaaatataaaatctacagtggcaggaaatgaaaatgcaataggatatacttcatttagctatttagatgaaagtataaattctactcaaatagatggtgtagatccgactgcagaaaatgctaagagcggaaaatataaattagcaagaccatttttattagtatataaagaagactcgatatcagaaaatggaaagcaatttatagactatgtgttaagtgaagatggacaaaagatagtagaggaaaaaggattgataagagttaaataatttctaagtgtttaagagttaaatggaggtatttatgttagctaaggagcaactagttagttctaaaggtaataaaacaaaatatactatagaaaaattagcaaagaatgtatttatggcgagtgcattattagcagtaataagtttgctacttataataggatttgttttttataaagggcttacaccatttatagcaaaagggtattcatttatagattttataacagggacaacttgggttccaagtgcaaataaatttggaattttaccaatgatagttgcatcaataatatcaactataggagctcttttaataggagcacccataggtattcttacagcagtatttattgctgaagttgctcctaaaaaagtagctaaagtaatatgttcaggtgttgatttacttgctgggataccatctgttttgtatggtttatttggattagcagtaatagttccaacaatgcaagagttatttaatttaccaaaaggacaaagtttgttagctgtaataatagttttatctataatgatgttacctacaattatatctgtttcacaaactgctataaaagctgtaccaaatgcatatagagaagggtctttagctttaggagcatcaaagatagagactatttttaaggtagttttaccagcagcaaaatcaggaatattagctgcagttgtattgggaacaggaagagcgttaggagaaactatggcagttatgttagttgcaggtaattcacctgttatacctaactctataatggatagtgtaagacccctaactacgaatatagcattagaaatgggatatgcatttggaacacatcaagaaatgttatttgcaacaggagtagttttgtttgcatttatattaatactcaatttgttattaaataaactttctaataaggaaggcatgtaatatgagaagattaaaagaaaatgtattaaaagctttaattttattatcagcaatatttactataagtgtgttagtagtgatagtaggatttataattataaaaggtattagtgggattaattttaaatatttaacaagtgattactctgctggagaaggcggaggaatattatctatgataattacaactttatatacagtatttttatctatattagttgcaactcctgtaggagtattagctgcgatatatttacaggagtatgctaaaaaaggtaaatttgttaactctgttagatttgccacagagagtttagcaggtataccgtctatagtatatggattatttggaggaatattctttgtaataactcttaaaatgggatattcaatacttgctgggtcattaacagtatctataataattttacctttaataatacgaacaacagaagaatcattaaaaacagttccaataggttatagagaagcatctttagccatgggagctactaaatttcaaacaatatgtaaagttataattcctagtgcagcgcctggaatattatcaggaataatattatctatagggcgtatagttggagaatcagcagcaatattgctaactgctggaacagttgcgaagatgccaactggaatatttgatagtgctagaacattaacagttcaatcatatttgttggctaaagaaactggaaatatacaagcagctgctagtgtaggagtggttttaatagtaatagtattatgcttaaatgctttagctaagtttatagttaaaaaatttagtaaggagatttattaggatggagaacattaaaataaatgtaaaaaacttaaaactattttatggtaataatcaagctttaaaaaacataaacatggaaataaaggaaagaaaagttacagcgttaataggtccttctggatgtggtaaatcaacatttttaagaacattaaacaggatgaatgatttaatagagaatgtaaatatagaaggagaaatatttgtcgatggagaagatatatataaatctgatgatgttataaaattacgtactaaagtaggtatggtttttcaaaaacctaatccatttccaatgagtatatatgataatgtagcatatggaccaagggtgcatggtataaaagataaggaaattttagatcaaatagttgaagaaagtttaaaaggagctgctatttgggatgaagtgaaagatagattaaataagtcagcattaggtttatctggtggtcaacagcaacgtatatgcatagctagaactattgctatgaagcctgaagtaatattaatggatgaaccaacatctgcgctagacccaatatctacgtctaaggtagaagaattaattaatgaattgaaagataaatatactatcgtaatagtaactcacaatatgcaacaagcggcacgtgtatctgatgaaactgcattcttcttatctggtgaggttattgaatttgatgaaacaaaaactatatttacgagcccaattgataagcgtacagaagattatataacaggaagatttggttaaaatcagatttattatataaaacaatttataaaaaggagttttaacatgatcaacagtagcttggagttaagtataaatactcttattaactatacactaaaaatgattgataaatgtgaggaaattctagaagattcaatgaagtgtatgataaataaagatataaaaaacgctagattaatagcggataaagatgatgaaatagatactttaagagattatatacgagatagaagtattgaacttatggcattaaagcaacctatggctaaagatttaagatttatatattctttaggtagcatatccatagaattagagcgtataggagattatgctgttaatatagctgatgaagttataaaaataggtagtgaagaatatataaaggaattagtggatattccgaagatgaaagatgtttgtatagatatgttagaagatattaaaaacgctttgaaaaatagagatgcagaacttgcctataaagtagcattaaaagatgatgtagtagatgatttatatgaatgtgtgcaagttcatacacttaaagtaatgcatgaaaaagaaatgaatatagaccaaggcgtacgtatagtatttgtaggtagatatttagaaagaataggagatcatactacaaatatatgtgaaaaaataatatatgccttaaaaggtaatatggtggagattggataaaactacaaaattaagtagttttatttttttgtattaatatttctaagactataaacatatttatttaaatataatatcaaattaaaaaataaggctatatacattaagataagtgtcaataatcattaataatatagtgtttattaataatatgaaggggaatttgggatgagtagaagaataaaacctatttttttaaatgtgtttatagtaggagtacttttatttttaatatttattacatgtgataatataattgaaacttcgaaaagttatgatgaagaagaaatagttttactaaatagtgaaaatatgacattaacacagcttatgattagtacaactaaagtaaatgaaagaggacctaaaccaaagcctgaaaaagttgcgtatataacaattgatgatgggccatcaaaatatactaatgaaatacttgatatattacataaaaatgatataaaagctactttttttatgatagataaaaatatgaatagatattctaatgaattaaaaagaatagaaagtgatggacattctttgggatttcatagtgtaagtcatgacataaatattttatacaaaacaccaaagactacagtatctgaatttgataaatgcaataatagtctagaagaaataacaaataaaacgtcaaagttaatacgattaccatatggaagtaagccttatgcaccaaaagaatcttatgatgcactagtagaagctggatataaaatatgggattggaatttagatacacaagattggagagctacagataaagagataataaaaaatgtaaagacatatttaggacaacataaagaagtagtattacttatgcacgaaaaagagcaaagtgttaaggcacttcaaggaatgatagatatattaagagaaaaaggatatacaatacttcccatagaagaaagagataaacctaaaaattattgggaacaaaacttaactaattgaatataatatttataaatattgacaataataatagtgattatatataattaaaagataaatagaataattaaaaactaagaaaaagaggagtatgcaaactcaacttacagagaggaaagttcatcggctgaaaaactttctaagaaatgaattgcagaaggtagctttggagtttctaagctgaaatagtagtaggtttagacggtgagaatcgttaaatttattaagggttatataaattttaatttaagatttatataaaattaaggtggtaacgcgagcttttcgtccttaaatggatgaagagctcttttttaatttatagaaaaattattttcaaatacaaaaataacaggaggaatctatatggaaaatactaatttaccaaaaacgtataatccaaaagactttgaatcaagattatattcaaagtgggtagaagagggattatttaaatctaagccaaacccaaataaaaagccatttacaataatgcttcccccaccaaatataacaggacaattacacatggggcatgctcttgaccatactttacaagatatacttataagatggaagagaatggacggttatgaagctttatggcaaccaggaacagaccatgcatctatagcaacagaagttaaagttgttgaaagaataaaagaacaagaaggaaaaactaagtacgagttaggaagagaagagttcttaaaaagagctatggattggagaaatgaatttggtagaaaaatagttgaccaaatgaaacaattaggagattcttgtgactgggatagagaaagattcacaatggataaaggctgtaatgaagcagttacagagttctttgtgaaactatatgaaaaaggtcaaatatatagaggaaacagaataataaactggtgtccagattgtaaaactacattatctgatgctgaagttgagcatgaagaacatgatggaaagttctatcacataaaatacccaatagcaggtagtgatgaatttttagaaatagctacaactagaccagaaacaatgctaggagatacaggtatagctgtaaaccctgaagatgaaagatatactcacttagtaggaaaacatgcaatacttcctttagttggaagagaacttataatagttgctgatgactatgttgatttagagttcggtactggtgcagttaagatgactccagctcatgaccctaatgactttgaagtaggtcaaagacacaatcttgaaaagataaatgttatgaacgaagacggaactatgaataagttagctggtaaatacgaaggtatggacagatatgagtgtagaaagcaacttatagctgacttagatgaagctggatacttaatagctataaaagatcataaccacaatgtaggttcttgctacagatgtaaaacagtagttgagccaagattatctgatcaatggttcgttaagatggatgaattagcaaaacctgctatagatatattaaagaaaaaagatttacaatttgtacctgataagtttgacaaaacttacttacaatggttagagaatataagagattggtgtatatcaagacagttatggtggggacatcaaataccagcttactactgtcaagagtgtggtgaggtagttgtagctaaagaaatgcctacagcttgtcctaagtgtggacatactcactttaagcaagatgaagatgtactagatacatggtttagttctgctttatggcctttctcaactttaggatggcctcataatacagaagaattaaattactactatccaacaagtgttcttgtaactggatatgatataatattcttctgggttgtaagaatggcatttgcaggaatgttctgtatgggagaagctccatttgaacatgtattaatacatggactagttagagactcagaaggtagaaaaatgagtaaatctctaggtaacggaatagatccattagaagttatagaccaatacggagcagatgctttaagattcatgttagctactggaaactctccaggaaatgatatgagattctatatggaaagagttgaagctgctagaaacttcgcaaataaattatggaatgcatcaagatttgtattcatgaatatagatgaagatataatgaaaggtgttactagagaatcagtagaaggtaatatgactttagctgataagtggataatatcaagagctaataatgttgttaaggaagttactgacaatatggataagtttgacttaggaatagctgctcaaaagatatacgactttgcttggtcagagtactgtgactggtatatagaaatagttaagccaagattatactctgatgataaggctgctaaacaaacagcactatatacattaacttatgtattagagaagatattaaaacttcttcatccatatatgccatttataacagaggagatatacactcatcttccaactgtagaaggaagtatagtagtagctgagttccctcattataatgaagctgacaatatggctaaagaagaagaaatgatgaacttaacaatggatggtataagaaacataagaaatgtaagagctgaaatgaacgtaccaccatcaaagaaagctaaagttataatagttccaacagctgaaaagaaagaagctatggaagctggacgtgattactttgtaacattagcatctgcatctatagtagatatagttgaagatgaaactaacataccagaagatgcagtaagtgttgttatagacggagttaagatattcatacctcttgatgagttagttgactttactaaagaattagaaagattaaataaagaaaaagctaaattagaaggcgaaataaagagagttaacggaaaactttctaatcaaggattcttagctaaagctccagaaagcttagttaatgaagaaaaagctaaaaaagaaaaattcgaagaaatgatgaagtcagttcttgaaagaatagaaaatatagaagctaaaataaaataataaatctaaaggagctatctcgtaacagagattagcttctttttttataaaatagaaaaatgtaaattacttgtataagattatatatatccattatagttgctttatcttgtttgatgacataaagtagataatctattataatgtttatagtttgtataaaatcataaaatagaatatatatgattaatatagatatagcataaaatacgtattatgaattaaagaaaggacgatataaattgacaatagcattacctcaaaaatttttagaagatatgaaggaaatacttaaagatgagtatgatgattttataaaaagttatgaagagccaaaaacaactggattaagagttaacactctaaaaattagtaaagaagaattactaaatttaaatttatttaacttaactcaaattccttgggctaatgaaggattttactatgatgaaactgtagatagaccgggaaaaaatccacttcacgaagcaggagcatattacttacaagaaccatcagctatgagtgttgtaccaaaagtagatgtacaagaaggagataaagttcttgatatgtgtgctgctccaggtggtaaatctacatatatattatctaaattaaatgatacaggactgttagtttcaaatgaaataaatcctataagaataaaagcgctaggggaaaatctagaaagatttggagctaaaaattgcattataactaatactgattctaataacttaagaaaagtatttacaggatattttgataaagttgtaattgatgcaccttgttctggacaaggtatgtttagaaaagatgaagtagcgataaaagattggtcttatgcaaaggtactagagtgtcaatctatacaaagagaaataataagagatggatataaaatgcttaaaaatggtgggatattagtatattcaacatgtacatttgcaaaagaagaaaatgaaactataataaatgaatttatagaagaatttgaaaatgcaaaactaatagaaatggatagagtatggcctcataaagtaaaaggagaaggtcattttgtagcaaaaatacaaaaattagaagatgaggactgtgctactaaagagttaaaaacaaaaagattagacaaagaaataaaagattataaagattttgaaaagaagtttttaaatgtaaatataggaaataaatttgatttaagaggagaaaacttatatctaattccagaagaatctccagatacaaaaaaattgaaagtattaagatatggacttcacttaggagtattaaagaaaaatagatttgaaccatctcatgcactatctcattatctaaaattagaagatgtgaagaatgtagaagaattcaaagttgatgataatcaaattttagactatttaagaggaaatacaataaatacaggaaaaagtagaggttgggtcttagtatcagtagaaggagttcctattggatggggaaaagaatcaaatggagtattaaaaaatcattatccaaaaggacttagaataaattattaattagtgtgtgaaaacaatgtatttgtagaggattaattaagtgttttgacgaaattaagtatcatataaataaaagtacttaattaacgcagtatggaggaatgatatgaactataatgaagcattaaaatatatacatgaaagtcataagtttggaatgagattgggtctagacaatataaaaaaattattagagctattaggaaatcctcaagataaccttaaaataatacatgtagctggaactaatggtaaaggatcaacatgctcattcatatcaacgatattaaaagagagtggatacaaggttggattatatacatctccatttttagaaacttttacagaaagaataagagttaatggagaaaacatccctgaaaatgaagtagctaagatagtgaaaataataaaagaaaagatagaagtcatggtcagcgaaggatattcctatcctactgagtttgaaatagtaacagcaatggcattttattactataatcaagaaaaagtagattttgtagctttagaggtagggcttggaggaagatatgatgctactaatgtaattgataaaccattagtaagtgttatagcatcgataagcttagaccatacaggaattctaggagataccttaggaaaaatagcttatgaaaagggtggaattataaaagaaaattgtacaactatatcatacccacaaaaggaagaagcaaaattagttataaaagatatatgtagtgaaaaacaatctaaatatatagaatgtaattttgacgatataaatataaaagagtcaaatgttaattatcaaaaatatgactgtattgtaaatggaagaaagtatgaaagtctagagataaaattaattggagagcatcaaataaaaaattctgtattagctcttaatgttatagattatattaaagaaaatgaaaatattaatatatcggaagaaagtataagaaaagggttaattgaaactaagtggccaggaagaatagagaaaattaaagaaaaccctatgtttataatagatggagctcataatgaagaaggggctatgtctttagcaaagtctatagataaatattttgaaggtaaaaataaaattttagtaataggtatgcttgaagataaagatatagattcagtattagagatattaatacctagatttaataaggtgataacaactatacctgataatccaagagcaatagatgctaataaacttaaagaaaaaataaataagtttaatatagaagtagtttgcaaacctaatataaaagatgcagttacttacgctttagataattctaatgaagaagatgtaataataagtgcaggatctttatatatgataggaactgttagaacaataattaataatatgtaacaaaaaagagtttgaaaatgagattataatacctcagcttcaaactcttttattattatttagataattgatcacgtaatgccttagataattggtcaggacaagatgtagatttgcctccgcaaggtattcctgctaatttttcagctatctcatctgctggtcttccttcaattaaatgtttaagtcctattaaattaccaggacatccacctacaaaattaacacttttcactatgttattttcatcaatatcaaatgttatttctttacaacaaacccctgatggcttaaaatttactttcatttataattcctcccaagttgtgttaaataaataatatcaaagaatgacaatgtatttcaagaacaaaattagtaataagacaagtatttaaagcaatatactatggtagtacaatttattagtaaggaggttttattttgaagctatatacatctaattatttatcacaaagcataagtgttatagattataaaactcttagtttggagaaagaaataaacctaggaccagatatatatccacatcatttttgtatagatagagaaaaggatataatatatatacctagttcttttgatggagtgttatatgtttttgatatgaaaagtgacaagattatagattctgtatctataggcggaaatcttagccaagtatctctttgtgaaaatgagttatttatagcaaatgaggattctaatagtatatacgttttaaataaaaatacattagaacctataggtgttattagcgtagataatatgcctcatgggtttgcgtttgatgataaatcaaataaattatatgtaccatgtatagactctatattatgtatagatataataaaaaagtgtatagaaaagaagataaacatagactataaagcatggcatataagaatagataataaaaaggatttaatatatacttctaccttagatggtaaaataatagttttagataagtatgaattaaatatagtagatattatagataatctattaatacctgttgaaatttgcatagactatgaaaatgaacttatatatatagcagatttaggatataaagctataaagattttagattataatacatatgagtatttaaactgtataaaaattgatggaaatcctcaaggattagagttatctaaagataacaaatatttatttgtaacagatactactaataatagtataaaagtatataaaacaaatgaaaataagttaatggatgaaattaaggtaggaaaagagcctactactattatatttgtgtaggctcttttttacttgtaataagcaagtctattacttcagcatacatataagatgcgttctttttccaattatcacatattagtttagcttgtttttcggaagacacatttaaatttaaatctattaggttagattgattttcaataactcttagatttactatgtattcattatcactttgtctaacaaaactagatttaacttgagtatcagctaataagttttctttgtttaatttaatgtattcatctatcttttccgtaatttgagcaggaatcctagataggaaatattctagagcttcaatacccttttgcgttaaagtataatactccttatttgaatcttcatatatttttaagaagttagaatccataagttgtgatagaaattgctgtaatgaaaaataattcattacctctgtctcaagaataacttgagtaatttgagaattagttaaatccatatttgttttttgtaaaacatataaaattaataacttatggtaagctaattcttcagatgagttttcaaacataatatcatcctccgtgtaatgtttctatataattatattaaactaaaacatataaaaataaaagtacaaattaagaattacgtaagcccatatatgtgatttttatatgcaatcattcaaaaaggctacctatacaggtagcctttttccttgatgtctaatttactacttatttgccagccatttgtttttctgccatttctactagctttttagtcatgtatccacctacataaccattttgtctagcagttaagttacctttgtctattgattcatagtttgataaacctaactcattagctatctctaatttcatttgatttaatgctgctttagcttctggaacggcttttctagatgatgatgacatagtaaatttcctccttaaatgttagatgtcttacgataacaattgtgttgttatcgttgatattaatttaaccaaaataaaattttatattcatatttaaaaaattttatttgaattttttattgatctttatttttctatcttttcttataccttcttgtattccatgggcctctcttaggaaatgagtactatttaattttacacttctttgttcattattttcagcttttccttttaatacaccaaattcacttcttaaattattcaatataaacaccacctttataatgtattacaattaattttcccaattaacaaaattaatttagtagtaattttttgaaaaaataaacttgtagtaaagtagttataaataaagaaattttatttttagtatggataacgtgaattttttagacacttaaataaatataaaaatttaggttcaaatattttttaatataatctatatagtataatatattttataaataagtgtttttagggaggttatgatgttttctgtaccagaaactaaaattgtaaaagacgtaatgagtaagaaattcgtattggtagatgagaatattactttagggcaagctatagatttaattgtaaaagaaaatgaaagagagattatggttgatgatggaaatgggggcatcaaaggaataatatctctgacagatatatgcaatttatctgcaaaatgcaaagattataaaaatgaattagtaaaaaatattatgagtaaagatttaatatttatagatatgtatgcaaaattagatgaatgcagaaatataatgatgaaaaataatataggagtattacctgttttagaaaataaaaaattaataggagtaataaatcaaaggcatataagagattttttatacatggaactagaagattatggaataactattaggcatattataggtgagataaaagaaggtatatgtgctattaatacagatggaaaagtagttctttggaataagtttatggaaaatagatatggaataaagtcagagcatgtggttggaaagagtatagaaacgtatcttagagcaactgtatcatctaaagttttaaaaactaaaactagagaaagcggtatatataaaattgaagatagtgatgtttacggattggtagatgcaaatcctatatttataaactctgaatttgtaggagttgtatgtacggaagttgatataactgaagctaagaagctttctcaaaaattagataaagcaaatgatagattaaaatatttagaagatgaagtgaaaaatttatcaaaaggaagttttgataatattttaggaagaagctataagttagaaagagcgaaagaagttgcaaagagggtatcaaagactactagtagtatatttatatatggagaaagtggaacaggaaaagaagtttttgcaagagcaatacatgattatagcgaaagaaaaggtcaatttatacctgtaaactgtagtgctataccatcagaattatttgaaagtgaattttttggttatgaagctggagcttttactggagccaataagaaaggtaagatgggtatatttgaacttgctaaagatggtactgtatttttagatgagatagcagatttaccattaagtatgcaagctaaattacttagagtattacaagaaaaagaagtgagaagaatcggtggagaaaaaaatataaaaatagatgctagaattatatctgcaactaataaaaatttacaagaattggttgaagctggtaagtttagagaagatttatactatagattaaatgtaatagaagtagatttgcctccattaagagaaagaaaagaagatatattactattagtagataaatttatagaagaaatttgcaaatctaataatagaaaaaaattaaaaataagcaaagaatctatggatatccttcaaagatacagttggaaaggtaatataagagagttaaaaaatactatagagaacatagttgtattatctagagggaatataattgagaaagatgatatacctatgtacattgtagaatcaagcgataaaaataatataaatgaagattatcctctagatttaaatcaagcaataagtaaattagagataaaaactataaaaaaagcattagaaatggcaaatggaaacaaagctaaagccgctaaaatattaaatataccaagaacaactttatattataaaatagaacaatacaatataaatgtgtctaaaaatagacagtagacgaaaaactgacattatttaaagttaacttaaggggtagttatatagaggtctgtgataaaaataactaaatgtttttacaaataattttgaaaaagtgtcagaaattagacggtataggtgggaaaacgtaatttgttggaattttttgatgataaataatataaagtagatgttttatatgaatataaaagtgggaaaagtgtcgaaaaatgttattttataaacaaataaatggtttattatcaaaaaaataaacaacattaaaaagttggcatggtaattgctaataataaaatagtgttaaataaaatagtcagggggtagaatccatgatgcttaagatagaattaagacagcatgtaggggctccgtgtaaaccgatagttgaggtaggaagtgaagttaaaaaaggacaacttgtagctgaacctcaaggattaggtgctaacatacactctagtgtttatggtaaagtagttgatataacagactctgctatattaatagaagctgatgaaaatcaaccagaagaatttgtaaagattaaagaaactgaaaataatcttgaagccataaaagaagcaggtatagttggtgcaggaggagctggttttcctacacatataaaacttaatgtagatcttacaggaggttgcataatagcaaatgcagctgaatgtgaaccagtacttgggcacaatgtagaacttatggaaaataatcctgaaataatagtaaaaggattaaagtatatgcttgatataactaaagcagataaagcatatatagctgtaaagcctaagtataaaaaagcaatattagctttaggaaaagcttgtaaggatgaaccaaatatagaattaaaatatttaccagatatgtacccagctggtgatgaaagagtaataataagagaattattaggaataactcttgtaccaggacaacttccaatagaagctaaaactgtagtttctaacgttgaaacaataaagcgtatagtagaagcaatagaagaaagaaaaccttttataactaaggatataactgttggaggaagagttgtaggggcagaaaatcatggcaaggtatttatggatgttccaataggaatgcctgtaataacatatatacaaaaatgtggtggatttataaaaccttatggagaaatagttttaggaggacctttcacaggaagacatggtgaagaggaaagccctatcactaagacgctaggaggaattttagtatcaatgccacttccacaagaaagcagaaagttaggaataatagcatgcgaatgtggagcacaagaagacagattaaaacaaatagcctctttaatgggtgctgaagttgtagctgaagaaaaatgtaagagaatgacagaggtaaacggtagatttagatgtgatttaccaggtatatgcccaggtcaagcagaaaaagttcttaagttaaagagtcaaggagctgaagctgtactaataggtaactgcgaagactgaacaaacacagttatgcaagtggcgcctaggttaggtttgcctgtataccatagtacagaccatgtattaagagcttcgggacatagattatatagaagaaaaaaataatgctaggaggtattagaaatgtcaataactgtagaaacagctaaagctcatgctaaagatccagcggtttgttgctgtagatttgaagcagggactgtgctagaaccatcaaatttagaagatccagcaatatttgctgacttagaggattcaggattattaacaataactgatgattgtttaaaaatagaacaagttttaggagctaaattaactaaaactgttgatgctttaactccactaacacctgattgtgtagaaggtatagttgtagaagaagaagctaaagaagaagttgaagttgaagaagttaaggaagtagcaccagttgcttctgtagcacctgtagctccagtagcagcaagtggacaaactataaagatacatataggtgaaggtagagatataaacttagaaatacctctatcagtagctcaaggtatgggtgtagcacaacaagcagcaccagttgtagctgaaactgtagaagctgtagaagttaaagctgaacctgttcaagaagctaaagcaataagaagcttaactaaaaagcattttaaaatagacaaagtagttttcgctgaagaaactaaaatagaaggaactactttatatttaagaaaaccagaagagttaactaaggaagctgtagattcagaagaattagttgttgatatgaaacttgaaataataactccagctgaatataacaaatatagcgaaactataatggacgttcaacctatagctgctaaagaagaaggagaaataggtgaaggtgtaactagagttatagatggagttataatgatggtaactggtacagatgagaatggagttcaaataggtgaattcggttcttcagaaggtgtactagaaactaatataatgtggggaagaccaggtgctcctgacaaaggtgatatattcatcaaaactcaagtaacagttaaagcaggaactaacatggaaagaccaggacctttagctgcccactgtgcatctgattatataactcaagaaataagagaagctttaaaacaagctgatgaatctttagtagttgatactgaagaattaactcaatatagaagacctggtaagaaaaaagttgttgtagttaaagagataatgggacaaggggcaatgcatgataacttaatattacctgtagagccagttggaacattaggagctaagccaaacgttgacttaggaaacgtaccagttgtattatctccacttgaagtattagatggtggtatacatgcattaacttgtataggacctgcatctaaagaaaactctagacattattggagagagccattagtaatagaagctatgcatgatgaagaaatagatttagtaggtgttatatttgtaggatctcctcaagttaatgctgagaaattctatgtatctaagagattaggtatgatgatagaggctatgggtgttgatggtgctatagtaacaactgaaggattcggaaacaatcatatagactttgcttctcacatagaacaaataggtaaaagaggagtagctgtagtaggtgtaagtttctcagctgttcaaggtgctctagttgttggtaacgaatacatgaaatacatgatagataacaataaatctaaacaaggtattgaaaatgaaatattatcaaacaatacattatgcccagaagatgcaataagatctttagcaatgttaaaaacagtaatgggtggagaagaagttaaagctcctgaaagaaaatggaatgctaacgttaaattaaataacgttgaattaatagaaaaagaaactggtaagaaaatagatcttgttgaaaacgagcaaacattaccaatgagtgaaaaaagaaaaaatatatacgaaaaagacgctaaatagtaaaagacgttaattgattatggaaggatgaatgaaaatggatagattaaaatatatatcaactgaaagaatgtatgaaggagtaatagtagagataactgacggtggggtcactatagacttaaaaggcagattaggccaatttaaaataccgaaaagaatgcttataactgactatgaacttaagcttggtcttgaggttggatttatgttaagttatccagaagtattaagtccagaacctaatcaaaaatatgttgacataatagaaagaaataaaaaaataaaccaagaggatttagataaatagaagggagaggaaaaatatgagccttacaacaataaaaggacttcaatctgaaatatatgttccgataacacctcctccagtttggactcctgtaactaaagaattaaaggatatgactatagctttagctacagcagcaggtgtacacttaaaatctgataagagatttaacttagcaggtgactttacttatagagaaataccagatacagcaactactgatgagatgatggtatctcatggtggatatgataatgctgacgttaacaaagatataaactgtatgttccctatagatagattacatgaattagctaaagaaggtttcataaaatctgtagctccagttcatataggatttatgggtggtggtggagaccaaactaaattcactgaagaaactggtcctgctatagctaaaagattaaaagaagagggagtagacgctgtagttctaacagctggctgaggtacttgccatagaactgccgtgatcgtgcagagagcaatagaagaagctggtataccaactataataatagcagctcttcctccagtagttagacaaaacggaactccaagagcagttgctccattagttccaatgggtgctaacgctggtgaaccaaacaacgtagaaatgcaaacacatatattaagagatactttagagcaattagttaaaataccatctgctggtaaaatagtacaattaccatacgagtacgtagctcaagtataatagataacatagcccttctctataattagaggagggcttatataaaaggtgatatacgtggaagagaaaatacttagacgattagtcattaaaccatttcatataaataatgttgaattcaatgataaaatctcaattaaaaaaggtactctatctataaataacaattacataaaaaaaattcttaaacaggaagaattaataacagatataaaagtagatataatcaagcctggagattatgacaaagaaattaataccataatggatataattcctatatctaccaaagttttaggaagacttggagaaggaataacacatactttgacaggtgtatatgtaatgcttacaggagtagatgaagatggaagacagatgcatgaatttggttcttctgaaggaatattatcaaagcagatgatatttggacgagcaggaaccccttctgttaacgattatataatacattttgatgtaactgttaaaggtggtttaccatatgaaagaaagcttccattagcagcttttagagcttgtgataaatttatacaaactataagagaagatttaaaacagcaagatggaagagatgctacgcaagttcgtgaatattttgacagaataagaccgaatgctaaaaaagttgtcatagtaaaacaaattgcaggacaaggtgcaatgtatgataatcagctattttctcaagaacctagtggctttgagaatggtacatcaataatagatataaaaaatgtgccaatgataatatcacctaatgaatatagagatggtgccttgagagctatgacttaatgaggtgagattatgggaataggaccatcaaccaaagaaacatctctacaccactttagagatccacttttagatattgtagggaatgacaaagatatagatcttttaggaatagtagtagtaggaacaccacaagataataaagataaagaatttgttggacaaagaacagctgcatggctagaagctatgagagctgatggagttataatttcttgtgatgggtggggaaactcacatgtagattatgctaatactattgaggaaattggaaaaagagatatcccactagttggacttacgtttaatggaacacaagctaagtttgtggttaccaatagatatatggatacaatagtagattttaataaatcagatgaggggatagaaactgaagttgtcggcgaaaacacagtaaatgagttagatgcaaaaaaagcactagcttttctaaaattaaaaatgaaaaataagaaataaaaaaattaatatatagggggctgtacaatgaaattttcaagaagtatacaagcgatagattctcatacaatgggcgaaccaacaagaatagtaacaggtggaattcctaatataaaaggaaaaacaatggctgagaaaaaagcttacttagaaaacaatctagaccatttaagaactgctataatgctagagccaagaggacataatgatatgtttggttctataataactcaaccttgccatgaagaagcagactttggaataatcttcatggatggtggaggatatctaaacatgtgtggacatggttcaataggagctataactgctgctgtagaaactggtatggtagaaatgaaagagcctgtaactcacgttgtaatggatactccagcaggtatagtaaaaggtgaagctaaagtagaaaatggaaaagttaaaggagtttctatagtaaacgtaccagcatttttatataaaagagatgttcaaatagaaatgcctgaaataggaacagtaacttttgatatatcttttggtggaagcttctttgcaatagttaaagctagcgaattaggattaaaagttgaacctaaaaatgctcaaaaattaactgaaataggtttaaaaatgagagatataataaatgaaactatagaaatacaacatccagaattatctcatataaaaactgtagatttagttgaaatatatgatgagccaactcatccagaagctacttataaaaatgtagttatatttggacaaggacaagtggatagatctccatgtggaacaggaacaagtgcaaaacttgcaacactacatgcaaaaggtgaattaaaagagggcgaattattcgtatatgaaagtatattaggaacactatttaaaggaagggtagtaggaactgataaagtagctgattatgatgctataatacctgaaataacaggagctgcatatataacaggatttaaccattttgttattgatgatgaagacccggtaaaatatggattcatattaaagtagtatagtgctaaaaattgacttataataaatatgattaaatgcttttatagtatttaatcatatttattgtgtaagacatttttaattaatatcagtaggaggaattataggatgttaaatttagtaagatttctattagcagcttttatatcattatttagttttaatttctttagagatttattaaaagctaaggcatcaaacaagtttgagaacgtagcagcatggaaagctcttttaacaggatttgtaacagatttttttgatgccttagggataggttcttttgcgcctacagtggcaatgatgaatgtattaaaagtaaatatacatgatagattattaccaggaacattaaatgtatgtcatactataccagttgttgttgaggcttttatatttactactgttatagatgtagatgcaataactttaataagtttattagcagctgcagtagcagggtcttatataggagctggtataatagctaagatggatgaaagaaaaatacaaatggttatgggacttgcattagctgtaacagcaatattaatgttattagctcagttaggattaatgcctggaggaggaaatgatactggattaactggttataagcttgttataggtattgttggtaactttatatttggagcattaatgactgcaggagttggattatattctccatgtatggctatggtgtatttcttaggaatgtctcctaaagtagcattccctataatgatgggatcttgtgcattattaatgccaatagcaagtgttaagttcataaaggaagaagcatatgctaagaaaacttctttacttatatctataggtggggttataggggtaataatagctgtttactttgttaaatcaatgcctatggaaatcttaagatggttagttataattgtaatagcatacacttcaataactatgttaaaaaaagcattaactagtagccgagcttagataagacaattagataaaataaaaaatgtaccgtattttaagatgcggtatattttttattttttgccatataaaaagtgttttattgtattttctttttacaaagcagtaataaaattaagcacatataaatatatttattatatagattcaagataaaatatggtaattaacaattttggggggaataatatgataaatttaaaggaagatactaacatagtaaatttaagaggagaacttgaagaagaattgacatttagccatgaaatatttggggagaaattttatagtgcaaaaattaaaatacatagattaagtgatacatatgatgttttgcctataactatatcagaaagactattacaagaagttaatttaagtgaaaataacttaattgatgtagttggtcaattaagatcatataacaaaaatatagatagcaaaaataaattagtattaactgtttttgctagagaaataaaagatgtagaggaagatactaaagacccaaatagtattttcttagatggatatgtatgtaaaaatcctatttacagaaaaactcctttaggaagagaaataacagatttacttgtagctataaatagaccatataacaaatctgactatataccatctatagtatggggaagaaatgctaaatttgcaaagaatttaaaagttggcgatagaatacaaatgtggggtagggttcaaagcagagattatgaaaagaaacttgataatggagaggttgaaaaaagagttgcttatgaagtttctatatcaaaaataaaaagattagatgaaaataatataaactaaatatattacgtttaggaaaaccatattaaaaaaattatttaaaatggttattgaatagttgctcgtgatttattataatctattctatgatgtaaaaacaaacactgaaaagtagaagggggagcactgtgaaaagcgtagtacaatggagttacgaatcaaattactctgcagaggatgccgaagaagacatattaaatatgataagatatactataggagaaaaaatccttctggtgggaaatataggtaccttaggtaagagattaaggatgatgggagtccatgttactatacttgaagatagtgcatatcatgacatatgctactctttagtgcacaatgaaaattgtagtatagttaagggctgcttagaattattacctttttcagaccaattttttgataaagtgattgtattaagtcaattcaactatactaataaccaaaataaagctttaaaagaaatccacagggttttaaatccagatggagaagttattttgcaagatcccaatttagaaaaatttaagataaaattaaaatgtatcaaacacagattattcggagaacgtataaaatattattctcctaaagagattgtaaaaaagcttgaacattcaaactttaaaggtgttttagaaaatttaaatagtgataagtatatttatataggaagaaaaattattaaagactaggttatacctggtcttttgttataggaggaaatttaatgaaaatacattatagtatgataattatagtcatgttatttgtaatattagtatcaatacagtatactttaaataagatatacaaaacacttaatgaaatgaaattactaatgtacaaggatagactaagggatggaaaatatgattaatttaaactttataaaaagagacatacaaaatatagcagaagctatatcatctgttttagaaattgatgtaactatagtagattcaaacttagtaagaatagcaggcacaggtacatattttaagaaaataggtcaacagttaagggcatattcagcatttaagtattcattaacaactaaaaaagaattaataatagaagacccaaaaagcaataaaatatgtaatgaatgttatagtagtggagtatgcaaagaatttgctgaagtatgttgtccgatagtttatgataataagtcttatggggtaataggtttaattgcatttacaaaagaacaagcagatgtaattaaatttagaaaaaaagatttaatgaatttcctacataaaatggcagacttaatatctagtaaattaaaagcagaaataaagacctatgaagtagaattagaaaagaaaaaactagaaactttattagataacatggataaggcagtagtatctttagatgtaaatgctaatatagaaaaatacaacttaaagtttaaagaagtatttgatataaaaagtgatataataggtagctttataggagatgtattaaaatttataaaactaaataactttaatagtataaataatgataaaacttataactttatttatagaggagatagtaaagaatttaaggggatttataatataaagcctataatattaaatgatgaacttaaaggatatgtcctagattttatagacagggtagatgctataaaaaactataataaaatgagtaatgaccatagaatatttttagataatataattggaaatagttatgcaataaataaagctaaagaagaagctttaatggcatcaaaaaccagttctacagttttgataacaggagaaagtggtacagggaaagaactatttgcaagagctatacacaatcatagtcatagatcaggaaatccttttatcgcgataaactgtgcagcaattcctgataatttacttgaaagtgagttatttggatatgaagaaggagcatttactggagctaaaaaaggcggaagtttagggaagtttgaattagctgataaaggaactatatttttagatgaaataggagatatgagtttacacttacaagctaagttacttagagtattacaagaaaaagaagtggacaaaataggtgctaaacataatgtaactatagatgttagaataattgcagcaactaataaagatttagaagatatggtaaaaaagggaacgtttagagaagacttatattatagattaaatgtgatacctgtagttttaccaaccttaagacaaagaaaaaatgatatacaccttcttatagaatatatgataagagaatactcaaacaagttaagtaaaaatgtagaaggtatagatattcaagcaatggaatatctttgtgaatacagttggccaggtaatattagagaattacaaaatgttatagagtatagtgtgaatagatgtgaaggtagcacaataaatcttgataatataccaaatagaataaaacatagccattcaaataatgaattaaatataaatacaactgaacaaattgttacattagatgagttggaaaaaaatgaaataataaaagctttagaaaaatataagaattataaaaaagataaagatttagcagcaaaagccttaggtatatctagagctacattgtatagaaaaatagataaatataaaatagtctcaaaatgatacttaatatcattttgagactattttttttctaaatgagactaaaatgataaaaaagtgtcgaaatataattttaaatatagtaatttcaagctttaaaaaaacattttcatttggcatggttcttgcttttaataaaatacataaatattttatagctatctaggaggagatcaaaaatgaaaaatttacaagaaaaattagttaacatattaagagctgaggttaaaccagcattaggttgtacagagccagttgctgttgcattagcatgtgctaaagcaaaagaaacattaggggaagatgtagtaaaatgtacaataggacttagcccaaatgtatataaaaacggtatgtgcgtaggtataccaggaactgatagattaggattaaaaatatctgcagcaatgggtcttatcggtggaaaatcagaaaatggattaagagtattagaaacattaactaaagatgatgttaaagttgcagaagacttcatggataataatgatataaatatatcaccaatagatacagatgaaaaagtatatatagaagttatattagaaggtaaaaacaatacttctaaagttgttataagaactaaacatgacaatatagtatttgtacaaaaaaatgatgatgttttattaaatgaagaagtagttgaagttgcagcaacatcaactcagcctaaagaaaatatattagatactataactataaaagaaatagtaaaagctatggaaactgtagattttgaagaaataaaattcttattagatggaataactatgaatgaagagatagctaagtacggattaaatgaaaaagttggtgtaggtgtaggatttggtatcaaaaaatcaatagaagatggattattaggtgatgacttaatgaactacactatgatgataacagcagctgcatcagatgctagaatggcaggggtaaaactaccagttatgagttctaacggaagtggtaaccatggtataacagctatacttccaatagttgcatacaatgataaattccctcaaacagaagataagttagctagatcattagctatatctcacttattaactgcatacgttaaaaactatacaggaagattatctgcagtttgtggatgcggagtagcagcaagtataggagctacagcaggattagcttggttaatgggatgtagcgagactcaaatagaaggtgcaatagaaaatatggttgcaaacctaagtggtatgatatgtgatggagctaaagcaggatgtgctttaaaacttgcatcagcagcatcagcagcagtacaaagtgctataatagctaaacaagattgtatagtacctccaatgaacggaatagttggaactggagcagagcaaagtatacaaaacttaggtagagtaagtgataaaggtatgactacaactgataaggttataataagtgtaatggatgatatgaataaagctaactaatatttatctaagacattgcaaaattaagaaaactcctataaaatagatataatattatataccggaggttgtaacatggatatagaaactaagaaatgggaagtattatgttctgaagagcaaatacaagaaagactaaaagaattaggtgcacaaatatctaaagattatgaaggtaaaaaattaatggttatatctttattaaagggaagttttatattctgtgcagacttagtaagacacataacaatacctgttaaaataggatttatgactacttcaagttatggacatggggaaagtagtactggccaagttaatatggtagcggatataagcgatgatatagaaggatatgatgttttagttgtagacgatataactgatacagcacttactatgaactttgttatgggtcacttaaaaactaaaaacccagctagtataaaatgttgtgttcttttagacaaaccaagtagaagaaaggtagaattagtacctaactactgtggatttgaaatagaagacaaatttgttgtaggatacggattaaactacggagattattatagaaacgtaccttacgtatttaatgttactaatgaagatagatagtaaaaaaagattggattaatccaatctttttttattactaaaacttaattttttagatgtatacttaagttgttttttaataaaaatctaataatatagcactaaaaacaataaattttataaagttaagcattaatagcaataccaaggtaatatatattgggtataattaaaaaaagataaattgttgaaaaggagaattatatgaacaatatatttaatataaaagaatcaatgaaaaacaatagaaaagaattacatgtactagctgaaattggtaatcaagaatttaagactagtaattatataaaaaactatttaaaaaatataggtgttgaatttgaagaatatttagatacagcagtagtaggtataataaaaggaaaaaatcctactaaaacaatagcatttagatctgacatggatgctcttactatgggggatacagctatgcatttatgtgggcatgatggtcatatgagtgttttattaggacttgtaacttacttaaatgaacaaagagaaaatctagtagataatatagtgtttatattccaacctgcagaagaaggtccaggaggggccaagcctttaataaaagcaggtatagttgaaaaatataatatagatgaaatttatggacttcacatatacccagaaatacctgaaggctatgtaggcacaagacctaattatttcttagctcaagttggggagttagacatagatataaaagcaaaaagtggtcatggagcgatgcctcaaaatggtatagatggaatagttttagcttctagctttataggaagcttacaaactatagtatctagaaatataagtcccctagataatgcagtacttacaataggtaagatgcatggaggtactagaagaaatataatagctgaaaatataagaatagaaggaactataagagcttttaaaccagaagtgtatgaaactatcaaaaaaagaattagagaacttgctaaaggatatgaagtagcatataactgtgaaattgacgttgaaataagagatgattatccagctgttaataataatgaagctttatatgaagaatttgaaaaagctatagggcaagataagttaataaaactagaacctataatgatatctgaagatttttcatactatcaacaagtaataccaggattattttttatgttaggtgcaagaaatgaagaaaaaggatttgtaaatggacttcacagtttaaattttaattttgatgaaagcatcttaggaaatgcactagatatatatataaaattactaaaatataaaaaagctttattataatactaaatcactccttactttgtataaattttacttatatgataagaatacaaaatgaaggagtgatttttgtgaacgataaaaaaattgatataaataaaccaagaactaaaactgctaggaagaaaaaaagaatattgacagatgatgatataatgaaatatgagatagcatcagaacttggcttaatggacaaggtttctgagcttggttggggaggattaactgccaaggaagcagggcgtattggaggtatgttaacgtcccgtaaaaagaaaaagaaaaaaatagagaaggacgaaggcgatggatcagtataaagattttgcatttgtttatgatgaacttatgaacgatgttgattatgacaaatgggttaaatatatagaagatataattaaaaatgaaggtgctaaagttaaaaatatacttgaattagcatgtggtacaggaaatataactatacctttagctaaaaaagaatatgatatagcaggtatagatatatcagaagaaatgctaagtgtagctaaagaaaaagctgaaaagcaaggaatagaattagttttactacaacaagatatagcagagcttgactttgatataacagggcttgactgtgtattatgtgcttgcgatggatttaactatataacttatgatgatgatttacaaaatgtatttgatacaacttatgaattattaaaagatgatggaatattcatatttgatataagttcatattataaacttgccaatatattagggggaaatatctatggagaaaatagagaagatgtttcatatctatggcaaaactattttgatgatgaagagaatttattagaaatggaattagcattctttataaagggtgaagatgaaagatatgataaatttgaagaagttcatcaacaaagagcttacacagaagaagaaataatagagatgcttcaagaatctggatttgggaatataaaagtatatggagactttacatttaacaaaccaaatgaagaatcagagagaatattctttgtttgcaaaaaatagatattaattagcttaaattgattggaggaatacgtatgaaagattatgtaataagagcaacagctggagacggtcaagtaagagcttttgttgcgacaactaaaaatatggtagaaacagctagagagatgcataaaactactaaggttgcaactgcggcattaggaagaactctaacagcaacatctatgatgggtcttatgatgaaaaatgatggagataaaataacagttataataaaaggtggaggacctataggaagcatattagcaacagctaattctaaaggaatggtaaaaggatatgtagacaatccaaatgttgtagttgaagattatccaaatggaaaattaaatgttgcagctgctgttggtacagaaggaacagttagagttactaaggatttaggattaagagagccatataatggatcatatcctatagttagtggagaaatagcacaagatttaacttactactttgcagtatcagagcaaactccatcagtagtagctttaggtgtattaactaaagaagaagaagtagagcatgctggaggatttatagttcaattaatgccagatgctgttgaagagactatagcaacattagaagaaaatgttaaaggattagattctataactaacatgctaaaggatggaaagactcctgaagatatacttgaaatagtacttaaaggtttaaatcctcaaatactagataaatgtgaagtaggatttgaatgtgaatgttctaaagaaagagttgaaggtgttttaatatctataggaaaagaacaattatctgaaataatagaagaagataaacaagcagaaataggatgtcaattctgtaatacaaaatatttatttaatgaagatgaattaaaagctatattagataaaatgaataaataataaaagattggataaaacccttttgcataagtgttgtaccaagtggtagaatatattaatgcgaaagggtttttttagtatatgacaatagatataaagcgaggtgagtaaatttatgaactttaataataggttggaattagttcaatcacaaaagctagttatgacaactcagttgaaacaatccttagcaatacttaatatgagtaaagttgaattagaagaagaaataagaaaagaatcagaagaaaatccattattagatattgagcgtaaggaagagataaattgggaggcttatataaataatattgataatggatataaaggagaaaaatcttataatccagacaatgatttaaacttagaaaatattatcagggaagaaactaatttatatgaatatctaaatctccaaattggattatataaacttacagaattagaaaaagaaatttgcaattatataatagatagtttagatgaagatggatatttaagaatagaagagcaatatatattaggagatttagggatagataaatttacgtttgaaaattgtttaacaaagattcaacaactagatcctataggggttggagcaagaaatttagttgaatgtttaataatacaaattaaaaatcaagggatttatgatgaagatttaatacaaataataaaagaagatttaaatttaatagcatcaaataaaataaaggaaattagtaaaaaacataagttgtcgatggataagtgtataagcttagttaataggataaaaaaattagatccaaaaccaggtagattatgttctagtgacaagacggtatacgtgcaaccagatgttatagttgaaaaagtagacgatgaatttattgtttatataaatgaaagagattcatacgtactaaaaataaataatttctacaaagaagttttgaaaaattcttcttcagacaatgaagctaaagactttataaaatcaaaactaaattctgcaacaaatttagctaaaaatatacaaagtagaaatcataccatacttaaaattgcggaagctatagtttcatttcaagaagaattttttaataaagggccacaatttataaagccactaaagctaaaagatatagcttacatgatagaatgtcacgaatcgacaataagtagaggggtaaatggaaagtatatgctaacaccttttggagtatatgaatttaaatacttctttagtagtgctatagaaactacttcaaatgagatggcttctagcacaagtataaaaaagataataaaggaaacaataaaaggggaaaataagaaaaaacctttaagtgatgagcaattatcaaaaatattaaaagatagtggaatttcagtggctagaaggactgtagccaagtacagggaagagcttcagataccttcatctagcaaaagaagggaatattaataataaaattataaaaaaaattttaaaaactattgaaattagtaaggatttcctataaaataaaattaacttgtgggactaaaaattaaacaagggacatggaatgtcccgataacattaattaatattgaaggagcaagattttaatgaatgacttaattaatatacaaaaaaagttaattccacaagtaatagaacttatggaaagaagatatttaattttaagacaaatatctttaactgaaccaataggaagacgtacattatccaatatgctagaaattagcgaaagagtaataagatctgaaacagaagttttaaaagaacaaaatctaataaatgtagctgtatcaggaatgacagttacagaagaaggattagagcttttagatcaactaaaagatattatgaatgaggttatgggtctttctaagctacaaaatagagttaaagaaaaactaggaataaagaaagttataataattcctggcaactatgaaaaaaatgaaagcttactaaaagatgttgcaaaacaaggtgcagagtattttttaagtatattaaaagatacaaacattgtatcaataactggtggaagtactatgttagaatttgcaaatagtttaagaggcgataaaaaatacaatcaaacgactatagttcctgctagaggaggagtcggaaaagatgtagaaactcaagcaaataatattgtagcaattttaggtaaaaaattaggagcacactataagttacttcatataccagatgagctaggtgtagaggctatgaaaacgcttagtttggaaccagagataaagaaaactttaaattacatagtagatacagacatacttgtatttggaattggaagagcagatgaaatggctactagaagaaaattaccaaaaaaacaagtagaagaaatattatctaaaggagctgttggagaagctttcggatattattttaataaagatggtgaaatagtatatgaattaaatactgtaggaattaatttagaaacatttaaatctgtaaaaaataatatagctatatttgcaggagcaagtaaagcagaagcagttactgcgatttcaaaggtaaatgataatatggtaattgttacagatgaggaaagtgcttataaaatattagaaataaattagttaataactagctaaagctagctaaatatacacacatttattttagggaggcaaataaaatggttaaagtagcaataaatggatttggtagaataggtagattagctctaagaagattaatggagcaaactgataaatttgaagtagtagcaataaatgacttaacagacgctaagacattagctcacttattcaaatacgattcagctcaaggaagattcaacggtgaaatagaagttaaagaaggagctttcgtagttaacggtcaagaaataaaagttactgcagaaagaaacccacaagacttaccatggaaagaattaaatgttgatatagtattagagtgtactggattcttcacatctcaagaaaaagctggtcttcacttagaagctggtgctaagaaagttgttatatctgcacctgcaaaaggagacttaaagacagtagtatttaacgttaaccatgatatattagatggtagcgaaacagttatatcaggggcttcttgtacaactaactgtttagcaccaatggctaaaactttaaatgataaattcggattacaaaaagggttcatgactactatacatgcatatactaatgaccaaaatactttagatggtcctcatgctaagggtgatttaagaagagctagagctgctgctgctaatatagttcctaacactacaggagctgcaaaagctataggtttagttataccagaattaaaaggtaaattagacggaggagctcaaagagttccagttgtaactggttctttaactgaattagtttgtacattagataaaaatgtaactgtagaagaaataaatgctgcaatgaaagaagcatctaatgaatctttcggatacactgaagaaccattagtatctacagatataataggaatagaatacggatcattatttgatgcaactcaaacaagagttatggaagtagatggaaaacaattagttaaagttacttcttggtatgacaatgaaatgtcttacacttctcaattaataagaactttaggatacttcgctaacttagctaagtaatttaaataaaaagtaaaaggcttcaaaaaagtccgggtttgtagtttaacgctacgggctccggacttttttagcaacgtataaagtcattgatgatatgagtaaagtgaatttttattaatgtgatatacttttatacaaaaatcaacaaatgtgatatactaaatagtgtgaactattttgagaggagatatgactatgtcaatgcttaataagaaaacaatagaagatatagatgtgtgtggtaagaaagttttagttagatgtgatttcaacgtacctttaaaagatggggttataactgatgaaaatagattaaacggggcaatgcctactataaaatacttagtagataacggagcaaaagtaatattatgttctcacttaggaaagcctaaaggagaagctaaaccagagttgtctttagcaccagtagctaaaagattatctgaaatgttaggtaaagaagttatatttgcagctgacgaaaacgttgtaggagaaaatgcaaaagctgctgtagataaaatggaaaatggtgatgtagtattacttgaaaatactagatatagaaaagaagaaactaaaaatgaagaaaacttttctaaagaattagcttctttagctgaaatattcgtaaatgatgcattcggaactgcacatagagctcactgttcaacagttggcgctggagaatttttagctgagagagcttgtggatacttaattcaaaaagaattaaaattcttaggagaagcagtagctaatcctgtaagaccttttactgctatattaggtggagctaaagtttctgataagatagctgttataaatgaattattagaaaaagtagacaacctaataataggtggaggaatggcttatacattcttaaaagctcaaggatatgaaataggaacttctttagtagaagaagataaagttgaatatgctaaagaaatgatggaaaaagcaaaagctaaaggtgttaaattattattaccaatagacaatgctgtagctgataaatttgctgatgttaaaccagttataactgaagatgcaaatataccagctggatatatgggactagatataggacctaaaacaatagaagaatatgtaaacacagtaaaagcttctaaaacaatagtatggaatggacctatgggagtatttgaatttgaaaacttcgcaaaaggaacattagctgttgctaaagctatggcagcattaactgatgctacaacagttataggtggaggagactctgctgcagctgttaaccaattaggatttggagataaaatgactcacgtttcaactggtggaggagcttctcttgaattcttagaaggtaaagaattaccaggtatagtagctttagataacaaataagaaaaattagtagttaccaataatttaaaatatatgactatggtagtgataaaactaccaccactaccatagttaaaaaaagtactatatagagtttatagtaatggaggaattaaaatgagaaaacctataatagcaggaaactggaaaatgcacaaaactatagctgaagctgtagaatttgttaatgaaataaaaggaaaagtaaacaatacagatgtggaagcagttatatgcgcaccttttactttattaaaggatttaaaagaagctacaaaaggaactgatataaaaataggtgctcaaaatatgcactatgaagataatggagcattcacaggagaagtatctgctcctatgttaaatgaattaaacatagattatgtagtacttggacattctgaaagaagacaatactttaatgaaactaatgaaacagtaaacaaaaaagtattaaaagctttaaaatcaggaatagacccaatattatgtataggtgaaacattagaagaaagagaagctgataaaactaaggatgtatgtagagtacaagttgaaaaagctttagaaaacgtatctaaagatgatatgaaaaaagttgttatagcttatgaaccaatatgggctataggaactggtaaaactgcaactgctgagcaagctaacgatgtaatagcatatgttagagatgtagttaaaggattatatggagaagaaatatctgaagaagtaagaatacaatacggtggaagtgttaaacctgctaatgtatctgaaataatgaatcaaactgatatagatggagctttagttggtggagctagtttaaaacctgctgactttgtagagcttgttaatttctaaggagtgaaaaacatgaaaaaaccagtagcattaataataatggacggttttggatgtagtgatataaaggtaggaaatgcagtagcaagtgcaaagactcctaacttagataaattacatgaaaactatcctcatactttaataaaagctagtggacttgatgtaggtcttccagatgggcaaatgggtaactcagaagtgggtcacactaacattggtgcaggaagaatagtatatcaagatttaactagagttagtaaagcaatagaagatggtgagttctttaaaaatgaagtcttactaaaagctatggaaaatggaaaagaacatgcacttcatttaatgggattattatctgatggtggagttcactcacacatagaccatttaaaagctgtaataaaaatggctaaagaaaatggtgttgaaaatgtatatgttcacgcatttacagatggtagagacactgaaccaaaaagtgctttaacttatatcgaagatgtagaaaaatacatgaaagaagtaggcgtgggtaaatttgcatcagtatcaggaagatactatgctatggatagagataaaagatgggaaagaattcaattagcttatgaagctatggttgacggtaagggcgaaactgcgacttctgcaaaagaagcgatagaaaaagcttatgccgatgataaaacagatgaattcgtattaccaactgtaatagttgaaaatgataagccagttggtcttataaaagaaaatgactctatagtatttggaaactttagaccagatagagcaagacaaataactagagcattagtatgtgatgactttactggatttgaaagaccttgtatgaaaacttactttgtttgtttaactacatatgacataactataaaaaatgttaatgtagcatttaaaccgcaaagtttaaaaaatacattaggagagtatttagctgaaaagggtaaaactcaattaagagctgctgaaacagaaaaatacgctcatgttactttcttcttcaatggtggagtagaagaaccaaataaagatgaagatagattattagtaccatctccaaaggttgcaacatatgaccttcaaccagaaatgagtgctgatgaattaactgaaaaaatattaaaagctatagatgaagataaatacgactttatagtacttaactatgctaaccctgatatggtaggacatactggagttatagaagcagcagttaaggctgtagaagaagtagataaatgtgttggtcaagtgacagctaaaatattagaaaaaggtggagtttctttaataactgcagaccacggtaatgcagagcttatgcaagaccctgaaacgaaaactactataactgctcactcaactaaccctgtgccatttatagtagtaggtgatgattataaatcagttaagctaagagaaggtggaagattatctgatatagcacctacagtacttgatttaatgaatttagaaaaaccagaagaaatgactggaacttcattaatagaaaaataattatatacggcaaatttagcctaaattaactataatttaccaaaatgtataatataatataaataaattcaaaaatttgatagtaaacttgaaaggagacataattatgtcattaatcgatttagtatacgctagagaagtattagattcaagaggaaacccaactgtagaagttgaagtagtattagaaagtggagcaactggtagagctatagttccatcaggagcatcaacaggagctttcgaagcagttgagttaagagatggagataaagatagattcttaggaaaaggtgttgaaaaagcagttgataatgtaaacgaaataatagcacctgaattagaaggtatggatgcaactgaccaaccaggaatagatggattattaatagaattagatggaactaaaaacaaaggtaaattaggagctaatgctatattaggtgtttctatggctgtagctagagctgctgctgaagaagttggactacctttattccaatacttaggtggagtaaatgctaaacaattaccagttccaatgatgaacatattaaacggtggagagcatgctgataataacgtagacgttcaagaatttatgatattaccagtaggagctaaatctttcagagaagctttaagaatgggtgcagaagtattccactctttaaagaaagttttaggagaaaaaggattagcttgtggtgttggtgatgagggaggattcgctccaaacttagattcaaacagagctgctttagaattaatagttgaagctatatcaaaagctggatatgagccaggaaaagacgttatgttaggacttgacgttgctgcttcagaaatgtataacaaagaaactaaaaaatacgttttagctggagaaggtaaagaattaacttcagagcaaatggttgaattatatgaagattgggctaacaacttcccaataataacaatagaagacggattagatgaagaagactgggatggatggaaagtattaactgaaagattaggaaacaaattacaattagttggagacgacttatttgttactaatactgaaagattagaaagaggaatagaagcaggtgttgctaactctatattagtaaaagttaaccaaataggtactttaactgaaactttagatgctatagaaatggcaaaaagagctggatacactgctgttatatctcatagatcaggtgaaactgaagatactacaatagctgacttagcagtagcagtaaatgctggtcaaataaaaactggtgctccatcaagaactgatagagttgctaaatacaaccaattattaagaatagaagaaatgataggtgaaccagctagatactgtggtttaaaatctttctataacttaaaaaaataataatataaattattttatataaaaggagccttagatttttctaaggttctttatttttatataagtagaataaaatactattttatgtaaataattctttataagaataaaatttaatatataactttataaactaaaaaattttaataatattaggtatataatataaagaagataggcttaataacttgaatgtagcattttattgtgctacactaaaattatgttataattagagattataaacgtaggaggataaccatggctaatgttttaatgggattacaaatagttttatctatcgttttagtaataagtataatgccacaagatagcaaaaatgctgtacctactgaattcggtggagaaggaacacaaagctattttaagccaaaaggaaaagaagcttttttatcaagagttacaaaaataacatcagtattatttttcttaaatgcaatagctttacttttagttaaataataaaattaaatttgtttaataaagatgacaattacgaaaatcgtaattgttttttatttgaaaaacaaaaaattacaaattaaaccaattaatgatataatttaggaatagttaatacatatgtaatttatataaataaattgggaaaaatatttagtaaaagcatagaataaattaaatgacaaatataaaaatgaggaggaagaacaatgggtgaagagctaaaacaaaaattgttgggacttatatcagaagcagcatacaatcctctaaaaaaagaagagttagcaatgatatttgatatacatcacacagaaataccgatgttttataattttttagatgaattagtggaagatgggtatttaatacttactaaaaagggaaaatatacatctccaaacaagatgggacttttcgtaggtaaattagtatctcataaaaaaggctttggatttgtagaatctgatgaagaatacactcaagatttatttatacctgctgatagcttaaacggtgcaatgcataatgacagagtaatagcggaaataacaacaccagcaacggacgaaaaaagagcagaaggtagaataataaaagtaatagaaagagctataacagatgttgtaggaactttccaagatagtaaaaacttcgggtttgtcgtacctgataataaaaaatttaataaggatatatttgttcctaagaagtttttcaatggtgcaaaatcaaatgataaagttgtttgtagaataacaaagtggccaatggaagatagaaagccagaaggtaagataatagaagtattaggacaaaaaggtgaaagatacgttgaaattgcttctgtaataagagagcatggattacctgaagagtttcctaagaaagtattagatgaagctgagaaggtagctattgaaataccacaagaagaaatagatagaagattagatataagagatatgaatatatttactatagatggtgaagatgctaaagacttagatgacgctgtatctatagaagttttagataatggaaactacaagctaggagttcatatagctgatgttactcattatgtaaaagaaaaaagcaaattagataaagaagctttaaaaagagctacttcagtgtacttagttgataaggttatacctatgttacctaagactttatctaatggagtatgtagtttaaatccttttgaagataaacttacattatctgtgtttatggaaataaacagtaaaggtgaagttgttaaacacgatataaaagaaactattataaactctaaagctagaatgacttatacagaagtatctgatattcttgaaaaagatgatgaaaagcttaaaaagacatttgccaagcttgtagatgatttttataacgctgagaaattagcaagaatattaatgcaaagaagagaaaagcgtggagcaatagattttgatttccctgaagctaagataattttaaatggtgatggggatgttgttgatataaaacaatatgaaagaagaatatctaatagaataatagaagagttcatgttagttacaaatgaaactgttgcagagcatttcttctggttaaacatgccttttgtttacagaatccatgaaactccagcgcatgaaaagatagaaactttaaataagtttatatctacttttggatatgttataaaaggtgatttagagagtgttcatcctaaggaattacaaaaaattatagaaaatatacatggaactactgaagagaaggctataagtactattatgctacgttctttaaaacaagctagatattctccagagtgtataggtcactttggattagcagcacaatattactctcactttacttctccaataagaagatatccagacttacaaatccatagaattataaaagaattcttaaatggaaagataagtcaaaaaagacaagagcagttagctcaaatagttgattatgcttcaactcaatcttctgaaagagaaagagaagcagaacttgctgaaagagatgttaaggatatttataaagctagatatatggaagataaggttggagaagaatttatcggtatagtttctagtgtaacttcttttggtatgtttatagagcttgataatactgttgaaggtttagttagacttgctgatatgagtgatgattattatatatttgatgaaaatacttttactattttaggtgagagaactaagaaaatgtataaaatcggtgatgttgttaagattagagttgataaggttaatgttgactttaaagaaattgactttgcattattaggtaaagttgaaaatgatatagatgagtagttagttacttgctagatggcggggtttgaataattgtttcctacacacaaaattcgcttcgctcatgtcgccaacggctttgcccgttgctcaaagacatgaggtttgcggtctttaagtgtttcgtcaacaattattcaaacccttgctttttgtaacttaactttgagggaagatagaagataaagagcaaaagatttataaaaaagattttaaaatatgagaaatttaaattattaaaaaattatttttgaataatatttaagttatatgttgttaaagaatttatttgggtattaatataataatatattaattatgtgtaatagatttgtagttattacatataatagtattaaatatagttatatatgattttactaggattttgtaagtattgactagtatggttatatatggtatattttaaggtaattaatgaaggataaagataagaggtgaattgtatggcaggtgttaaggttttagctactaatagaaaagctagacatgagtattttatagaagagacttatgagtgtggtatcgagttaaagggtactgaggttaagtctattagacaaggaaagcttaacttgactgatggttatgcttctgttgataattcagaagtatttttaaaacaagttcatataagtccatacgagcaaggtaacatttttaatgttgatcctcttagagttagaaaattattacttcataagcatgaaataagaaagcttataggggctactactataaaaggatattctttaattcctttaagcgtttatcttaaaaatggtaaagttaaggtagagcttgctttagctaaaggtaagaaattatatgataaacgtcaagacttagccaaaaaagatgctaatagacgtatagaaagagaattatctggtagatactagtattaattccaatgagataatattgcttttgtttttaaaaagttttattatatagataacaacttaataataataaatggtgaaaaaaagtttgcgaaaaagtcttaaggactataaaactaccacgggggcgtaatggtttcgacgtgggtttggaacttgaggctgcgtgtcgtgttactctgggtcacgtaaaaactggggaatttaaaataaacgcaaacgataattacgctttagcagcataatgactgctcgtcccgcctaagccctcctgccggctaggcctggacgtcatctatgcagggaactactttcggggtgtctcgaccgagagtggactaatcgggactggtcaatcacatagcttgccactgggcgatgtgtgcgacgagatttaaatcagatggctacacacgtagatgcagcgaggaaaagacttgcggacaggggttcgactcccctcgtctccaccattgaaatccacgaaaaagatattggctaaaagtcaatatcttttttgtgttgtgtaaacatatattatttcaaatgaagctaaaataagttataattaattgataaaaattatcacacaaaagaggtatgattatatacatagattatagtaaatattagtatacttgattatacgttaaaaataaaaagaggagggagatgaaacatgtatttatatataactatagtagtattgttattaagttactttatatcaaggcaaaaacctaagtatagaaaagtactaataacaataaatacagttatatccattgtatatatagtatggagatttacggttatacctataaacaatggtatgtttagttttataatgggtactagtttatatttagcagagatagtaggattaatagcatttttaaattttaaatttttgtttactagagaatataaaatagaaaagaaaagcataaaagattttgaatacaatagggtaccaaatgtagatgtattaatatgcacttataatgagccactagatttattagaaaaaacaatagtagctagtataggcatggagtatgataagaataattttaaagtatatgtgtgtgatgatggaagaagggatagtttaaaaagattatgtaagaaatacaaagtaaattatattactagagaagataatgaaggtgcgaaggctggaaatataaataatgcacttaaatatataaaaggggatttatttgcagtattagatgcagatatgattccaaaaaaagattttttatctaaaacagttggatactttgtagatgaaaatttagcttttgttcaaacaccacaagtatactataaccaagatatgtatcaatacaatttaaataagaatatacctaatgagcaagatttctttatgagagaaattgaagaagcgagagcatctataaatgcagttttacatgtaggtacaaatgcagtatttaaaagatctgccgttgaagaaattggaggttatccaacatgctcaataactgaagatatggcagtaggaatgttgttacaatcaaaagggtatactacaatgtttatcaatgaagtattagttttaggtttaagtgcaactacgttttcagagttagttaagcaaagagatcgttggtgtagaggtaatttacaggtattaaagaaatttaatcctttatttaccaaaggacttactttaagtcaaaaaattgcatatttggatggttctatatattggttttctagtttacaaaagttaatttatataatttgccctttaatatatttaatcactcaaagacttataataaatgctgatgcttattcgttggttagtatgtttgtgccatatttatttggacagattttaatatttaatacattgtcaccaaaaactagaagcgtaaaatgggcacattattatgaaatggctatggcacctcatataagcctatctgtacttaaagagatgttatctataaaggttaatttcaatgttacttcaaaggatattactaatgatagaaaacagttccagtttagaatagctatgcctcatatagttataatacttcttactttaattggttggtatattagtggaaaaatgtttttagaaggtgatatacacgtaggtgcatatcttattaatatggcatggagtacttttaattttattggagcaattatatgtataaaggttgcttatcaaaagcctatatttagaaatacggaaagaattgaagttgtagatgatataagaattgagctagaagatggtatcaatcgtttaataggaaaggtagtagatatatctgagaaaggcgttggaataaagttaagtaatgatgaagagattgaactcggaaataagctagatttagttattaacgggattaagattaattgtaaggttgctagaaaaagaggcacaatagttgggttgacttatgataatctaaatgttgagcaaatgaagatggttatggatatttatgtggataatatgagtccttattatgatccaaagagaactcagcaatatgtagaagaaaaaaatatagaaaaatcattagctgcataaatttaaaactagttataatataagtcttatgactaaattaataattagttgtattaggagtaaaaatgaatatatttgcgggaaggcagaaagtgaattaatcgtgggtattattcttgtgaatcgtctccacaattgaataacctaaaagatattagtaattactaatatctttttttattttactctcaatttaaatttaaaattagtaaaataatttcttcaaatatttttctaaaatactttatttgaaaatttacatcctcacgtgctatcatgacctcataagacgaaacgaaacaaaataggaggaaatgatgaactacaaacccaacacaaaactaataaaatatcacatgctaaaaaaaggctactcaataacaaaactagcaaagaaaagcaacctaggaaaatcaacagtatcaaggctaataaaccaaacaggaacaccaagaatagaaacaatccacaaaatagctaaagccttagatatagaagtaaaagatataacaatataaaagaataggggggataaaatgtataaacaatatatagaggaaataagaaatattagagatttagaaacagtaataaactactactatccaagtcaactaataaaaaacaaaatgaaatgtccatttcacaacgacaaatcaccaagccttcaaatagcagataaaggaaatggagctttttacaaatgctttggatgtggggtaggtggagatataattgattttataaaaagagtagaacaaataaattttatagaagctttaaaaaaagcatatgaaatattaaacagaccactatcactacctataaaaagaactatcaaactaaattcagtaaacaaaactaaaatcaacgaatattacaataatcaagtaaaagaagctataaaagaaaaaaacttagacaaagcctttgaactaagctgtaagcaagacgaagaaataaatcaaaactataatataaactttccttacttagattctaaaaatagacctcaaaaaatatgggacaacttagacgtactattaaaacataataatataaatgtagtttacaacgaaatagttaaagatattgaaataactggactagaaggaacaaatctagaaagtcagttagtagatatacattcactttgcaataaatatggattttctctaagtctaaatacaatacaatctttcatacatcgcatagcttacaacaattcatataatccagtagtagattatctaagaaattgctatatggaatttgatggagaaagcaaatacatacaaatgttatgtgatgcacttataactagacgtgattatgaccaagagttaaaaaaattattaataagaaagtggttattaaacacagctaacattgtatttaatgatggaaatactaacatagaaggaatattaacattacaaggaaagcaaggtataggtaaaacaagattaataagaaagctaatacctatgtatgttaaaacaggactagagctagacccaagtgataaggataaagtttatcaatgtataaaatattgggtatgtgaactaggtgagttagattcaactcttaaaaaagacttagcaaagttaaaagcttttataactgagcaaatggatgaatttagaagaccttatggattagtacctattaaatatccaagaaaaacatctttttatgcaacggtgaataatgaagaattcttaaaagatgaatcaggaaacagaaggtattgggtaattcctattgaaaagatagattttgatttgatagataaaattgatatagataaattatggggagaagtaatgtatttaaaagaagaaaatatggaaactacctatttaaatcaaagtcaaatagaaaggttaaatactagcaatgctgattttaaggttatgaatcaattggaattaggtattaatatggagtttgattgggatgctgataaaattatgtggaattggaagtcatctactgaaatagcaaatagactgcgtttaaaatctagtaaaggtttaagagctacactagaaagttatggtgctaagtataaaaaggttggtaataaaagaggttataacacgccaccatacaaatacataatgtccattagttgattttaggtacagtaaatgctgtaccttttatatattaaattaaaactttatttgaaaatactttggaaagtacactaaaagtacgtcaaggtacactaaatttatttttgatgaactactttaaaatatagaaaaaacaacaggtttaagaagtatatccaccatagacactagattaaataaactataagagtattttaataaaaatatattattatagttagacttatttattgtgtacttgctgtacttaataaaagttagatataaatagccttaagttaaaaaactaaaacatcacaaaatgaatctgtatatattaaatataaataaatagacaaaactttaattttgggtaaaatttatctaaataatatacaaaatgaaaaaataactatagagtttatattgacaatgaaataaatttagtagaagtgttaataggtttatttgttgaaaaatgttgaaaagtgaagtatcatatgctaatctttatataagagacaaaaagtttagataaaatacaatacaacgtgcgttagagaattggagtcaagcacaagccttaaaaatattagttaacagtactaatagaggcttagcttggctcttttttagcgtaaaaggagggtctttgatgttaaaaattttaaagccagcaccatttatgaaaaggttaccagaagaagaaatagctccaacgtataaaagatatcgtatccagatatttataagtatttatgtaggatatcttttatactattttgtaagaagtaattttgccttatcaaaggtctatcttatacaacagggatttacaaaagttgagataggacttgttgcatcagctttaggattatcctatggtattagtaaatttgtaatgggaaatgtatcagatagatctaacccaagatatttcttagcaataggtcttatattgtctggtgtagtgaatttatttttaccaaatgcaaataatattgctattatgtttattttaatgctattaaatggatggtttcaaggaatgggatggcctccatgtggtaggataatgactcactggttttcagatagtgaacgtggtgtaaaaatgtctatttggaacactgcacataatataggtggaggatttatagctacaattgcattaattggggtatcattatttggaacatggaaaggtattttctatttaccagcaataatagcaattgtaggtggactagtatatactatatttgcaagagatactccacagtctgttggattacccccaattgaagaatttaaaaatgattatccagagtatgaagttaagggtataaatgctgaagaagaacttactgctaaggaaattttatttaagtatgtattaaataataaatttttatggtgtatagctttggcaaacgtttttgtatatttagttagatatggtgttataaattgggttcctacatatcttcaagaagttagaaatttcaacccaaaagattcttctatagcatttgcactatttgaatatgcagctatacctggaactattatagttggatggattagtgaccatatattcaatggtagacgtgctccaatgggtataatatgtatggttggagtagctatagcaacaatggtgtattggaaaagtacaagtccacttgctataaattgtgcattggcatcaataggagcattaatttatggacctgttatgttaataggagtaagtgcactagatcttgtacctaaaaaagcagctggtactgcggcaggatttacaggtttatttgggtatatgggaggacaggttttagctgaggttgcaatgggtatggtagttgataaatttaattgggatggaggatttataatgttaataatatcttcaatcttagcaatagtatttttatcatttacttggaatactcataatacaaaagagaaagctaatgcttaatgaaatatatagtacatataagaaataaacaataatttctatttattttaggaattgtatatataattttacaatttttattattttataatatatttattttttattgttagattataagtaaatagtatatatggaatttttaaaataaattatttagtataaataagaactattctccaatatttacatatgatatagagaacactatttatatcagaaaaaggagaatcaacaatggaaagaaattattggcaagactattgggataattattataagtttgtagctttatatcttagagaattacaaaatgcatatcctgatgcagatattaaaaatgaatacttagaagtggctagcttatttgagcctgctatgcctcttggagataatgatgattatgacgattatgatgatagtgatgattatgatgactatttagaaggagataacaatcaaccttttacatcacctagtggtgatcaatctgctgaatcttttacatcacctagtggtgtgcaacctgctactacttttacattacctggtggagatcaatcagctcaaccttttatatcacctggtggtgggcaatttactataaataactgtaggagagtggcgatagttagaatagtaatgagaagaggttttacaccttctaatttctttatggcagtagatagagctgatagaagaagtattcaaggatttagaatagcttgcgaatctggtagaattagatttgtaccaatggctgtagaatatagaaatattaatcttatagaatgcgcattttagattgaatttaataagaggcatccaagtaatatataatacttgagatgcctcttattatttattaattaaatttttcaaaaaataaatttatataaaaaattaaaatataagaaaaaaaaaccgtatatatttaagtatgaattagattttaagagataaaaatgcaatgtatgaaaaggttaaacataaagcctaatttatacaaattattatacgatggagaattgattatatggaaattataaataagatagaagatttaattaaaaaaaatgatatagaaaatgcttatgaatgcataattcaaaatgaaagacaatatttaaacaatgctaagtattggaatttaagaggtattttgtgttcacaaataaaagaatatgaagcagcaataagttgttataaaacttcaattgatattaagtgtgactatatagatgcatatttcaatttaatatacacatacctgattacaggagaaaaattaaagtcggttttaaacgctagtatatctttaagatacattgatgatataaattatataaatgatataaataatttatataaatatgaaaaagcatcaaaaaattatatagaattattaaatgaggctaaaactaatatttatatagacaaagataatgctagcttaataaagtatttagctagccattataacaatataagcaaagaatatatacaaagtttatatgaaaataatatagcatgtaactgggcgtatgtaaaagatgattgtattgttacaaacaaagaaattataggtatagacgattttatatgcaattataattattcagattttgatgtaatagttccttatgatatgaactatataaatgtaataaaaaacatagcatcaaagggagtaaataaatgttttgtattactttcttatgacgggaaatttaaacttattgatatagataatgaaattatgacagggttaagaaatgaagattacaaaagaacagtaacattaaatagatttaatgcagctgactcaaatgtatatgcattaataaagtatatgccacaacaatataaagataagtataagttaaatattattaaaggcactgatgtttgcgatatagaaaatatagttaaagtacctcttatatcatctattacggtttcaggatttaatacattttgtaatttttatccaaaacttacttataatattgaggtaggtcatggagaggtaggctttaaagggtgtggattaatggataagaaaaataaggaatttgcgtttaccccagaagaatataaaaatatagataaaatatttactccatctaaaatgtgtatgttattaacaagtgcatttgcagctgtaccagaagataaatatgaaataacaggaaatcctagaacggatcttgttatgttatctgatggaaaaagaaatttagaaaaattattaggaatatctttagaaaataaaaaagttatatttaatatgccaacattttatgtacatgataactcaggggtatcaaatggttcaagagaacttaatgatgctataaaaataaaaaactttgattatgaaaaatttaatcaattcttaatagataataatataatttgtatatcaaaggtacatcacggagaagaaagaagtgttacgaaaaaagcaaagaatagaaatctagataatatgatatttatatctaataaagatttagaagataaagatttagatttatatgaagttttaaatgcagctgatattttaattactgattactcaagtatatatggagatttcttatttatggataagcatacgatatttgtaaatacagatatggaaatatatgaagaagaaagaggaataattttacaaccttatgatttttgggcagctggacctaaggtacaggaacaagaaaggttatctgaagaaataattaaatgtattaatgataataattattataaaaaagaacgtaatactattagagatattttttattatcataaagataataaatcaagtattagagtatgggatagcatagatcgtgtattaagtaatttataacaaaaatgtgtggggagataagcggaaactatagatagtgacttagattttaacttatattttaatgatgtagtatattatgataaattaatgaatagtatgtttgaaatcagtgaaagaatatattatacaaattatgactacaattatttattaaaatctttagaaaagtgtagacgtgaaaatatagatacattagtggtaggtaactcttatcccttaacaggtatagacattaaattttatctaataagtcggtaaatttatctatatctagccaggatttatactattcttataaactagcaaaagaagctataaacaataatgaaaacataaaaagatgtattataggagctggatattatctagtaaatcatgatttatctaaatgtaaaagtgaatattctgttaatatggttaaatgtctatattatcctatattaaaagataaacacaactcagaaaaagtggatactatagaatttttaaacctaagaaaagtattaaaaaatgatttaatagattatatattcaatctagaattcttacataatcattttatagatttaatatatagagaaaataatggagatttcaataaaaatcaaagtagagaaatgattagtattttacaaggagttaagttaagtagtattagtgaagatgaaaaatatagactaggtgaatctagagctaatcaacataatgacttatctaaatatactgaaactaaaaaagaatataattgtatatttaatgagtttataagctttttaaaagataaaggtgtagaacctgtgatagttgtatttccaactactaaatattatagcaagtttataaataaaacatatgaagacgaattttataaaattatagatggtataaaagacaaatatgaagttaaattaatagatttttcaaaaatagatatatttgaagaagatgattttatggattttgatcatatggctgaatctggagctattaagataacacatgagttaaataaaatcttaaattaaaaactaatataactgatagcataattttataattatataaatataggtaaaaaatatatttatgcttatttaatcaacgttggtattattcatgtgatttgtctaaaacattgagatacacaaaaaaggtattgactaattagtcaataccttttatttatatgtatgtgaatttaaatagaatgatttttaaatgcatatctataaagttcactatctgagtttagatgtaattcaagaattaacatatctaaaatagaaataaaaatatttaataaattaaaaaataattgcaacaatacattaatccaagttgtatttatagttacaaggaggttttaatatggctaattttgaagaagtatacaatcggcaagttgatacagtatttaaaatatgtgtactgtatcttaaaaaaatagatgatgcagaagaagctacacaagatacttttattagatatctaaagtataatccagaatttgaaaacattaagcatgagaaaaattggttcataaaaacagcaactaatatatgtaaaaatatcttaaaaagttcatggtttaagaaaatagtatgttcagaggatttatctcatttttatcaagaagaaaaagattatgatattttacaagaaatattagaattacctcataaatataaaatgagtatttatcttttttactatgaaggatacagtacagaagagattgcccaaatactagatatgaagccatctactgtacgttcaaacctacatagaggaagaaaattactaaaaattagtttagggagtgattatatcaatgaaggataatgagataaaaaaagtatttgataagataaaagtagatgagtcgatgaaatctcgtatttatgaaaatgtatataaggatttaaacactaataaagaaagtaaaaaaagtaagtttaatattatatatttaaatcataaaaaatcattatctactttagcggcaagtttagtacttatatgtggattatttttatataatgaaaataaggtagataatatgcaaaatctatcaaggtcaaatgaacctttaaataaatcaatttcacgaagcagagcaattatcgaaaataatgaatttaacaattttgaatttgaaattttaaaagataacaccaaaaaagtagaaattaaaaataatgaaaatactaatgtgtttaaagaaataacaaatgaaaaatctataaataatttattaaatcttttacaagatgctaaagaaaaagattttaaccctgaaagttatgacaattttaaaggcacaggaaagattataactttaagttttataacgaaagatggtttaacaagttcaatagaaattaatttagacttgaaaattgcttgtataaatgaaaaatactatactgtatcatctaaaatgataaaaattatagatgaagaattaaaaaatataaaagattttaataaaaattaataaaaataaaatttaatgcaacaatttataattttaaattgtatttatatatgaatggacaacaaacaaataaaaaataataagtggaggaatatattatgaaaaagcaaattatagcattattaacagttggattaatttcagtaagtggaattcttgtatttgcaaataataaatcatcgataactaaaaatgatgtaaattcaaatggagggcataaggatatatcagaagttaatggagatgttgatgtcaatgatattgcaatcagaggaataattaagggtataggcatagataaagaagtaacatctgtaagagtagaaggaaacttagaaaaagatactagctatgatatagcagatgttcttgtaggtaaagatactataattaaaaaaggtaattcaagctctaatcttaaagtttcagatttaaaaataggacaaaagatagaagttgtattccaaggtccagaaggaagatcttatcctgtaacagctaatgcatatagtattaatattattgatgaaaaaaattaaataattaaaaaatctagttgagtaaaagtgcttattataagtatttttactcaatttttttgctaaatctgaaatcaaataaaattgaagtgataataataacttataataatctagtggtagattatctaataaactgctatattaaaagatattgattataataatagttaggtataattttaaagtatacaataagattataaactcatattaattcagataaagaaattagaaaggttggacaaaaatgataagaaatattgtaaaggatgtattatttttagaacaaaaatcagaacctgcaactaaagaggatgtagaagttattaatgatttaatcgatacattaagagcaaacttagatcattgtgtaggcatggccgcgaatatgataggagtaaaaaaacgtatattggtatttagcgtaggtaatatcatagttcctatggtaaatccagttatattaaaaaaagaaaatccttatgaggcagaagaaagctgtttatctttagaaggttttagaaaaacaacaagatatgaaacaatagaggtagaatatctagatagaaatttcaagaaacataaacaaatatttacaggatttactgcacagattatccagcatgaagtagatcatttcgaaggtataataatctaataaataatattatgggtattattacataaatccatatccgacaataccgaggtacataacctttaaagcattgaaattaccacatcaatctgtgtggtaatttttttattttgttaacgataaaagtaaaaggattctattgacataaatagtaatagtagataatatagtttagtacaaaacaaatttttatatggaggtgtttccatgaaaaataaaaataagcttaaactaggtcttgatattagtaaaattcatcatataatttcaaggaagatggatgcttctgtaattagtgcaattgatgataacttaactgtgtcacaagcttatgtaatcgattttatttctaatgaaggcaaagataaagaaatatttcaaaaagatttagagagagaatttgatttaaagcgttcatctattagcttaatgctaaataatatggaaaagagtgatttaatagaaagagtacctgttacagaggatgcacgtctaaagaaaataattttaacgcaaaaatctataaaaatttatgaaaaaatttctactgcaatcgattcaatcgagaataagttatcagagaatataacaccagaagaaataaaagtatttcaaagtgtacttgataaaataagaaataatctagaataaccgttttaagtttcaataacggttatatttatacaaatattgttttgtccaaaacaaaaataaaaaataggaggatgatatatgtcaaaagtatctaactttacagaggggaagatattctcacctttattaaaatttgcaatacccatattgcttgcattatttttacaaactatgtatggtgcagttgatttgcttatagtagggcaatttggccatgctgcagatgtttctgccgtttcaacaggtagtcaagtaatgatgactataactgtaataattacaggattaactatgggtcttaccatattaataggtcaaaaacttggggaaggaaagtcaaaggaagctggaaatgttgtaggaagtggtatttcaatatttgctattatagctttagttattactgttttaattgttagttttgcttcaaatatttcaacttttatgcatgctccaaaagaagcctttgatagcactgtaatatatataagaatttgttctgcaggttctgtttttatagttgcttataatattataggaggagtatttagaggattaggtgattcgaaaactcctcttattacagtaggaattgcatgtgttacaaatattataggagacttaatatttgttggaatatttaaaatggctgctatgggggcagcgttggctactataatggctcaagcaattagtgtcatactgtctataataattattaaaaagcgtgggcttccttttgaattttctagacaaagtataaagttccataaaggtttaacgtcaaagataattaaatacggaacaccaatagccctacaagatggacttgtacatttatctttccttgtaattatgatgatagggaattcaatgggagtaattccatcagcaggaattggtgttgcagaaaaacttgttggatttataatgcttataccatcatctttttctcaagcagtatctgcatttgttgcacaaaactatggagctaaaaaatactatagggcaagaaaagttcttgtttatgcaatttcagcttctttatgttgtggagttttgatgttttatattacattcttccatggaaacttacttgcaggtatgttttctaaggataaagatgtagttttagcatcttggcaatatatgaaggcatacggaatagattgtcttttaactgcaattatgttctgtatggtaggttactttaatggatgtggaaaaacgacttttgtaatgatacaaggaatagtaggtgcctttggggtaagaataccagtatcatatatgatgagtaaaatactaccagtatcgttatttaaagtaggtcttgcaacaccaatgtctacatttgtgcaaattatattatgtgtaatttactttataattttatcaaagaagttatcaaaagaagatactcctatagatataacttatcaagtacaagagcagtaaaatctttaattttaagtatttaaatctatctggataactgaactgattttttatgaatattgcgttcaaaaaattgatttgtataaaaacacttgagtttaaaggtctaataccaaaaaaatagggtatagtgaaacaatagagggtgttagttaaaaataaaaaagttgagtcaaatcatttattaccacgctttgactcagcttttttatttaaaatatttctaaaaaattatttgaatcaataaattaggattttaagtgtttgataagctaaaataatacatttattgactttatataagtacatagttactatttaattgaacaaatctaaaaatatacaataatgtatttgacataataaaaaagtatgggaattaatggagggaattaatggggaataaaactattttaataatagaagacgatataactctaaacaaaggcataatgttaacacttaggcaaaatgacataaatataaaacaggcatttacattagaagattcaagaaacatattaaaaaaagaaaaaatagatttaataatactagatgtaaatcttcctgatggaaatggatttgatttttgtaaagaaataagaggaaaatcaacaatacccataatatttctaactgcttgtgatatggaattggacatagtaacaggattagaattaggtgcagatgattatataacaaaaccatttagcttaatggttttacgtgcaagagttatggtagctttaagacgattagaaaataaaaattcaaataataaaataactgtagataatctaattttagactttgacaaaatggaatttactaaagataataacaaaataaatttaagcaaaacagaacaaaagctattaaaaatgctaataaaaaataaaggacgagtgttaactcgtgaacaattaatagataatgtatgggacaatgatagtgagtttgtagaggaaaatgcacttacagtaaatataaaaagattaagagaaaaaatagaagataataaatcaaaacctaaatatataaaaacagtatacggaataggatatattttctcagaaggtgacaaaaatgagtaaacaaaaaaatcattcctttaacaaaatatatattatatatttaactttatttataggtatatgcacacttttttcagtattcatatactttatagatacaattgatttagaaatattaaagctagtgagtataatatttttattatctatagtaattataggattatcatttatttatataataaagcttaaagtaaaatctacagtaaatttacttgataatatgatatcaaaagctatagataaagaagaaataataaatagatatgatgaaacaatactatcttcactagagcataaactattaaaatacataaaaatatatgaaagcaacaaaaaagctatagaaaaagaaagaaatagcataaaatccttagtatctgatatatcacatcaaactaaaacacctattgcaaacattatgttatacagtgaacttatacttgaaaatgaaaatttagatgagtacacaaaagatatacttctagatataaataatcaatcaaacagactaaacttcttgatacaatcactaataaaaatgtctcggcttgaaaatggaataataaaacctactaaaaataaaactaaattaatagatacaataagttcatcaataaaagaagtctataaaaatgcagacaaaaaacaaataagcataagcgtagatggagataaaagtgtacaggggtattatgataataaatggacaatagaagcaattgtaaatatattagaaaatgcaataaaatacacaaataaaaatggaagtataagcataaatataacttcttatgaaattttcaaaagaatagatataacagatgatggaattggaatagaagaatcagaaattaacaatatatttaaaagattttatagatgtaaaaatacaaatcaatatgacggggtaggtataggtttatatttaacaagacaaataatatcacatcaaggtggttatataaaagtttcatcaaaaataaatcaaggctcaactttttcaatattcttaccagcataaatcaaatgtgtcaaagctgttatatttgagacactactttgtaacaattcatttatatattaaaggtataggaaataaattacatttaataagaaattagggaggaagacatgaaagtagttgaagttaaaaatttaaaaaaatattatggaaaagatgaaaacttggtaaaagcactagacggtataaatcttgaaataaatgaaggcgaatttgtttgtatagtaggtacatcaggaagtggtaaaagtacattgcttaatatgataggaggccttgatagacccactaatggagaagttaaaattgcaaataaagatatatcaaaattaagtgatgatgaattaacgatatttagacgaagagaaataggatttgtatttcaacaatttaacttaataccaatactaaatgtatatgaaaatatagtacttccaatagagcttgatggaaataaaatagataataaacatgtagatttagttataaaatctttaggtttagaaaataaaatatataatttaccaaataatctttcaggagggcaacaacaaagagtggcaatagcaagagcacttgctagtaaaccatctataatacttgcagatgagccaacgggtaatttagatagtaaaactagtcaagatgtaatgggacttttaaaaataatgagtaaaaaatttagtcagacaatagttatgataactcacaacgaagaaatagctcaaatgggagataaaattataagaatagaagatggaaagattgtttctaaggtggtggagaagtaatgataaaaaatacaaatacactagttataaacaatctttcaaagaaaagttttaaagcaaataaaagtagaaacaaaattgctataatagctatagtacttacaactttactttttactagtttatttacaataggcatggggatgttaaaatctaatgaatacagtactatgcgtatggtaggaggaagtactcacggtaggtttaaatatttaacggtagaacaatacaataaaataaaagacaataagcttataaaatataaaggaatagcagtgcctatagcaatagctgaaaataaagaacttgcaaaaagacaggttgaaataaaatatggggataaaaattatataaaaacaacttttgcaacacctataaagggagatattccaactaagaaaaatgaaatattagtagataccttaactttagacttattaggtcttccttatgaccttaatcaaaatataaaattaacttataaaataaatgacaaagaatatactaatgaatttaaagtaagtggtatatttgaaggtgacaaagtaattagcgcaagttctgcatatgtttcaaaaaattttataaaggatgtattaggtaatatagatcaagaaaaacttaaaaaagataatgatattgtaggaactataatattagatgtgaatttttctaattctatgaacatagaaaagaaattacaaaaagtaataaaagatagtggatacaatgaaaatgaaataaattatggagtaaattgggcatatatgggaggtaagaatttagatttaggcacagtatttggagcaattggattaatacttcttataatgtttacaggatatttaataatatataacatattctatatatcaatagttagggatataaagttttacggtcaattaaaaactataggaacaactaaaaaacaaattaaaaagataataataaaacaagcattaagactgtgtttaatagcaataccaataggtttagtattaggatatgctataggttctatgataactccacttataatgaaaacagtaaatgtaactcatactaagctatcatcaaatcctattatatttatatttgcaacagtattttcaataataacagtattaataagtgtatataaaccagctaaaatagcatcaaaagtatccccagtagaagccataagatacactggagtaaatgaaaacataaaacgtaaaataaagaaaacttcaagtggtgcaaaattaaataacatggctttatctaatatttttagaaataagaaaaaagcatttatagtaatagcatctttatcattaagtataatacttttaaatacagtatatacaatggtatcaggtattgatatagataaattcttgagagggtctataggtacagattttacaataggtgatacgagtttttatagaatggaatttgacccagaatctgcaaatgcccttactgaagatgtaattaaagacattgaaaaattaaatggagttaactctattgataaaatgtattataaacaaactaagatacctttaactgacaagataaaaaaagttttagatgctaagcacaaagaaggaaatgaagagataaatgaatcaatagatgaaatgttagaagaaaaaaaggtctcaagtgaatactatggagtggatagaggtatatataagcttttaaaaaatcatatatctgaaggtaaattagatgaagaaaaatttgcatctggcgattatataatagcaaatacaaactttatacttggagacttggtagaagttggagataaggtgacaataccttttgaaaatggtaaaaataaagagtacacagtaatggcaataatgactaatgaaccagcatacttatatataggacgttcatttccatgttttacaggatatttgccatcagaagaatttaaaactacaacaaaaaataattcaataatgacggctatgtttaatgttaaagatggtaaagaacaagaagtagaaaatcatattaaatctttaataaaagataatccattacttgattatagatcaaaacaaacttatataaatgaatttaaatcaactataaaaatttatgaaatagtaggttatggactaagtgccatagtaggtattataggaatactaaactttattaatgtagtatcaacaaatattatatctagaaagaatgaactggctatgttaaatagtataggtatgacaagaaagcaaatcaaaaagatgcttatacttgaaggaatatattatgtagtaataacaataggtgcagtaattataataggattgccacttacttatttattggttaatactattgcaggtggaatgagtatatttagttatacttttagaattatgcctgtaatattatcactacctatattactattaatatctatttttgttccaagtatttgctttgaaaaagttaacaatgaagtaattatagaaactcttagaaatagctaaataagcatgctcatttagagataaaaaaacttatgatgtatggcaagaaaagaaactatattaaaaaagtagggtttggagttgttaaaactacttacattatagatgaaaataggattatagataaataaattaaagtaaaaaatctcaaaaatatcttataagatgtttttgagatttttatttaaacaatacaaatcattgtatttatattaaaatttaaataactttattttaatttttttcctacacacgccatataaattacaaattcattttcgccatctaaatttagcatattatcaattatatcttggtcataaattccaatagcacaagttccatagttaagagattctgatgctatataaagattttgacaaacatgaccaatatctataagtatttttttatgagcagttatgctaaatttatgttcacttctatatggaatacagctccaagcaaatacaacagcacttttagaaacaaaattttgaacaaaaggttgatttggagttgctttatctatttcatcatctatattatttaaagttttcataaatataagtttatgctctagtggtaaatatctataaactccacactctaatccttcaacattatttattattaaatatgtttcaaaaggatgagtacaaccagcagaaggtaccgttcttaatgcgcttgatttatcttttacagtttgtattccttgagtagcccaaagtaagtatgaaagttcagataaatttattttttcatcactatactttcttatacttcttctatcatttatacaatctaatacgttagttttaactaaaatgtctttgcttaaaggtggcaattctattaaatcagaatttgaatcatactctttttgaaaagttggagcaggtattcctttttgtttatcagtttttatctgctttaatatttcaaaatcagctttaaaaaattctctgttttgtgcaattttatccatagatgtctccttattaaaatgtataattttttatattcattatatcatactatacaaataggctataagaaggtgtagttagaaaaatattttaagtatttattattaaaaacctaaaaagggactataacattatagttataatcccttaaatttttaatgataatttaacaacttattaacttaccttttcaatatacttacaattaacctcgatatgatttaaaaaaactaataatctttcataaagaggatgagaatcctcaccgtaagtattttctaaacgacaacctatgtcttcaacggtatttttaccatttatttgtaaaaacacaaaactactgtacttatcaagttcaatctttttatacataggaattttaaactttaacttcctaaaaaatttttgtataaaatgatcttgcttttcaattatagtcactaaatcattattaacttcataatcaacattactagaaactttgaaaactaaatttaaaatatcattattattcattatttttcaccttagatttaacaataggtatagtagtcagtattactaaaacagctaataagattatagccatttcattaccagaagcaaatccactaggtgtatttcctccaactaatcctgtaacttgacatattattcctataagtcctagtatagatccaccagcaactaaaccagaagataaacttataccattagaaattttaacttctttttctttatcatttttagcagttttttcaactaatacacgaattaatgctccaactaatattatagaagttgtcgcaactggtaaataaaatcctatagcaatagtcattataggtaaatttaataagtataaaacaactgccataaatactccaactataatcatgacccaaggtaattcgcctgacattatacctgatgttaatgttgacattaagttagcttgaggtagtgcaaatggtgggttatcaccagttattctaagttggtctgataataatatcatagttccaacaacaactacaacaccaacaatacttgctaatgtaaaatagcgttgcatttcatttttactaccacctattatatatgttactttttgagattgactgtatccaccagctattgcgatagaaacaactatgaatgaaccaagtaaaagtaatgttttattatcttctggtgatttccatcccattaaaacaaatattagtgtaactataactaaagatgcgatagtcataccagatacaggtaaattagatgttcctatagttcctgttaaacgtccagcaactataacaaataataaagataatactaatgataatatagcacctactatagccatcataaaactattagaaactataaatgaagctataaatccaacaaccattccacctaataatattaatatttgagcagaagaaccatcacctttagtagcagtagctcttgctttagctgtttcttttactgaagctattatagttggtataagttttatagcacctattataccaccgcaaagcatcataccagcgcctatgtatttaacataactactagatattgcttgaacagtcatttcatttattggcattgaagggtcattccataccataacactatctttagctaaatcagtaaagtatcctattaaaggagtaataccaaatactgataatacagaaccagcaaacattgttaaagcaatttcaataccaacaataaatccaattcctaataaaagaggattaacctccatatcaaacttccatttgtaacttttactacctataaagctaattacattatttgttaaatttaaaaatgaactagttaaaacagttatgattccaccaataccaaagccaatacccatatactttatagaatctccaccactatctgaagcaaccaatgtttcagatatagccattgattcaggataaacaagtttaccatgttcttcaattattaaatagttgtgaacaagtgatgctacaccaataccaaataaaacaccaccaacaccaactgcaactccttcaatgaatgaaatttgactaccaattaaaataacagaaggtaatacaaatataagtccactagcaactgattctccaccacttgacataccttgaattaagtttttaccaagtatacctttatgctttgcaaacatacttacaaaagctgaacctattattgcaccaggaataccagcagcaactgtaagtcctgctttcatacctgaatatgcagtagaagctgcaaatactgatgccaatataagacctataataagtactactatattgccacctgtttttgatttatcggttatataaggaacataatctttgccagatactcccccatatgcacctttaggcaattttttattcatctagatatcccccttttttttatttagatatttatattgtagcaccgaagcaggatgtcctattttaaaatttaaatagcaataaagataaaaaatgattataaaaaacaataaaataacaggctttacagcaatgtaaaaattaaaagaaaaaattaaaatttaataagtagaataaggtcaatattttatataaaaaaattgacacattaattaaatataaataagttttttaataaaaataaacttattttaaattggtaacaagggtatattaaataagagtagaaacatcacactaaaattatggaatatataaggagaaaaaatgactaataaaaaagaaattataaagatgggatggaatttagataatagctatattacattgccaaaagcattttatagcaaaattaatttaaataaagttagctcaccgaaattagttattttaaatgaaagcttagctaaatctctaggattaaatagtgatgctctaaaaagtcatgatggagtgtcaatacttgcaggtaatgaaactatagaagaaggagcttttatagctcaagcttatgctggtcatcagtttggacactttacaatgctaggagatggaagagcattattaataggtgagcaaataacaccttcaaaagatagatatgatattcagcttaaagggtctggtaaaactccatactctcgtggaggagatggaagagcagtgcttggacctatgcttcgtgaatatataataagtgaagctatgcatggtcttggtataccaactactcgtagtttggcagtagtcaaaactggtgaatctgtaattcgtgaaagtataaaagaaggggcaattttaactcgtgtagcttctagccatattagatttgctacatttgaatatgcagcaagatttttaggagtagatgaagtaaaaaaattagctgattatacaataaaaagacattatccacatataaaagacgatgataataaatatctaaatttacttaaagaagtaataaaagctcatgctattcttgtttctaaatggcaaactgttggatttattcatggtgttatgaatactgacaatatgactattagtggagaaactattgattatggcccttgtgcttttatggataattatgacccaaatactgtatttagttcaattgacactacaggtcgatatgcttataaaaatcaacctattatggctgagtggaatttatgtagatttgctgaaacattattgcctttattacatgaaaatcaagaagatgctataaaaatagcacaagatgctatttctaatttttctgagttatattatttaaattggttatctaatatgagagcaaaacttggactatttaatgaagaagcacaagataaagctataattgaagatttacttagtataatggaaagatataatgaagatttcactaatacttttattaatttaacatttgataaaaataaagataaaggtatgtttagtagtaaagaatttgataattggtataatatgtggcaagaaagattaaaaaggcaaccgcaatcaaaagaacaagttcatcaattgatgaaaaattctaatccagcagtaattccaagaaatcatagagtagaggaagcaatagcagctggtgataaaggtgactttagtgtaatgatgaagattcttgatgcaatttcaagaccatatgatcactcaaaagatcaagaggagtattcacagttaccaaaaccttcaagttgtccttatagaactttttgtgggacataagattttgtgtaaattaaggtgttctctataagaattataagtgtaaaacttatgttaataattatattagatatatactaaatttaatcgtagagattatttttatgaattgtttcaattattgagacctaaaaaaaggtattgattgttaaatcaatacctttttatattaaacaatattacagatttacttttttatgataattttaaaatgctttattattaaatttctaaagtaacaggcaaaggttttaaattatttacaaaaaataacatttatgctaatatgaatgtggatttaaatctaaaataaaatttaatttaattagcaaacccggagtgattcggcgacgcaaagctataggggcttttttttaaagtcagccagttgcataaattgtcttttaaaagaagagtgttgacgggtctatgttgatgctcttttatttttgtgttatgtaagtggattttaaaaattataatactttaattaaggaggttattatggataatcacaaaacataagtgctttatatttaggctagagataaataagccttaaagtgttaattttgctgaatattatgacaaaaaattaacgtataaagatataataacgggagataaaaaaatgaaatttaaattaagacaaaaaagtaaagacaaaactaaaagtataaaaactcaacttactttaataattgtatgtttttcagttatttgttgtttatgtttaggggcaattacaagttatttaaactataaaacatctaatactattttatcaaatacagtagtagaaacaactaaacaagcagcagcaaccgcttcgcaaaaaattacaaacctaaaaaatgcagcaattcaaacaggtattataaaggaaatttcagatcctaaggtaagtgtagaggaaaagaaaagcataataactagacaagaaaagctatatggattatcattagggcaaattatagatgcaaatggtaaagatttatttagtggaaatgattattctagtagagattattttaaaatttctatgcaaggaaaagcatatatgggtagccctgttgttagtaaagtaacaggaaatcttacacttgtagtttcagcacctatttgggaaaatggagtacaaggcagtaagatagtaggagttgtaacttttgatgcagataaagatttcttaactgaaattattaagaatataaaaataagtgaaaatagttatgcttaccttatagataatgaaggaacaacaattgctgatatggatactagtcttattggtaaggaaaatactataaaagaatcagcaacaaatccagatttaaaagattatgcacaagcagatgaaaagcttatttcaggaaaaacaggatatgctaatgtagactcagaaggacaagattggattttaggatatgctccagtaaaaaatagcaataattggggtgtaggtgtaatggtaaataaagatgatttccttggacaaatgtatacttcaattacaataacagctgtaatatctataatatttacccttgtagcatttattggagcaataaagtttgctagtaaaataggaaatccattaaaggaatgtagtgaacgattaaagaaactagctgagggcgatttaaactcagaactaccagttatagatgaagaaaatgagataggtctagtagcagatgcaacaaataaaatagttaatgattttagagaaatgataaatacattaacaaatatattaactgaaattagcaatggtaatttagatattgatgtagatgatgataaattaagtgatttatttgtaaatgattttgagccaatgttaatagctgtaaataaaattgtaaatgatttaaacagcactttagaacaaataaatacttctggagaacaagttgcaatcggttcaaatcagttagcagaaggtgctcaagtactttctcaaggtgctacagaacaagcaagttcaattcaagaactttcagcaactataaatgaaatttcagtgcaaataaaagaaactgcacaaaatgctgaaagagcaaaagaaatatctgtaaattcaagtattgcaacagataaaggaaaagagcaaatgcaagaaatgattgctgcaatggatgaaattagcaatacatcaaatgaaattggaaatataataaaaaatattgatgatatagcattccaaacaaatattttagcacttaatgcagctgtagaagcagcgcgtgcaggagaagctgggaaaggatttgctgttgttgccgatgaagttagaaatcttgctgcaaaatctgcgcaaagtgcaaaggatacagctgagctaattgaaaaatcacttaaagcaatagaaaatggaactgtaattgtttcagaaacagcaaaatctcttgaagaagttgttgatggtgctaaaaagtcagcagaagttatacaagaaattgcagatgcaagtaatgaacaagcacaaaatatcaaccaaataaatactggagttgaacaaatatctgtagttgtacaaactaattcagcaactgctgaagaaagtgctgctgcaagtgaagagctatcaagtcaggcacaaatgttaaaagaacttcttgaaaaatttaatttaaaggatgaacgagctaaatactttgatggcaagatgatgtttgacaatgaagaattttagataaaaatctttaattaatttaatataaaaaatatattgctagataaaaatcttataagaaatacatataaatattgtattcactataagatctttatctggcttttttagtttttagctttatttataaaatctaaaatcttatcagatagttcttttgcatcattataaccctctttatataatgcagtaagcttatcaacatttttttctatttgactaactttaacagggtttttcggtctaattacaagaacgtcgccactttgagataatttatttactaaatcaagacttttattatagttaatatgtctagattcaatagctttaacaagtttaggatactttttatactttctttttacaatagaaataaatttttgttttccttttctataagttatatctcttgttaaaacaactatattttttttataaccttgatttaaagcatattctataggaattgaatcagtaactccaccatcaactaatttataattatcaatttcaactatatttgcaaacacaggtatagaacaagatgcttgcatataaataatttctttatttaaatctgtaagttcaaaatattcaggtttgcctgtttcgcaatttgtagtaactactacaaatttagttttagatttactaaaagcatcataatcatagatatttaattcattaggaattgtattaaatataaaatccataccaaatattgagcctgttttaattaaattaccaaagcttaaatattttttatcatttatatagtcgatagtagcattgaatgctcttttatattgtttcgatatataagaagaagcatgacagcttccagctgacactccaattgttatatctacttctatatttttttctataagaaaatctaacactccagcagtatatattcccctcataccgccaccttctaatattaatcctatcttactcataattatcctctcttcactttaagtatgcatataatttaaaattaatagttatggttttataactattatagtccaaggcatttatattgtctagttttaaggattaggctaaaagcttaaaagataaccgattaaaccgtataattactataaggataatatatattagcgggaataatgatatacacttcacttgaggagcaaataaaaaatgattaataatataaataaaaattcatataatatgaatccatacataaaactacccacaaaacctaataatgaagaaatacctacacaaagtaaggttgaagacatagatgttaaagatttttttctaaaaattaaagaagagttaaaaaatgtagaattaatagctataaaaatgattaaaggagaacctctaactccaaaagaacaacgtcttataactgaaaaatatccagatataaaaaaattagtacaacaatcaaaaaaagaaattaaagatttaaaagaagaaataaaaaactgcaaaacagaagaagaaaggcaacaagtaatatcaaaagcaattaacaatataaaagcaatggacaagaaaggattattatcggaagtacaagtaaaaataaaaatggcagcagtaaaagaagttgaaaagttctctcaaaaaattaatttagaaaacaaaaaatcagaaataatagctacaaaaataatcaaaggagaaaaattaactcctaatgaacaaaaatttataactgaaaaatatcctaaggtaaaacaatttgcacagcagtctaaaaaagaagttaaagtcttaaaagaacaaataaaaaattgtaaaacagaagaagaaagacaacaggtaatatcaaaagcgattgaaaatataaaagtaatggataaaaaaggattattatcaaaagtagaagtaaaaataaaaatggcagtagtagaagaagttgaaaagttctctcaaaaaattaatttagaagacaaaaaatcagaaataatagctacaaaaataatcaaaggagaaaaattaactcctaatgaacaaaaatttataactgaaaagtaccctgaaataaaacaactagcagaccaatcattgaaagaaagtaaagatttaaaagaacaaataaaaaattgcaaaacagatgaagaaaaacaacaagtaacatctaaagcaattgacaatctggaggagatgtttaaaaaaggtataatatcgccaatgcaattgaaatttaaaatgttagcaatagaatccataaaaaatgaaaaagaaaataacaagttatttaatataaacccatacgtatatctaaatccaggagcattagtggataacttaactggaatattaatggttgtagtaataataattatttttttgtatatgatttaaataatatataagataatttaattatttatgaaatcaacatatataatatacttactataattggtaaatattagtgaataagcaaatgtatacaaagataactaattataaagaaacctctagaattgtaaaaaaaatccgtatataagcatgagtaatactattttgagaattatttttatgtaggaggttgagtatgggattttcagaaaatacaagtcaaacaaaaatacttttggaatccggaactaatgaacttgaaattatggaatttacaatttcaggtgaatcatttggtataaatgtagcaaaagttcgtgaaattatgatggcacaagagattaaaaaaatgccaaatgcacatgatgatgtagaaggagtatttaaatcaagagatgaaattatcactgtaatagatttaggaaaatatttaaatattcctaaaggtaatgattcaagtaaggatatatttatcgttactcactttaataagttaaacattgcatttcatgttgatgcagtagttggtattcacagagtttcatgggaagccataaataaaccagatagagttatttatggaggagatgaaggtgttgcaacaggtattgcgaaatataaagataagcttataactattttagattttgaaaaaattgttgcagaaatcagtcctgaatctagtattcaatttgaatctatacaaaaattaggtgagcgtaaaaatagtgataaaactattttaatagtagaagactcaatgttactttcaaaattaattactgagtgtctacataaagcaggatatgtaaatactgttaaagcagataatggacaagaggcatgggattatttattagaagctaaaacttcaggtgacccaattgaagcacatgtttcttgtatagtatcagatattgaaatgccgttaatggatggtcatagattaacaaaacttgttaaagaagatagtgttcttaagcaaataccagtaattttattctcttctttaataagtgaagaaatacatgttaaaggtaaagcacttggtgcagatgaacaaataactaaaccagagatagctaatcttgttagtattattgataggttaacggaaaaataaaatattaaaaatgaagtttatacaattaaatttttattaaaagattaaattgataaataaaaaaggatatatgtccacatttatataatgtgagtatatatcctttttttattttattctaatattaaattttcattatctacttttttagattttatttttttatcttttacatatattaatgatattactaatccaactaatactaatatagttgcagatctaaaggctgcatccataccggctatatccgaaattactttagaattacttagactatgctttgtaacacttgtcattatagaaataaataccgatgaacctattgctcccgcaacttgtctaagtgttgaaccaatagcactaccatctgctatttctgatgacttaagtgaattaagcccccaagttgtaattggcattagtaaaagtgttattcctagcattctaaatgaatacataatagttaacattaaaattgatgttgtttcacttaaatttgaaaatgaaaatgttcctattgctaagcatacaaatcctgatatagctaagattcttaccccatgtttatcaagtatacgtcctgatattggacttaataaagacataagtattgaacctggaagcataactaatcctggaatcatagctgacatctttcttgttgattgtatatataaggataaaatcatagttgcagatgtaaatgatgcatataaaatcattagtattataactgatattacaagttgcttacttttaagtaccctaagatttaaaagaggtgagtttactttaaattgtcttattataaataatataagtgatataattccaactgttattggtatatatgttaaaggatttgatatgctataagctccaatatttgaaactccgattaataatcctccaaatccgaacgttgataatattaatgatatgaattcaagtttagattttttagtttctgtaacattttttaaggtaaagtgtgcaaatataatatctaatattgcaataaatcctaatatataaaataatattctccagccaaagttatcaattacatatccagatgctgttggtccaatcgctggagcaactccaactacaaaaccatatatacccatagcagtacctctttcttctttaggatataggcttatcattgaaacttgaaccaactgcataattattcctgcacccatagcttgagaaattctagatacaattaataatgaaaagtttttagtaaatatagatattgcacatcctataaaaaatagtgacatagcgcttatatataattttctagtgggaaaattacttattaaatatgctgttgcaggaatcattacacctaaaactagcatataaactgatgttaaccactgagctgtatctgcagttacagaaaagtcatgcataatacttggtagtgctgaagttagtacagtttgagcaagccccgttaaaaaagaccctagcattagtactaaaactattaaatttcttacttttttattctccacttcttatgtcatctcctaattttgatgttaatctgtttaatttttttgtatattcttttatagattcttgtttttctaagtatgctatcatagcatccatagttaatgaattataattgcctaaattaaattcttcctctatttttacaactgcttcagataatttttcatttttatctaatttaatgcactcttttatagaataaagtacatttaaaaatacatcttttatagaatctttataattactttcaccaatctcatctatagaatagaatatatttttatttatagtacttttgttttgttttaaattttctatatttaaatttatttttagaaaaatttctaatttcgataatccatcggtaactatacctatagttttcatacttatatctccttttttaaacatcagtaacttcatgtaaaacttttaaattaaaaaactttattaagctatgtatttcatgtaatattatacacaatctttttaattttttaagtttaatatatttgtgcaaataaaaaaagatgaccaatgccatccttttttattaatttatttaaataaagttttgctaaatttaataaatatttagttatttactatttcatttaatgcatcatatgcaaaatcaattatctctgaacaactaactttattcttctttaaatctctacatatttcactattatatttttctctaactttattcattaactctctagaatactgtctagcatcatttgattcagaattatcttctcttccttttaagtatcctaatactaatatagctgcatttacagctccacaaaggcttccaactgtcatacctgtacccataccactccctaatgcaactggtatatctgtatcatgctcttcattatatgactttattatagattctgcacaattgtatccttgttgatgatataatgatggttttgtcacttatatttcctccactccatattaatttttaaattatttaagtaataacttatataatatatattaactcatttacttaatatctgacgtgaaaatattaaacactataaatttttcctctcgaattcataaatttatctaaccttttacaaagccctaaccaagttttgtcattcatatttaaaactttatttcttgtcttaaattgaagtatattttctatcatttcatttatagctaaacctaaattattctcaaattccaaaagatctctttctaatggtaggccaatatccttcatatcaggcaagttaacatactttatctttccagatgtatttatatcttctccaatccattcgcttacaccaggtatattagtagtaatcacattacatccactagctaaagcttctattactactagtggcagaccttcaaaaaatgatggtaatataaatatatgagtatttctaaatacttcagctaaatccgtttgttcaatttttcctagaaaatttatatttattttacttttcttagaaaggttgattatactttcatactcttctttattacttccatctccaactatatttacacttataatttcttttttataatcaattttgtctaaagcttttatcaaagattctactcctttaagcttacaaatcttccctgcaaatgtaatatttatagtttcattatttatttgtttattaaaaaatatattctcatcatacccactacctaatgaaaataccttatctttatctatgttaaacgtattaattatttcttctttttgttcatcatgaagtgaaaatatcatatctaaattacttatgttattttttatataatttttttctaaatcatggctttttatttgtttaagacacgtcccatgacatacccctacaacaggaatatcttttactgtttctcttataaaagcagttattagatataggtgatgacaaattatcaaatctggatttatttcatttattgccttttctagattatgtttaaaaacttcttttaagttatttaccatatccaaattcatatgcctatatacagtactttcataaggcatgacatcactcatacctacaacattgaaaggtaatttatctgtattataaattacaggataaaaacttatattctcactaaaacatttcctagaatcatttttgtcaatacctgctattactccttgtttataccctaaagtgttaaacccttttatcattccactcatataaataccactgccggtgctatttggtttttgcgttattatatgtagtatattcatatatcccccttattaatgatttaaaaatttatgtctaaataaacacatgatgagtcatcatttatcttaaatcttggaaatctagtcgtaagataatcatcttcttctatttttctaagtctattataaatattaccaactccactttcttctacattattcaaaagttcttgttcctctatctcattgtatctatcactaatacatgaaaatccatcactagttaacataagttttatattatcttttatatatataaacccatttattgagttatctatagcttctttatcaaaatctaaaatccaatatccatcttttgtattcttttttaatctatttgatattattgttttcataacactactttttatttcttcatatgaaagttcttttaaattaggtaagttttccatttcatcatatactaatttatctaagtaacataaagttctatcttttataatttttactttatcttcgtgtttaaaatgaagtgcacaatctcctagtaaaaaatattctattttatcactataaaactttataattgaaatagaacttgaaggtgtatccaatttttctattctatctttatttacaataccatagtactcatccctaattaattttattccatcagccataatttcttttaatgcaatttctttatttatattttgatgtaaatatttattccaccagtttacataccaattagcatcacttttatctgatactaaatttttattattaagacctgtcgctccatctaaaacccaagctccaaaaggactaacacctactatatcttcattatattttgcactaccttgatagcataaagtatcacaaactttcatctccatatgatatcctccatctatggcacatctatattaccatataattttaaaaaaacttgtcgaaaaatatgtgaaaaagtattattttatatttttccataatacttcaaaattcacctttaattaagtgtattctatataaattgttaactttcctttatatatttcatagttatattctatactatatattttaaaattttatataaattaatttataataaaaaaggactatttcaagctacttgagatagtccttttttattatttaaaatatttaactccagattcaaatattttttgatctttttctcctataatatttttaacaacttgatttccaattctttctgagtgacccattttcccaagaattcttccatcaatgcttgttataccttctactgcgaaagtagatccatttggattaaaatttatatcataagttgcatttccttctaaatccacatattgagtagctatttgcccattagctatcaattgttttaaagttttttcatctgctacaaatcttccttcaccatgagaaactgctatactatgaatatccccaacttctgtaccatacagccaaggagatttattagatgaaattcttgttttaaccattttggcttgatgtctccctattttattataagtaagtgtagggcaattttcatctatatccattattttaccataaggaactaatcctaattttataagtgcctggaatccattacatatccctagcattaatccatcttttttagttaaaaattcgttaactgcttcagctattttaggattcctaaatactgtagctataaattttcctgagccgtcaggctcatctcctgcactgaatcctccaggtaacattattatttgtgaagattttatttcttctaccatagaatctatagagctttctatatctttatcagttaagtttttaaatacctttatagaagtttttgctccagctttctcaaatattctagctgaatcatattcacaatttgttcctggaaaagttggtataaatacctttggcgaagccaaacttattcctgatttacagtctttagtatctgttataaagcttatagtttctatcttttctttaatcggctcaacttttgttggaaatattggttctaaaacttcacaatacttattgtatataaaatctatatctattttttcattttctataaatatagattcttcttgtactgtatttcccaatatcttataattgtatccttttaatgactctaaaacttctttagtatcatcttttaattccaggattatattgccataagatgccccaaataatatactttcatctatttcaatagattcattaaacctaaatcctattttatttccaaaactcattttgcatattgcttcacatactccaccgtagcccattgaataagctgaacttactttttcatcttttataagttcagttactttagataaatttttctttaattcttcaaaatcaatcactttattttcaagtacttttgttgataacattatcactgtagaattagaatttttaaattctggggataagacctgttttgcatccacagtatcaacagcaaaagatactagtgtaggtggcacatctatatctttaaaagtaccagacatactgtctttcccacctattgcaggtatttcaagtttgttttgcgcatagtacgctccaagtagtgctgaaaacggtttgccccattttacttcacttatccccaatttttcaaaatactcttgaagagtaagtcttatagagctaaagttacccccaatagccacaactttacacacagattcaactactgcatataaagctccatgaaatggactatattttcctatctttggattatatccatatgtcattatagtagatgtgtctgtttctccattaagaacaggaatttttgccaccattccttgggttggggtagcttgatatttacctccaaatggtaataacactgtatttcctccgattgtattatcaaacttttcaaccagtcctttttgtgagcaaacatttaaatctgtcatagtttctataaacttatcttttaaacttatttctttatctactactacttcaaatttcttttcttttactttattatttatttttatatcatctatagctttaactctaaccttagtagtttgtttaactccattagtttctataaagtctctagacatatctactatagtttttccattccagaacattctaactcttttactatcagttacatcagcaacatgagtagcctctaaattttcttctcttgccatatttataaacttttctatattttctttttttataactacagccatacgttcttgagattctgatatagctaactctgttccatctaatccttcatattttttaggaataacatctaggtttatgtctatactttctgctatctcaccaatagctacacaaaccccaccagctccaaaatcattacatctttttatcatttgagctacttctttatttctaaaaaatctttgtatctttctttcatttggtgcatcacctttttgtacctcagcgctacaagtaaataaagattcttcactatgctcttttgaagaacccgttgctcccccacatccatctctaccagtctttcctccaagtaatataactacatctccactttctggagtttctcttattacattttcttttggtgctgctgctatcactgcccctatctccatccttttagccacaaaatcttcatcatataattctgtaacttgacctgtagaaagtcctatctgatttccatatgaactatatccattagcagcttgagtagttattttcttttgcattaactttccttctaatgtatcttctaaggaagttctagggtcagcacttcctgtaactctcattgcttgatacacataacttctacctgaaagtggatctcttatagctcctcctaaacaagttgcagctcctccaaatggctctatttctgttggatggttatgtgtttcatttttaaacattactaaatattcttcttttttcccatctatttcaacatcaacatttatactacaagcatttatttcttcacttacatctaagtcttctaattttcctatctttcttaattctttcatagctattgttgctatatccattaagcaaacatctctatttgtttcaccataaacattttttcttgattgtaaataaagatcgtaagcctcttttactacatttgtatatttactttcttctataactatatcctctatttttgtcatgaaggtagtatgtctacaatgatctgaccaatatgtatctaaaacttttatttctgttattgtaggatttctattttctatttgtttaaaatatttctgtacatgaagtaaatcgtcaaaagtcattgcaagtcctaaatttttcattaaatcttttaattgattttcttctaaatttataaatttttctaatatatctactgatgttggtatttcagtatcaacttctaaagtttctggcttttctagccttgcctctctactatctacagggtttatacaataagattttattttcttaaattgttcatcggttatgtttcctgtaagaattacaactttcgctgtatttataataggtcttattccttgattaataatttgtatacattgagatgcccaatctcctctttggtcatattggccaggtaaatattctatagcaaatactctatcttctttgcttaattctacatactctttatatacatcatctgtattaggctctgaaaatacagtatttattgctttttcatatacttcatcttctattttttctatatcatatctatttaaaattcttaaattttctattgtatatatattcaaactttcttctaaatcaaattttagatgcttggcttccaagtcaaatccttgctttttctcaactaatattcttcttacagaagatgctaagttagtgatagacatcatagtatttacccccattaaatgaattggtttagtctctcattatataagtcataattttttataaaattcctatatccgttctgtaatgcattccttcaaaatttaatttttcaatatttgagtaaacttttttacttgcttcctcaagagactttccttttgtggctatgccaataaccctgcctccatttgtaactaattggtcatctaatatttttgttccactgtgaaaaacaactatatcctcatctaaatcttcaagtccttttattactttttctttttcatagttttcaggatatccacctgaagttagcattacacatactgcatgcttttcatcatattttattttaacttcatctagtttattatctaaaatagattcgattatctcaattaaatctgtttctaatcttaaaagtactgattgtgtttccggatctccaaatctaacattatactcaagaaccttaggtccatcttctgttatcataagaccgataaataatattcccttataatttaagttttcctctttaaacccttttaatgttttgtctaaaacttcttcttttactattgttgataactcatcatcatatatattacttggagagaaggttcccattcctccagtatttggaccctcttcattgttatatacttttttatggtcttttgcactttccattggaacaattgtattattatcaacgaaagcaagtatagaagtttctactccttttaaaaattcttcaactactattttttctccaacgcttccaaattttttatcactcatcatatcttctaaagaacttaccgcttcttcatgattttgtgctattattacaccttttccagctgctaacccatcagcctttataactactggatatccaaataaatcaatatcttttatagctttatctatatttgtatattctttatattttgcagttggaatgttgtgttttatcataaattcttttgaaaaagctttgctcccttcaagtcttgaacattccttattaggtccaaatatctttaaattttctttttcaaattcatcaactatcccttctaccaatggaacttcagggcctactatagttaaatcaatttcattttctttagcaaaacctagaagtttttttatatcatcatcttttatatctatacatttagcaattttactaattccagcattcccaggtgcacaataaattttttcaactttattttcttgacttaacttataacatatagcatgttctcttcctcctgaacctacaactaaaactctcatatatttccctcctagtgtttgaagtgtcttattcctgtaaacaccattaccatatcatttttgttgcaagcatctattgagtcttggtcttttatagatcctccaggttgaactataccttttataccgtactcactagctaaagttacacagtcatcaaatgggaaaaatgcatccgatgctagtactgctcctttaaaatctttatctttattattttctaaagcattttttaatgcccatattctagatgtttgaccacatccaagtgctaatgtttgcccatctttgactatagctatagcatttgatttcatatttttaactattttcattccaaattccatatcttttttcattctttcatcagcttcatttactgtaacatttttatattcattaactaatttttcatctctgtcttgaactaataattttccatctaagtattttaaatcaaatctttgaagactatcttctatatttgaaagctttaatactcttaagtttttcttttgttttaaaactacaagggcttcttctgtaaagtcgtaagctactactatttctaaaaatatttcatttaattttttagcagtttcctcatctacagttgaagtaaatcctacaattcctccaaatattgaaaccttgtcagcctcataacattttttataagcattaaagctattatttgcaattccaactccacatggattagtatgttttacggctacacaaactacatttttactatctttaaattctctcattatttctaagcatccatgtaaatcatttatattattaaatgaaagttcttttccatttaattgttcataatttaatattggatttttagcattagattgggtatagattactgcttcttgatgaggattttcaccatatcttaagctgtcttccttttggaacgtcatagttagatattctggaaatttatcatctaattctcttctaaagtaattagatattaaagcatcgtatcttgctgtagttgcaaatgccttatatgctaatttttttctatcctctaatgatatttctccatttcttaagctctctattatagaatcataatctttaacatcaactactactaaaacatctttataatttttagccgcagatcttatcattgatggtccacctatgtctatgttttctatcatcacatcatgttctttattattttttaaattaccttcaaaatcatataagttaacaacaactaaatctactgcttctattttatgttctttaactgttttaacatgttcttcattatctcttttataaagtattcctccatgtatatatggatttaatgttttaactcttccgtcaagtatttctggaaagtttgtaacttcatctatttgtataactttgcatcctttttccttaagagttttaaatgtatttcctgttgatattatttcatatcctaaatcatttaaatttttagcaaaatctactaccccagtcttatcagttacacttattaatgctcttttagtcatttataattactccccttccattaacagttaatttattttcacaatatagttttacgctttttttaagaattttgtgttctacatctaatacccttgatgctaaagtttctggtgtatcatcatacttaacttctacactttcttgaattattataggccctgtatctgcaccttcatcaacaaaatgtacagtagcaccacttaattttgctccataatctataacagctttatgaactcgtttcccgtaatacccttctccacagaaagctggtattaatgatggatgaatatttataattttgtttctaaaagtttttacaaagtttggactcataatttttaagtatccagcaagaactattaaatcaactttttctctctttaataatttaataactttatcttcatttttctcgactacagcttttatattgtgttttttagccctttctagaccataagctccatctttatttgatataacaatcttgacttttccatttatatatccactttcacaaccatctataatgctttgtaagttgcttcctcctccggatattaaaactgcaatgtttaacatagatttactccttcatggctatctacaacttcaccaattataaaagctttttcttctccttcatttataaatttagttatctcttctgatttatctgaatctacaactattacaagtccaattcccatattaaaacttttgtgtagttctatttcatctatagaattaaatttctctatcattttgaatatagccggcttttcccaagaatttttatttatatctattccaagaccttttggtattactctaggtatattttctataattcctccacctgttatgtgtgctattgcttttaaatcatatttttgtattaaattcataacaagtttcacgtatatcttagttggtacaagaagtgcttctcctaatgtcatttctaattcttctatatactgatctaattcatatttatattcttctaagaaaatctttcttataaatgaatatccattactgtgtattccacttgatgctattcctattaaagtatctcctgatttaacattttgcccacttattattttatttttatctgctatcccaactgaaaaaccagctaaatcataatcttcttttgaatacattccaggcatttcagccgtttccccacctataagtgcacatcctgcttgtttgcatcctttaactattccagaaactatatcatctattttttcaggaactagcttacctgtagctatataatctaagaaaaacaagggtttagcgccttggcatataaggtcattaacacacattgctactaagtctatacctactgtattatgaatatttagcatctgagctagtttcagcttagttccaactccatcagtcgatgaaagaagtactggttcttccatactcataaagtcttttaaactatataatccactaaaatttcctaagtcacctataacattattatcataagttccttttattttattttttataagctcaacagctctatttccttcgtctatatttacacctgaatctctataagttaacatgatacaagttccccctcatcgattttttcaactggatattttccatcaaaacatgccttgcagaaagttgatttattttctgttgcttctaaagttccttctatacttaaaaatttaagtgtatcgcaccctatataatctcttatttcttctaaatcatattttgaagctattaaattagagcgatgtggagtatctatgccgtagtagcaagagtgagttacttcaggagaagttattcttaaatgtatttccttagctcctgcatctcttaatgatttaacaatttgtcttgaagtcgttcctcttactactgaatcgtctactaaaacaattgatttatcttttactgcattcgttaggggatttaattttatttttactcctatttctctttcttcttgagtaggttttataaatgttcttccgacatatctgtttttaacaagcccttctgtaagtttaatcttgctagcatttgaatatcctatagccccagcccatccagagtcaggtacaggaactactatatctgcatttatattttcatcttgagctaaaatttctccacactttactctaaactcatatacattaacattatctatagttgcatcatttctagcaaagtatatatgttcaaatatgcaacttgcttttattggtttatagttttctctatagtgatatgattttagttcgttatcttttattactacaatctctcctggctcaatatcccttaaaacttctcctcctaatatattaattgcacagtcttcagaggctactatatatgtgtcatcttttttccctaataataatggcctaaatccatgagggtctctaacagctacaagttcattttcactacttgctataactaatgaataagcaccttttatataatccatagttatctttaaactttcaactatatcacctttataatatcttgctagtatacaaagtatagcttctgtatctgaatctgattgaagcatatatccttcttcttctaacatgtttcttaagtaatttgcattaacaagatttccattgtgtgctatagataattgtctctttctacatcttcctactaatggttgacaattagataaactacttcctccagctgtagaatatcttacatgccctattcctatatttccttttagtttttctaactcgctagatttaaaaacatctcctacaagtcccatatcctttttaaaattgatttggtttccatttaaaactgatataccacaactttcttgacctctatgctgtatagagtataatgagtaatataattcttttgatatatctttattcgagcatattcctactacaccgcacatttaaatatccccctgattaattttctattctagaaagaacttctgtgtatccttctactaaatctcccaaatctcttctaaatctatctttatcaaatttctcatttgtatctacatcccaaaatctacaagtatctggagatatttcatcagctaatattatatttccatctacatcttttccaaattctaatttaaaatctactaacttaaaattcatatttaagaaaaatttcttcattatatcatttatttttaaagtttcttctcttaaaaatgctaattcttctctagttgcaagtttcatggctactgcatgatcatcatttagcattggatctccataatcatcgtttttatatgaaagttcaaatattggttcttctaaaactataccctcttctattccataccttttacaaaatgaacctgctgttatatttcttacgattacttcaagtggtaaaatttcaacttttttaactatcatttctctatccgaaacaccttttataaagtgagtttttataccttctttttccaacatttcaaacatagctgtacatattttattgtttaatatcccttttgaatttattgaagcttttttctcaccattaaatgctgtcgcatcatctttgtagtaaactaggtattcattttcattttctgtactaaatatttgttttgcttttccttcatataataacattttgattacccccttaaattttgatcatcttctaatacttttaattccatctcttttctataattctttaattgttctttaatttctgggtatttaatactcattatctgagcagccattaatgctgcatttactccagaatctatagttacagtagctacaggtattccttgtggcatttgaactattgaaagaagtgaatctaaaccatccattgtagatgactttattggtaaccctataaccggtattaaagtatgtgatgctattactcctggtaaatgtgctgcttttcctgcagctgctattattacatctgtgtcattttctatttcttttaaaaaattcattaattgatttggagttctatgagctgacaatgctcgtgctgaaacttctattccgaacttttctaaaagctcaattcctttttctaactttagataatctgactttgaacccataactactgctattttcatcataatcctcctatttttacatacttaatgttttttataattttaaacatacgtattatataacgaaccttatatttaaatggtatcttattatacgtattttatcaaccatatatttattttttgttcgagttttttatataagtttttaatcttataaattaaataaaaaaagtcacatacttgctatcaaagatatttatagcaagtatgtgacttttataaaatcattatattatcctaaaaacttatccaaccttttacttacatcaaacccaaaatctacacctattattaatccaaatacaatagcataggcaaaatcaattccccaaaacaagaatttctttttaagatttgtgttcatattatcaccctattaaaatatattatatatattattatattcctaacatctatattttctacattttaaaaatattactgattcattatatcaactatttctccagtatacatattaacctcaaaccatccacttgtagctatatgactctcctctttatttgttataacatcataggcatgaacaatatatttatctccatcaacattatccacttctatgaaattgggtatataagaatttttatcttctaaatatttttttactaaatcactagcctcttttttgcttagttttttatctacattattaattgatgtttcttttaaattttctttattataacttttatcactgtctgaactactagcacaacctataattaaaaatcctgaaagaaatatactagttactaaaacactatataatttcataggttacctccatattatgaaaaatttactatctaatatagttcacaagttaactaattttcattcagtaacagcttaataaaataattttatttttcactaattcttaaaattacgaaaatataagaaatctaattaaattgttttaatttaattttatgtggtatctatataaaataattaaaatttataatttatacttagggagatgaattaaagatgaaatctttaaaaggaactaaaacagcacaaaatttaatgaatgcatttgcaggagaatcacaagctaaaaacaaatatcaattctatgctaaaatagctagaaaagaaggatttgttcaaataggtgatgtatttgacgaaactgctaataatgaagaaatgcatgctaaaatattttttagatacttattaaatgattttactggagaagatgttcaagtaactggatcatatggtgtaggaatggctagcactttagaaaacttaaaatttgcagcaaaaggagaagatgaagaagatactctttacttaaaattcgctgctgaagctagagaagaaggatttgaagaaatagcagcttctttcactcatatacatggaatagaagctcatcatagagatagatttttaagattagctaaaaatatagaagaaaaaacagtatttgaaaaatctgaaccacaagaatggatatgtacagtatgtggatatgttcatgtaggaaatgaagctccacaagtatgtccagcttgtaaacacccacaaggatactatgaagtaagagcagacaacttctaaaactaagtataaaaaaaggttaaatacatattaaaatgtgtatttaacctttttttattttattttttaaatattatattataataatataaactttagtataaacattatcgaaagtaatattaatgataaattaacttcttttttctttcctgtagctaactttaatattgtaaatgatattattccaaatataataccatctgctatactatatgctaaaggcatcattgcaaatgttaaaaatgctggtattgcattagtaaaatcgctaaaatctatttcaagtaatgaacttgccatcataactccaactaatataagtactggagcagttgcttgtgctggtattgcagtaaatatcggagcaaagaataatgaaagtaaaaataataagcctgttgttattgcagttaatccagttcttccaccttctcctatacctgaagcactttcaacataagctgtaacagttgaagttccaagtaatgatcctgttgtagttgctatagcatctgcgaataatgcctgcttagcttttggtaatttaccattttcatctaacatgtttcctttagatgctactcctactaagcaccctaccgtatcaaataaatctacaaataagaatgtaaatactactactatcatatctaaactaaatatttgattaactggaactgaaaatgcttgtaaaaatactggttttaaagatggtactgatgaaactatagctgaaggtaattgaactaatccagcaacaattcctattgcagtagtaactaccatagctagtaaaaatgtacctttaacatttttagaaagtaatacagctgctattactaaacctgctatagataataaaactgttggactttgcatattacctaattgtaatatagcacctccaccttcaactattcctgcatttactaatcctataaaagctataaataatcctatacctgctgtaactgcatgctttaaaactttcggtatacagtcaattattttttctcttacattagttactgttaataatataaatattaaaccttctattaaaactgcacataaagcaaattgccagctataacccatttgtaaaactactgtatatgcaaagaatgcatttaatcccatacctggagcaagtgctattggataatttgctaataatcccattacagaacttcctataaatgctgctatagcagttgcagcaaatacagcatctttgttcatcccagcatcccctaatacactaggatttactactaatatataagccattgtcataaatgttgttattcctgctataatttcagtcttaacagttgtattatgttcgcttaacttaaaaaccctatctaaaatagatttatttccctttgaagtttgtgctatttgcatatccttcctcctatttttataaaatataattataatttcgttcgtattttaccaaccttataccctaattatattttatggcggatactttttcaagtcattttacgaatattttaatattatttttattttatattcgtattttattaatattttctacaataaaaaataaactatcttaaaatatttgttttataacatctaatatctcaagatagtttatttataataattttttaattagcttctacaagctcttctttaacttcattttctttaatttcactttcacttaaccctctgttatactttttagtaaatataatcaataataatattgaagctataaagtacaatacacttgctatataatatgctctaccataacctgcatcagtttttaataatgaatatctagcaaatatacctgcaaatatacctactatagagtttgatataagtataaatgaactatatgctggagctagatttttaggtacaaatgtaagtggcagtgattgttgtataggatttgatgcattagcaaatccagatcttaaaaataaaactcctcctattatccatgctatgtttcctccaagcatagctccatttgccattattatcataagtggtatacataacatcatagatgctgatatagttattatagatccaagtttcttttctaaatatggtgcagcaagaaatcctagtaccatagctaaagtttgtaatgtaattattgttgaaactgtacctctacttatatgtaaaaagttatttaaatatattgggaaatatggagttataagcaatgctccaaatcgtattatactaaatattacaacccacattattatatgcttattaagaaatatcttaaaatcaaatttcttttctgcttttctagcaattatctcttcttctgattctctataatcttcaactctttctcttaaaaatactaaacaaattaatgctaaaacagtaaatattattgcgatccataaagcaaatctatatgaatttatataataactcatttgagttgaatttaatttactggcattttcagataaagttgaagcttgattataatcaattcctaaatatctactaaatttccaaacaactactttcccatttaaaaatgttaaaagtgattgacttattaagttgcaatacattactcttgaaaacattgaaattcttttttcttttggtgtgtatgatgtaaacattagaggatatatgaagtcgaacatgccagcccctatgttaactaagatgtttgagattagaattactttcgcattactactataaatacaagatagtagcgcacctattaatgctattggtgcaaataatataattttcttataccctaatttgtgaactaataaaagtgtcattgccatgatgaaagttgctattgaggtatacattggtaaagcctttacaacatccggtactgttaagtttaggtatgatatatatgaatcatttgttatacctgtaacagctcccataaaaatgtaactaacaataaatatggcacaattatatttccatctgctgtcccaattcttgtcattgcttgtaattataccaactaacttctcttccatagaactcaccccttagttgttttatataattatataacaatatttgacaaaaacctcgcgttttttgtttacataattattacattacgtaaaaatatattatattcaaaatatagttttatttttaacaatcttattcttaattttaaatataaagaaaatactgaattgaaactaagatttttaaactgatattaattatcatatcctctataaatacattttatatttataagataaacactctattttttatattttaaataatatatttatcatattgattgttttatttttattttttaatatcaaaaaaatctataagtatactaacatatacttatagattttaatcatattataaaaatgcaaattttaaaataaatattacacttagtataatcattgaaatttttgtttcttctttttttccactaactaattttaagaaagtgtaagctattatcccaaacataattccatctgcaacactatatgataaaggcatcattacaaatgttataaatgctggtatagcatccgtaaaatcttcaaaattaatttttaatatagaacttgccatcaaaaatcctactagtataagtattggagctgttgcttgtgcaggtatagatacaaataatggtgcgaaaaacagtgatataaaaaacaaaattcctgtaatacaagctgttaaacctgttcttcctcctacggctattccagatccactttctacagtagttgctaaagttgatgttcctaaaactgaagatatagttgtagaaacagactctgataataatgctttttttacatttggcatattaccattttcatctaataaattagctctttgggctattcctaataaaaatccaattgaatcaaacatattaacgaataacaatgtaagaactataactaacatatctaaactaaatatttgactacgacttacatcaaatactttcataaatacaggttgtatagatggtggtacatcaattacaccagttggcataggtactattgcaaatagcatacctattgcagatgttattattatagatattaagaatgctccatttacattttttattaatagtgtagcagctatcattaaacctattattgcaagtaaaactacaggagattttatattccctaaagatattattgcccctccttgctgcactattcctgcatttacaagacctataaatgttataaataatcctatcccagctgtaattgcatgttttaaaacatccggcatacactctattattttttcacgaacattagttactgttaataatacgaatataataccttctataaacatggcacataatgcaaattgccaagtatatcccattcctaatactacagtgtaagtaaagaatgcatttattcccatactaggcgctaggattataggatagttagcaagtaatcccattataaaacaccctatacctgatgctattgccgttgctgtaaatacagctcctttatccataccagcttgtccaagtatattaggatttacaactaatatgtatgctatagtcataaaagttgttactcctgctaaaacttctgttttaacattcgtattatttgcgcttagcttaaaaattttttctaaagtactattaactttagacgaattcgtattttgcatattgctcctccgatgctgataattttagtattgattgttataaatataaaaaaataaaaagcctaggctttttatttttttatattttattaataaagtgtttgaataaacttcttattcccattcaatagttccaggaggcttactagttatatcataaactactctgttagctccatcaacttcattaacaattctattagatattctttctaatacgtcatatggcatcttataccagtcagaagtcataccatctgaagaagtaacagctcttatacctactaagtaagcatatgttctttcatctcccataactccaacagtttttacatctggtaaagttgcgaatgcttgccatatcttgctatatagtccagcttttttaagctcgtccatatatatagcatcagcttctcttaatatatcacatttttccttagttacttcacctataactcttattccaagtcctggacctgggaatggatgtctatatattaaatcataatctattccaagttctaaacctatttttcttacttcatctttgaataattctcttaaaggttcaactattttaaactctatatcttcaggtattccaccaacattatggtgagattttattgtagcagcctctccttgtccactttctacaacgtctgggtatatagttccttgaactaagaaatccatttttcctaatttattagattcttcttcgaatactcttataaattcttcacctattatttttctcttagcttcaggttcagttacaccttttaacttagataagaatctatcttcgcagttaactcttattaagttcatgtcaaacttatctctaaatattctttcaacatcattaccttcattttttctaagtaatccatgatcaacaaatacacaagttaagttgtctcctatagctttatgaacaagtacagcagcaactgatgaatcaactccaccacttaatgcacaaagtactttcttatcacctatagtttcttttatttcttttattttttcttctataaatgaatctgttgtccaatctccacttacttcacaaacattatataagaagtttcttaaaactttatctccatctagacaatgttcaacttctgggtggaattgaactccgtataattttttctcaggatgatgcatagcagcaactggacaatcagtagtatatgcagcaacttcaaatccttcaggaagagtatctattaagtctgtatgactcatccaaacagtgtttgtatctataccttcaaatatacttgaagcattgtatgttatagaagttttaccatattctttttcactgttgttaccttttcttacattaccaccaagtaagtgagccattaattgaactccgtaacaaattccaagtataggtactcctagctcaaatatttctttacttatcttaggagactcttctaaatatgcactattaggtcctcctgtaaatattataccttttggatttttagattttattatttctatatctgttgtatggggtaatatttcacaatatacgttattttctctaactcttcttgctattaattgattatattgtcccccaaaatctattactaaaactaattcatgttgctttttcatattttatacctccccttgagtgctgtaatttggtgcttctttagttattgttatgtcgtgtggatgactttcttttaatgaagctgctgttatttttataaattcaccattttccattaaatcttttatagtaggtgctccacagtatcccataccagctcttataccacctatcatttggtatactatatcttcagctttacctttatatgccaccattccttcaacaccttcaggaactaatttcttagcatcattttggaaatatctatctttagaacctttttccatagctcctatagatcccattcctctatatgttttatatgatcttcctctatataatacagtttctcctggactttcttcagttccagcaaacattgatcccatcatacatacagatgctcctgcagctaatgctttaactatatcaccagaatattttattcctccgtcagctattactggtaccccgtacttatgtccaacttcagcacaatccataactgctgttacttgtggaacacctatacctgcaacaactcttgttgtacagatagatcctggtcctataccaacttttacacagtctgcccctgcttttattaaatcttcagtagctttagcagttgcaacatttcctgctataacttgtaaatttgggtatttcgctttaacactcttaagtgcatttataacacccatagaatgtccatgtgcactatcaagtacaactacgtcaacattagcttttactaaagcttctactctatccattaaatcagcacttattccaagagctgctccacataataatctaccttgagcatctttagcagagtttggatattgtattttcttttctatgtcttttatagttattagtccttttaaatgaccttcttcatcaactataggtaatttttctattttattttgttttaatatttgttgagcttctactaagtttattccttctctagcagtaacaagattttctttagtcataacctcgtccacttttttagtaaaatcatcttcaaattttatatctctatttgttattattccgattaacttattattatcatcaactataggtacacctgatatcttatatctagccattatatcatcagcatcttgtattgtgtgatcttttgataagtaaaatgggtcaactataactccactttcgcttctttttactttatcaacttctaaagcttgctcttctatagacatgtttttgtgtattattcctataccaccttgtcttgccattgaaatagccattttagattcagtaactgtatccatacctgcactcattaatggtatgtttaattttatagtttttgttaattgagtttgtgtgttaacatctttaggtaaaacttctgacttttgaggaactaaaagtacatcgtcaaaagttaatccttcttttaatagttttgccatatcagttgcccccttcgttatttttttatgcttacttattatttttatataattaaaaatttttatgcttaaaattgttaaatattaaaattataaaaatataaaaaaaatctgtataataatttcttattttaatataagtgaaattactatacagattcccaaagttcatttatttatagctaacctgtagggatttagtatcagcctacaaatttacttacgatgatagaactttgttataataatttcactcatagtcgatgtattttcggtacttcggtagaaactctcagaccatatttctgagtatatatgagtgatttttatttgcgatattgtatacacgttgtaataagttgtttattaatttatcaaattttattactcgtgtcaacatttttatatgaatttattttttattgaacagtttatgctatcatagacagtttttatggatatattagcccttttagctatcattttacactcctcatattcaggagtaacttttacaattttatttttataatatcctattttaactgttacatctccatattcacaatgtactttatcaaactctcttaaaagagtcttcctattatatatatgatatctaactccaaaagtactagtttctatcaatatcgtttcaataaatttgtctaaatctatctcattacataacacagataacttaattgcaggtctgttttttttcatatatatgctttgtgtgtatacatctaaagctccatcttctattaatttctcatataaataagaaaaaatctcagaagacatatcatctatatttgcattaatttcataaattagttcttctttttttttataccaactatagttctaagcatatttggcatttcaaactttttatgacctattccatagccaacttgctctacctcaaattctgatacatctacaaattcatcacataaagtttttattattgcagctccagtaggagttgtacattcaccatttacagtatttaatttaattggaactccttttaatatctcaattgtagcaggtgctggaactggcataataccatgatcacactttacagtaccagaaccaacaggtacagaacttgaatatatcttatctatatttaataaatctattaatactgaacaacctactatatcaactatagagtcaatagctccaacttcatgaaagtgtattttatctatagttgttccatgtactttagcttctgcctctgctacagtcataaatatctttttagctctgtcttttatactatcctttaaagatgaattatcaataatttcaaatacatctactaagtatctatgagcatgagtttcttttgctattacattaacttttgtccctactataccactttcatttttataatctatttctatactaaactcgtcatctagattaagcttattcatttcttctaaaaatatttctgatggaactcctgcatttattaaactagccatagtcatatccccagaaataccatttactatatcaaaatataaaactctttcttctaacataatttacactcccatttaattagtgttaatctaatttatttatagtagcagccaaatagccagctccaaatccattatctatattaactaccgatatacctgatgcacagctatttagcatggttaaaagagctgaaagaccaccaaaattggctccataccccacagatgtaggaactgctataacaggtacatcaactagtccccctacaacacttggaagtgcaccttccatacctgctacaactattaataccctagctgatttaagtatactcattttatttaataatctatgtatacctgctactccaacatcataaactctttctacttcatttcctaaaaatttagctgtataataagcttcatctgctacaggaatatctgaagtacctcccgtaacaactacaattttccctttacctacattctttataggcttattttgtatttttaaaattctagataattcttcatactcacaatttggatatacgttttttaccttctcataagtatctttcctacatctagttcctaatatattagaacctttttccttcattctttttataatccctaatatatgttcatcactttttccttcacaatatataacttctggatatccatttcttatttgcctatgatggtcaatatttgcatatcctatatcctcataaggtaaatcttttaatttatcaatagctaaatctatatctatatcaccatttttaacttcttctagtaaatttctaatatccataagttccccctattattggttgtttaataataattttaacacactaagcataccttttccagccacccagttccatataatatttacatataaaaaagagataatttgaaaaaatcaatttcaaattatctctttttatttttctcttatcacaataagttaaataataagaattacaaagggcgaagtgttaattataattgttgaagaaacgttaaagaccatgccctataggtctttaagtgaatgaaacaactataattaacacgatgccaaccaaagcttactattaccaacctacatcattggaggcattcctccacccattccaggtactggctcgctttctggaagatcagcaacagcagcctcagtagttaaaaatacacctgctatagatgcagcattttgtaacgcacttctagttaccttagttggatcaactataccagcttctatcatattcacgtatttttcatttaaagcatcaaatcctacttcagcctcttcatttataactttttgtattataacagctccttcaagaccagcattaatagctatttgtcttaatggttcttctaaagctcttcttattattttagccccaacttgaagttctccttcaagttcttctattaatttatctacaactggtataacactaactaatgcagtaccaccaccagcaactataccttcctcaacagctgctcttgtagcatttagagcatcttctattcttaattttctttctttcatttcaacttctgttgcagctccaacttttataacagctactccaccagcaagtttagctaatctttccattaatttttctgtatcaaattcagaagtagtttgctcaatttgatgttttatttgagctactctatcttctatagctttcttgtctccagcaccatctactattgtagtactttctttagttactttaacagatcctgctctacctaacatagataaatctgcttcttttaaatcatatcctaattcttcagatataactgttcctccagtaagtactgctatatcttcaagcatagcttttcttctatctccaaatcctggagccttaacagcaactacttcaaatgttcctcttaatttgttaactactaatgtagataatgcttctccttctacatcttcagctactattaataattttttaccttgttgaactatttgctcaagaacaggtaatatatcttgtatattagttatttttctatctgttattaatatatatggatcatttaatacagcttccattttgtcaacatcagttaccatgtaagctgaaacaaatcctctatcaaattgcataccttcaactgcatctaattcagtatgcatagtcttagattcttcaacagttataactccatctttacctactatctccatagcttctgctattagatttcctacttcttcatctccagcagatatagaagcaacttgagatatagattctttagtttctatagtttttgattgtttttttaattcttcaactgatacttcaacagctttttgtatcccttttctaattaatattggattagctcctgcagttacattttttaatccttctcttattatagcttgagcaagaactgttgcagttgtagttccatctcctgctacatcattagttttagtagcaacttctttaactaattgagctcccatattttcaaatctatcttctaattctatttctttagctatagtaacaccatcattagttataagtggtgctccaaattttttatctaatataacatttcttcctttaggtcctaatgttacctttacagtatctgctaatttatttacaccagcttctaaagctgatcttgaatcttgagcgaattttatttctttagccattttatatccctcccctaatattattcaactactgctaatatttcactttgttttaatatagtatattcttgaccttctaatttaacttctgatcctgcatatttagagaatattactttatctcctacttttaattccatcttaacttctttaccatctactattccaccaggtcctacttcaactacctcagctatttgaggttgttctttagctgccccaggtaaaactataccacttgcagttttttcttctgcttcaattttctttataactactctgtcagccaatggtcttattctcataattatccctcctaatgaaatttatatatgtaaattttttattagcctttttatcactctactcattagagtgctaataattttataatatatcaaacttttttatttttcaatagttttaactagattttatgtattttttatacgaggaatttttgtttatattgacaaaactcctcgcataatatatttataaaatcggagaaaataatcttgccacagattctgcccatttttttataaatggtctattttcaaaatcttttaattttatttcttcgctattttcaagatctttaaagaaatcatctgttattttacttattattttttcatcataaataaatgcgtttatttcaaaattaagcataaagcttcttaaatccatatttgcagaacctattgatgaaatcttatcatctataattactacttttgagtgtataaatccttttttatataaataaacttttcctccagaccttaaaatatcatcaaaatatgaatatgatgcttgatgtacaattttatgatctgcgatacttggaaatataattcttacatcaactccactaagtgctgcactttttaatgcccttaacaaactctcatctggtataaaatatggagtctctatataaaccctttccttagcattacaaatagctgaaaaatatgcataatgtatagcttcccaatcactatctggaccagtagcaacaacttgtatcatcgagttgcccatattacttaattttggaaaatattgttcgtcaaatgattctttttgagtcgtataataccaatcaattaaaaataccatttgcagcatataaacagagctaccttctattcttatatgggtatccctccagtatccaaactttttatttttacccatatactcatcacctatatttatgccacccgtataacctatatgaccatcaattatagcaattttacggtgatttctataattgattttgccccctattataggaaactttgctggtaaaaatggtactatttctataccttcatctttcatatcttgaaagaattttctatgaaaccaaaacctccaacatccaacatcatcatataagatttttatacttactccttcatttgctttctttattaataattcctttaatttaatgcctatctcactattttttattataaaatattctaagtgaatatgctcttttgcttgttctatatcttttagtaaactttcaaatttttcgtttccatctataaatactttaacgttgttattagtcgtaaatggaaatttccctgtatttaaaagtaaacttattaccttcttttttataccttcataatattcatctttaattaaattattatcatttatagctctttgttctaattcaactagctcttctatagactccatatttttaaataaattattttcttttatatttgtagctagtttttgtgtattaaatatttttctctttcttatatttcgtcccaatactgcatatataactaaacctacccctggtaataatataaatattaatagccaagccatagtcttagctggatctctattttgaagtattatattaatagaaactataataccagctatgtatgatattattacatagcttaagagtattatatctaaagcaaccataaagcctcctttagttatcttcctatacctaattcacgtgcataatagaataaatattgttgagcaaaacctgataagtctccaaatttatctatagcatactttctaattttaggcaaactcatatcgtcttctacataaaattcttgcattactctcttcacccaaacatcaacagggaatgtgtcatacttttgcataccaaataacgctatacaatcacacactttaggtccaattccgttaaatttaagaagttcctttctacaatcttctgtatctaaatctctatatttatatacattatcattactagttacaacagcttctgttgtagactttatgtatttatctctaaaccctgtagaacaagatcttatttcttctatcgaagctttatttaattgctctggtgtaggaaaatcataataatctactccattatattttcctatataagttccatattctcttgataaattagctatagctttttgtatcataggtattctattgttagatgatattataaacgatattatcatttcccacggatcttgacgcaaaattcttattccccatccaaattcagttgctttttctaaatactcatccatactccttaacttatcttttatctttgagtaatcagtatctaaatcaaaatattctttccatatatcattaaaatcatttaaattagtattctttaaataaattgtttctccttctcttaatacatttattactctacctttagctactccagtgtatgatccatcatcttctgctttccatctaaaacactgcccacattcaaatatatgtttcggatcaaaatctgttactccttctaatataactagttcatttttttcgtatactttcatttttttactcccttcaattaagcttatacctctaattctacccaaatttttataaaattaaattaactatttttttataatacaaatttaatttaaaaagtctagagtagaattgataaattttttttgctaaaatacataagacattatttttagaaggtgattatatgaataatagaggtgtatttatagctatcgaaggacctataggagttggaaaaacaactttatcaaatatactaagtgagcactttaattatactttacttagagagatagttgaagaaaacccattcctatcaaaattttatacagatataaaagagtatgctttacaaacagaagcattttttctttttaatagaataaaacagcttgaagatacggaaaaaaatattttagaaaaaggtaatggagtaattagtgattatcacataattaaaaatttaatttttgcaggtataacacttgataatatgcaattttataaatataaacaaatgtataacatttttatcaatgatttgcctcaaccagatatagtaatatatcttaattcaaatacagatgttttaatgaagagaatagctatgagagatagaagctttgaaagacaaatggatataaattatatacatgaattgagaaatgaatacaaatactatttcaatccattatctataaagcataactttgtaggtaaagagcctattatattagaaatagacaactctaatttggactttttaaataatgaaaatgatagaaaatttataatagacaaagttgaaaatgcaatcaataacttagggggacattttaatgtttaaattggtaaatcagtgtaacaaaccactaaatagggatttatttattactgttgcaggtaatgttggagcaggaaaatctactttaacaaaattagtaggagaaaaactaggatttgaaactcattttgagcaagttgataataatccatatctagaggatttttataaagaccaaaatgcttggggatttcatttacaattatatttcttagctcaaaggtttaagcaacaaaaagaaatagatagtaatggcttaaataacattcaagatagaagtatatacgaagatgttgaaatttttgctagaaatctatacgataataaaaaaatgtctaaaagagattatataacatatagagatttatttaatgatatggtcccttatcttagaagaccagatttaatgatatatttagatggttctatagatactattattaatagaataaatttaagaggtagggatatggaaaaatcagttgatttagagtattgggttaatctgcataatcgatatgaaaagtggataagtgagtataatcaatctcctgtactttatgtaaatattgataaaattgatttaattaataatcctaaagatttagattctttatgtaatgagataaaaaaaatattaaatatataaattaaaaatgaccctttaaagggtcattttttataataatatagctattaatactattgctgttactatctgtaatatacctacaaacaatccatataatgaaacttctttaccttgttttataagatctttaaagtttactctaagtccaattgctgccaatgctattatttctaatttgctacttaattctttagctatgtgagataattctattggtattaaattcatagaaaataatgcacatgttataaaaaatcctattacataccaaggaatttcaatctttttattagatatttgagcttcttcttcttttataatttctgtgttagttttattttttaaatgtccaaatataaatactacaacaactaataatataactctcactattttaaatatagtagataaatcttttgtagcttcattaaccatcgctccactggctacaacttgacctactgattgtagcgttccacctattatagctgaagtcttcattagttcatgtttatataacactcctgctaatagtggtagtaataacattaaaacaacacctgttacattaactattgtaattgctattcctttttccttatcatcagcatttataactggtgcagttgctccaattgcagatgatccacaaactgcatttccacttgccattaaatatctaaagttttcactaaatcctaactttttacctatatatatagctccaactatagtcactgccatttgtataactataaatattattccacctaatcctaactccattattgtagatatgcttaatgtcgctcctaaaagaactattgaatatgataataattctgtttctgaaaatttataaccctcatgaaatacttttttatttaagaatagatttcctaatatcattccaagaaatatagaaattgttgctgcacctaaactcggtacaaatttagctaagaatatactaataaatcctattattatagataccattaatcctggtaatattttttttattttatccatatataacatctcctaaaacttgttgtctttttacatgaagtagtataccaaacttattattattggtaaaatagatatatatcataataatcattacttttttaaatgattttttaaaacaaggaggttttaaggttgatagaagaatttaaaacgtttatagcagttgtagaacaccaaaactttactaaagctggggaaagtataaatttatctcaaccaacagtaagtacacatataaaacatttagaaaactactttaacacaatacttataaacagatctattaaacaaaaaacaatatctataactgataatggttatcttttgtacaaaagagccagagaggtaataacatcaatagaatcaattaaagatgagttgggtagtatatctaattctataaaaggtcatataaaaataggtactagccttacaattgcagagtattttcttccagattttttaactttattttcaacaaaataccctgatgtagaaattgaaatggtagttgaaaacactcataagatttgtgaaaaagtaaaaagttcaaatttagatattggattggtagaaggaagtctttcttcttttgactttaatcaaaatttcttctttgaagatagaatggtcctaacattctcacctaaagctaaaatagattctaaaaatttcacattagattctataagaaataaaaagtggatttttagagaagaaggttctggaactagagaatatttaaacatatttttaagtaataacaaaataactccaacacaaataatggtgttaggaagtaatcacactgttaaagaagctataaaaaataatttaggtgtatctattttatctaaattagttacagattcagaaggagatgctttatgtactgtaaatttagatgacacatataatcgatctttctcctttattactccaaaaggaataaagccttcaaatacaacaactttatttataaatgagcttgaaaaatatacaagtttaaataaataaaaataaagtcatagatattcttaaaatatctatgactttatttttacatccctaattctttaaattctctacttcccggcttaactaattcctctttaccttctttacataatggacagttatcagattcataaacttgtatatctaattttatagcactatatataggcattcctatatcatggttagttctatctgctatacaagcaacacctataacttccccacctaaagcctctagtgcttttttagtttctatagtagattttccagtagtaacaacatcctcagctattattattttagctcctggtttaacctcaaatcctcttcttagttgcatttgtccatcttttctttctgtaaatactgattcttttcctaattgtcttcctaattcatatgaaactataacccctcccatagcaggtccaacgactaaatctatatctaaatctttgatttgatcaactactgtacttaaaactttttctgcttgatttggaaatcttagtacctttgcacattgtacatatctattactatgcttccctgaagataataagaaatgtccttctaataaagcatcacattcttttaatatttcaacaacatttacattactcataattttcttctcccttttatccttaaatttgatatttttactttattccataaaaagtcttttatataaatttttattaaataattcctctaatttcatccaaagaatttattccttcttcttccatgtatttctttattccttctataatatcaagtcctattttaggatttacaaagtttgctgttccaacttgaatacatgtagctccagccattataaactctattgcatcttgccaagttgtaattcctcccatacccataacaggaatatttacagctttgcaaacttcatgtaccattctaagagctattggctttattgcaggacctgataatccagcatatgtattttcaaatactggctttttcttatttatatcaatagccatagctttaaatgtatttactaaagatatcccatctgcaccttcttcttcacaaaccttagccattccaattatatcctctgcatttggagataacttaactattaaaggaagtgtagtttttgctcttactgctcttacaacttctcttgcaacctcattttttattccaaatgccattccccccgcttttacatttgggcaagatatatttagctctatcatatctattggttggtcatttaataactctacaccttttatataatcatctaacgttcccccacctaagtttgcaattcgtactgtatcaagctttttaaaaaattgaagttcattttctataaagcctttaactccaggattttcaagtcctacactattcatcatacctgatggagtttcaaaaactctcatacctttatttccatctcttttttcaagcgtaagtcctttactacttatccctccaagtttttctatatcataaatttctgcatactcttttccgaatccaaaagttcctgatgccataattaaagggtttttaaactctatattcccaaatttaacacttaaattagtcattaaatatcacgtcctctccccagaaaactggaccatctttacatgtctttttgtttccaaactttgttttacatgtacatactaagcaagctcctacaccacaagccatatgattttctaatgaaaccattattttagtattagttccctctgtcattttcactagtttttccatcataggtgttggtccacaagctagtatataatcatatttttccacatctaatatatctgtaacaaaagtatctcctagtgctatattaacgtcattacaaacttctttaaattctttttctaatatagattcctttctaaatcctaggtacgcatcacaatttttaatatttttagctactaaatataatggagctactccgattccaccacctactaaagcaatctttccttctactttttcatatccatttccatatggaccatctaacttaatagaatcattaggttttaaattgctgaaaattttagtaccttctccaactactttatataaaaatgatataccttcttcgtctacatcatgtacacttatcggtcttgatagtaaaggatatgtatcccaagctcttaacatgtaaaactgccccattttagctttgaagttcccttttactttcataaaatacatatcttctccaacatatttattttctaaaactttatacattacatatccccctttatgtagtacataatttttccgtctcttattgtcattaatacttttcctaaaattttttgcttatcaaatggattatttttacctttagatataaatttagatgtatctataatatcattacagttactatctactaaaactagatctgcttttaatccttcttcaaccaaaccttgatttaatcctaaaagtttagcaggatttaagctcatcatttcacttaatttatttaaagaaatcccattttcactaaacaccttatttaccatcccaaaagctacctctatattagatatcccaggtgcgccattttccttatcttctttagtatgaggtgcatgatctgttccaatcatatctatatatccatctttaattccttgaataagatatttcatatcttcctcattagcaaaagatggatttaccttataatctagtccatatccatatatatggtgtggccctacttcacaagtaaatttatgtccattatctttatatttttttatttcttttaaagtttcctttaaactgatatggcatatatgaaggttacccgcaacttcctcaagaagttttaaatctctttttactattatttcttctggttgacaatgagttaatactttaaaatctagttcttttgaaagttctaatgcttttttcattatatctttgtcatgaagagtgtatccatcatcagaaaataattgagtgtattttctcatactttctatatctatcatttcctgaccttctagatttttagttattgcacaaacttggtttatataacataagtctaatttttcagctttatctaagatatattccatagtttctttattgtcacaagctggtttagtatttgccataggacataatactgtaaatccaccttttaaagctgccatttgtcctgtttctaaatcttctttatgagttaatcctggatctcttaaatgtgtatgtacatctataaatgaaggcattaatgtataattttctccatttataatttttgcatctattgaatctatatttgtatcaattttagaaatcttaccatcttctacaagtaaatcacttttaaaatctttattagcatcaactattcgtgtattttttattaaaatcttattcatttgcatctacccccaaaagtttcattattaatgccatccttacgtacataccgaatttagcttgatcaaagtaaacagctcttttatctttatcaacttgtgtatctatttcatttactcttggtagtgggtgcataactaacatatcagattttgctttttccatcttttcagtagttagtatatagtaatcttttaatctttcatattcatctttattttcaaatctctcttgttgcactctagtcatataaagtatgtctaattcctctataacttcatctaagttattagtttcaatataatcatgaccttttatagcctcttttatataatcgggcatctttaattcttcaggtgctataaatacaaacttagtatctttatatcttgacatagccttaactaaagagtgtactgttcttccattttttaaatctccacacaatcctatggtgtgattttctaattttcctttaagtgattttattgtaagaatatctgtaagtgtttgagttggatgttgattccctccgtctcctgcatttataaatggtactctagcgaatcttgaagcttccaaagctgaaccggctcttggatgtctcataactattgcatcagcataacaagatactgtttccatggtatcttctaaagtttctccttttgctgtggatgatgagtttggttctgaaaaacctataactcttccccctaatctattcattgcagcttcaaaactaaatcttgttcttgttgatggttcataaaataaagtcgctagtaaatttccttcacaaacttgtgagtattttgacggattatcaattatattttgagataatgatagaatttcatctatttcatttatcgaaaagtcttctggttggattaaatttcttccttttaatttcatcttatatatcctccttttttagcctctctggactaaatttaaaagttttataattttttcttttatagtagcttatcacctttggtaaacgatgtcaatataacttttaattttttatatggtgcttatgtgtataaaaaaaggatatacataatacaaatagctaaggaaaatatgcataactatgcatattttccaagtaactataagttttaagctatatcctttaaatttctattattataatactctcttagctccaacgtaagttttttgccagtaagatgagtttatgttacttactttaacaacatctccttcttgtggtgcatgtatcatgttacctccaccaacgtatataccaacgtggcttattccacctccaccagtagcgaagaatactaaatctcctggttgtaagttagccttgctaacagatcttcctgctccatattgagctgatgaagttcttggtaaagatattcctgctgcatttctaaatacatatgatgtaagtcctgaacagtcaaatctatttggaccttctgctccccatacatatggagaacctaatttagagtaagctaaatttactacagcacttgcagcatttgagttattaactggcttttcttctggtttttcaactggcttttgaaccggcttttgcactggtttttgtacaggcttttctgctggtctctctactggtttttgtacagaatttgaagcttggttatcatttgaaacttgatctttattaacattagtattgttatttacattactattgttattctctttttcatcattatcattattagctgtattattttcagtagtactattattgttagcactatcgttattatcattgttagttgtagtattttcagttgtttgtgtattatctactacttgtccatcattttgattttgagactcatcttgagtttctttttcttctactacaggagccttgtcagatacatataaatctcttatatatccttctttatctccatttttaacttttacccagttatcttgagttcctaatacttcaacttttgtagataatcctaattcatcttgaatatcagattctacatgagcatcttttcttaagtttactttgtctgctgttacatatgcattagcagctttaacatcaacaaatctagatgctatccatccttcagtgttgtcatctaattggattttataccatccatcttgctctccaactattttaaattcatcccctgcatatgctatagtttgaacagaaccttgttgtcttacttttactccaactccatcttttacaacagcaactttgtaatctacatctttgtagttttctaagtctattatatttttttcattaacctttttcttatctgttgctttttcagcttttgtatcatctgcatgagctattccattcatcgataatgccataaatgatgcaaacactggtactaatatttttctcttcataacgtttttccctccaaaaattcaccataagttttcttacgtgttattttcatagatgaaacctatgtaggataaaatactaatacacaagatattttttatttatttatatttcataatttgtaacttttttgtaaataattgttacaaattatgtagtattcttatattaaacaatagttaatttataccttgtatataatattaaaaaattaaaacttatttattttatccaaaaataactttaatatacatttttatctttattatatactatattttccaaaaagtaaatatttttggatattttagcatatattagtacattaatttattctttatgtactttttttatgcccttttttcttatatagcaaaataaagtgtgtattctctttaaatcaattaaaagaatacacactttttatttaaaaacttataaatttatattatattttccaccttaaactaaagaagtagctacttctttagcaggagcctctgtataccatcctcttaacttcatagcatcagctattctctttatagacatcatataagcagcagttctcatttctacattacgttcttctgctaatgcccatatttcttcaaatgcttttatcattaaagctttttgtttttcttgaacttcatcaaaagtccagttatatctcattaagttttgtacccattcaaagtaagaaactgtaactccaccactattagctaatatatcaggtactaatgtaacacctttttcaaataatatatgatctgcttctggagttgttggtccattagcaccttcacatactattttagcttttatatctcctgcattagctgaagttatttggttttctaaagcacaaggcattaatatatcaacttctgtagttattacacttgtgtctacagcttcagctcccgggaatccttttatacatctatgttctttattataagccattaaagctttcatatctattccatctttattatatatagttcctgtatgatcttctacatatataacttttgccccagcttcgtctatgtacataccagcaaagcttccaacgtttccaaatccttgaagacctacagtaacgtttgatacatctattccttttttcttagcagcttccatagccattgtagcaactccgtatccagtagcttcagttctagctaaagatccgtaaaaatcaactggctttccagtaaatacccctggttgaaattcacctgtaacattagcatattcatcaaccatccaagccattatttgtccatttgtattaacatctggagctggtatatcttctttttcccctattattggagctatagctttagcaaatcctctagatattctttctaattctccttgagaaaactctgtagggtcgatggccataccaccttttcctccaccatatggtatacctactactgaacatttaaaagtcatccaagtagataatgcttttacttcatccatgcaaactgctggatggaatcttaatccacctttaaatggtccacatgcattattatgttgtgatctatatcctgtaaatgttcttacagttccatcatccatttttactgggaatgatacttctaatactctcattggattttttaatatttcatatactgctggatcagcccctaacttatcacaagcagttttaacttgagatcttgctatctctagaacatttaaagttttttcagccattttaaaagcccccttaaaatatttataattttatatccccttgtttgttttaattgaaaacattttcccttcgatacattttgattatagcatagttttttttaattttgtatataaattttattagttttttatttaacatattttattttatttatccttacatctattttattaacatttattaaagtcattttatataaacaccttattatatgttgttgtagctcaaaaacattctcaacgccttcaaattcattaaattctaatgcaataaaaacatttaagtttcctttttcattctcaaattttacagtatttattttatgtatatagtgaattttagataattcataaaatattatttgactaatagcatttttacttatataaaattttccaatatagctaaaggtaggccttattattgttttctctacaataatagattctttatctttccttttaaataatttttttataggatttatacttaaaccactagcaataggttttacctctaaagtagaaacagggattatgtgattgcctgcttttcttgattcttttgcagcatttatttcttcttttgtagatatatcctctatataaatagttttatttatcttttctaaccccaatctacttataattttacttaccattttatcagatgttcctataactaaaattttatcaatctcttcttttaacaacttttcttttacattatctctatgttctccattattaaatatagctattttaacagcttgagttttagtacttgcttgttttgctgataatcctgcaattattttgttattgtgtattaatataccatcatctattatgtaatttatattataatcatatgctaattctaaagctttataactttttcctgaaccactttctcctactaatgcataaaccttcatagacttctcctatatccttatatatttaaaggctatagatttaatctatagcctttaatatcatatattatagcaaaactctccatttcctttaatagaaaagaaatctgagtatcctatatcaaatattttgttttctaaatcgttaactactaccttattttttattaaataagtaaatacactacataaggtatatctccttgtattatagcacccttaattacattatcttttattataaacttcttaatataatactatattatatagatttaattcctacttatttataaatttaattttcttttgtatacaatgtctttattgttatattgatttgtttttgctataatactattgaacatattatttatatatattaggaggagatttaaaatggcttacaaaattaatgatgcttgtataagctgtggtgcttgcgaagctgagtgcccagttagctgtatatcagctggagatgacaaatacgttatagatgcagactcttgtgttgagtgtggtgcttgtaacggagtttgtcctgtagatgctccacaacctgagtaataaatagtataaaaaaactacctacattgtaggtagtttttttatactatttattttcgttcataagatatgataaagtaaataaactttcagttaaatttacattttcaacgataacatcatttggaacttctaaatctaatggagcaaaattccaaataccttttataccaactttcacaagtctgtctacaacatcttgtgctccatttttaggtatacataatattgctatatcaatattattttcttctacaaactcttctatactttcagaatcaagtatttcaaaatctctaatttttaatcctatcattcttggatttgcatcaaataaagcttttattttaaacccggcttttgtaaacccagaatagtttgctattgcttgtcctaagttaccagcacctattataatagaattgtatgttctagataaacctaatattttacctatctcattatacaattcttcaacattatatccgtatccttgctgtccaaaaccaccgaagttatttaaatcttgtctaatttgagatgctgtaaatcctattatatcacttaactctttagaagatattctttgtatatctctatctaataaatctccaaggtatctatgatatttaggtaatcttcttattacagccatagaaatatttctattactcatgtcatcacctcctgtatagtcataatccctattttcgtataatctatgctatttttttaacatagtgcatatatccttgattatattataccaaaacattataattttagatagtttaaggaggtataaatttatgattgttttgtcatgtaataacttaaataaaagttttggaatagatactatattagaaaatattagctttacagtaaatgaaggagataaagttggtattataggcgttaacggaacaggtaaaacaactttattcaagattctttcaggaatatatggatatgatagtggagatatatatcttggaaaaggtgtagaaataggctatcttgaacaaaatactaattttcaatcggaaaaaagtatatatgaagaagttttagaagttttttcagatttaatggaaatggaaaactatataagaaatttagaaattagaatttctgaagaaagttcaaatccaaattcaaaagaattagacaagcttatgaatgaatactcgcataagctagagcttttttcagaattaaatggttatggatataagtctgaagttaaaggaattttaaaaggtctaggattttctgataacgatatgcaaactccaataaacatattgtcaggtggagaaaaaactagagtcttactttcaaaattattgcttaaaaacccttcacttttattattagacgaacctactaaccacctagattcagatgccatagaatggcttgaagttttcttaaaacaatacaaaggaacagttattatcatttcacacgatagatatttcttagatcaagttgttaatagagtatttgaaattcataataaaaaacttagaacatataatggaaactactctaaatttatagagttatctaaagttgagaaagaattagaagttaaaaaatatgaagatcaacaaaaagaaattaaaaaacaagaagaatcaatagaaagattaaaagcttacggtagagaaaaacatttaaaaagagctagaagtaaagaaaaaatgcttgataaagttgaggttttagatagacctgatgttcatagaaaaagagcaagtataaaatttagtccttctgtttctagcggtaatgatgttttagaagttaaagatatttctatgggttatggagaaagaattctttttaaggatataaactttaatatatatagaggtgaaaaagttgcactaattggagctaacggtattggtaaatctaccttattcaaaattattatgaacgaaatagtacctctatcaggtagtactaaacttggtacaaatgtacatgtcgattatttccaccaagagcaaaaaactcttaatttagataatactataatagatgaaatctgggatgatcatccagaattaaatcaaacaaatcttagaaatatgctaggttctttcttatttgaagatgaagaagtatttaagaaaatctctactttaagtggtggagaaagagcaagagttgcaatattaaaacttatattatccaatgctaacttcttgttactagacgaacctacaaatcaccttgatatagattctaaagaagtgttagaagaagcacttttaaattatacaggtactttatttacaatatctcatgatagatattttttaaatactgtagttgataaaattttagttctagactctgaaggtattactgaatacttaggaaactacgactactatatggaaaagaaaaaacaaactctagaaatgaatactgtagaagttgttgaagagaaaactaaaactcaattaaaagatgaaaaaagaaaagaaagagaacaaagagagatagaaaaaaaagctagaatcaagagacaaaatatagaaaaagaaattgaagaaattgaaggtaagattgaagaactagatttacttatgtgccaagaagaagtttattctaatcctgaaaaatctaaggaagtaagtcaaaataaatctaatcttgaagaaaaattaaataatctttacgaagaatgggaacagctaatgtaagctgttctttttatttcgataattctgatttttccataataaattagttgctatatatgtgttgtttatattaccatagtatagacattaaaatttagggggtgcttatttgaataatattttaaatttaaacgatgaaaataagagattttataaactattaatttcactttgtatacctataatcatacaaaatcttatctcaacttcagtaaatgttatagataccgttatgatcagtagtttaggagaaacttcagttgcttccataggagttgctaatcagtttttctttttatttaatatgaccttatctggtttaacaggtggagcaggtttatttatatctcaattttatggaaagaatgatattaataacataaaaaaagtaacaggattaaatgttttacttggcataatacttggactgatatttcttatacctgcacttttctttccgaagttaataatacactttttctcttatgatcctaatgtaataaaactttgtattgattactttagcataatagcattttgttatcctttaattgcagttagtactgtttttagtatgggatctagaagtgtaagaaatcctaaattaggaatgatttgtagtgcagtagctcttataagtaatataatcttaaattatggattaatatttggtaatttaggtcttcctgcattaggagttaaaggtgcagccttagcaactgttatagctagattaattgaattttcacttttaattgcctatgtttatgtagttaaaaagaattatgttttaagatttaatttaagcaatttaaaatctatagataaatcatttataaatgcattttttgctaaaagtacaccaatcttattaaatgattctggttgggctataggaactgtgttatattctgtagcatattctaaagcaggtacttctgcgattgctgcaagtcaaatagcaacaagtacaggtaacttctttataataactgctgtttgtgtagctataggagcatctattatgctaggaaatgaacttggagcagataataaagaagtcgctattgattatgctaaaaagttttctaagattgtatttgttgtaggaactctatttggtatacttcttatatttaatattcctatgctacttaagatgtttagcgtctctgatagtctagcacctgatatcattaagatatttgttattatgggattattaatgggacttaaatcttttaatacacttttagttataggtatattaagaagtggtggagatactaaatactctttattcttagaattaggatgtatgtggttagtctcacttcctcttacttttatattcgctattaaaggagcgccaatttacgtacttgttcttattacttattctgaagaaatagtaaaattcatatttggtgttcctagggcattatctaaaaagtgggttgctaacattgttaaagaaattaattaaaaagcgatgccttttatggcatcgcttttaatctatttttattaaattataagatttcggttctaaaatagttattaattttttatctattaattcattactttctatttcaattttttccctaatatctgatctatttattaatattaatactttattatttttaatatatctaatatacccaaatatattttgatttgataattttaaaaatttagtttctccatttaataataatttattattctttctttccttaactatctttttataaaagtttaatatatccttatcttcattttcccaaggatatgttcttcgattgtcaggatctttttctcctattaagcccgcttcatccccataataaatatatggtaccccttcaaaggtcatctgaataaagactgctaatttaagaagatttttatcttcatttaattctgtaagaattcttcttgtatcatgtgttcctaataaattcagattcgatttaaatacctctttaggataattttcctttattgtcataaaactgttatatacatcctgtgattttatatttccctttaaaaattctactactatatttttaaatacatatccagttactccatttaattgatctcctaaaaagtatttacgcctttcatcatagctaattttattagatgcatcttcccatacctctcctataataatagaatcatcatctatatttagagtttctttttttaaagcttctataaatgtagatggaagttcgtctgctacatcaagtctccatcctttgactccatagttcatccacttctttattacactatctttatcccttataatataatccatataagacttttcagtttcatttacattaggtagtgatttaactccccaccaacaatcgtattcatttggatagtccttaaagttataccatgaatagtatttagaatcttctgattgatacgcacctaaagaatcataatttccatatttattaaaataaatgctatcatctccagtatgactaaatactccatctaaaataatatttatcccttttttacccgccttatatattaattccttaaatatttcttcatcaccaaacatagggtcaatagttttataatctcctgtatcatatttatgattactttgagatttaaatataggacttaaatatattacacttattcctaaactttttagatagtttaatttactgattataccttttaaattaccaccatgaaaatcccatcttatgacttcattttctttattttttatatacataggtgtatcttcccagtttgcatatataaaactattttttttaggattatttattttaccagttttattaaacctgtcaacaaatatatgatatagtatgccttccttaaaccacgttggagtttctgtttttttgctaactgtaatttgatatttatttatattatttatgtcatgatattctacgcattctccacagtcataactttttccatagtattttacctgtaaattttctccttctatggatttaaaataataaaaataaatattttctttttcaaatttatatttatctatagtaaaaataccatttaatttattttccattttgatttctttttttgtctcttcatttgtttctaagataaggtacatttctttgacatcagaaattacttctacatttatatttatgtcttctcctatctctaatgcgccaaatggctttttatgacattccatccaagaatcgtatattatactcatttattcccccttatttttatcacttataaaaatatttatcttttgtaccatatttcatttgcatattcttttatagttctatcacttgaaaaaatacctgagttagcaatatttattaatgccatcttattccagtgacttttatctatatacaaatcattaatctttttctgtgcttgtatataattttcaaaatctcttagtacaaaaaattcatcattatatgttattagagagttgtatatctctctgccctcttctacgatatttggtataaatccattaactaagtcatctaccactctttttatataaaaattatttgaatataaatcagcagaagaataacctccaaatttactatattctaaaacttgatttgcctttaacccaaataaaaccatattttcatcacctatttggtcatgaatttctatatttgctccatctagcgttgctattgttatagctccattcatcataaacttcatattacttgttccagatgcttcttttgtagttgtagatatttgctcacttacatttgtagcaggtattattttctctgccaaagaaactccatagttttctaaaaaaactactctcaacttatcttttactcttacatcattatttattttttgagctaattcatttattagttttataacgcattttgcaaaataatatccaggtgcagctttggctccaaatataaaagttcttgattccatatttaaattcggattatctaataattcatgatacatatgaagtatgtgaagtgcattcatgagttgtcttttgtatgcgtgtaatctttttatttgcacatcaaaaattgagttttcatttatatttatttcgtttttttgagttatgattttagataagtttcttttattttcttgtttgattaattctagttcttgtaaaaccctactatcattttgatatttttctaaatttttaagttctaacgtatctttttgccaactttcccctatcaactcatttataagtttagataacctaggattggatagcattaaccatcttctatgtgctatcccattagtcttattgttaaatttaaaaggttcatcttcataaaagtttttaagtacttctttttttaagatctctgtatgaagttttgctactccatttacactatggcttcctataatgcttaagttagccatatttacattatctgcagaaatcactgccattgttcctatcttgtcaaaatcattgccatatttattatttaattttcgaatatatcttttatttatttcttcaattatcatataaattctaggcaataactctttaatcatatgaatattccatctttccatagcctctgccattatagtgtggtttgtataagatataactcttttagttatctcccaagcttcatcccattcaagttcttcttcatccattagtaacctcattagctcaggtacacatagagatggatgtgtgtcatttatatgaatcgaaattttctcatatattttacctatatccccattattctttttatactttctaaatatatcttgtattcctgcacttactaaaaaatattcttgctttaaccttaaaattttacctgcatcattagaatcattaggatataacacttgagaaatttcatcagcataatatctatactgtagtgcatcatgataacttccataactatttttagattcttttaatataggctcaaaatcttttcgaggtacatctgatttgaacaacctaagagtatttatatattcatttttatatccaattataggaatatcatatggaacagccataactggaatatagttcttatgaatagcctttaatttaccgtttttttcaactaaatcaacctgacctccaaattttacaatgcttgctttgttaggccttacagtttcccatatatatgattcttcttttaaccaattatctgggacttctacttgatgtccatttacaagtttttgttcaaataaaccgtattcgtatcttattccataaccatggccactaatacttaatgatgccattgaatctaaaaaacatgcagctagtcttcctaatccaccatttcctaacgcaggatctacttctgcattaactaagtcttctaagtttatgtccatttcttttaaaattaactttatatcttctaaaatacctaaatttaaaagattagactctaattgacgtcctaataaaaactctatacaaaaataataaacttctttttccttatctaatctgctttctttccatatatcacctatcttacattttaatactgtaactaatgtatttaacaattgttcactattagcttcttctatagtttgtttatataaaaaatccatttgatttctaaattctaatttgaactcttctttatttataagggtcaatattaccaactcctttgttcaactatttcttgataggcccttaaatattccttagctgactttttccaactattatcagtattcattgcacttcttactatattattccatgtagttctatcttctttgtaaatatctatcgctgatttaatacaataatacatctcgtgtgcattgtagttggcaaaactaaatccattaccttctccagtatatttattatatggaataacagtatccttaagtcctccagtttctctaactaaaggaattgatccatatctcatagctatcatttgtcctattccacagggttcaaataatgacggcattaaaaacatatctgatgatgcataaatttgttgagctaatgctgaatcaaaagttaatatagttgccaccttattaggatacttccctgaatagtaatttagcatagattgatattgttcttctccagtaccaagtacaactagttgtaagtcttcttcaactatttcaggcatcatatatgaaagtaagtctaatcctttttgagacactaatctagacacaatccctatcattggtatattttcattaatttctaatcctagtattttttgcaattctaatttatttttaattttattatctattgattcaatattaaaattacaaactatatttttatcgacttccggattattaatttcataatctattccattaacaattccttttaatttatatccattctcttttatcaatccatctagtccttctccatagtattttgtttgtatctcgttagcatatgttggactaacagtacttactttatctgaatatactatgccagccttcataaaattgattccaccataatattctatattcccttcatataaatgcaatctaggaatagctagtgtatcttctatgtgtttattagaaaatacaccttgatatcgtaagttatgtatagtatacatagtttttatatttgaatatctttcatcatctttgtaatgctcttttaaaaataaaggtatcattcctgtatgccaatcatttaaattcattatatcgggataaaaatctatcctttttaaagattctaaaactgcattactgaaaaatgtaaatctctctacatcatcatcatatccatataaataggcatactcaccctctcttttaaagtaaaactcattatctataaaataaaacttaactccgtctaattctaattctaataatccacaatattgatttctccatgccacatttacattaaacacggcaacttttttcattttatcttttaaatatttaggaatattagcatatttgggcattataacccttatatcaacaccttccttttttaatgcttttggaagtgcatatgatacatctcctaacccccctgttttagcaaacggccaacattcagctgtaacaaaaagaaccttcaaaatttatccccctttatatacttacgtttttttctactaccaaaggaaactttatatctccttttaattctttttcacttgatatatttacatttttatcaagaattacattatctaattttgcattttcttctattgtactattttgcataattatagaatttctaataaccgaaccttcttttatatgaaccttcctaaatataatactatcttttacatctccttcaataatacatcctgtagctataaatgagttatttacatttgaagtttctgtatataaagttggttgagtatttttttctttagtataaatttttctatctgagtaaaacaattcatttgctatatctatattaagtaaatccttgttagtttgaaaataagttttaatagaatttatacatcttaagtaacccttatactcatatcctcctacatttaatatatctacactttcatttatacaatcttctaaatttgcatatccaccttttgaaactgctccatatattatttctataaataattttgttttcattatatacatttccatagatatatttcctgtggattgtcttccaatattagttcccatacttaaaacttttttatttctatcaatatttaaaattgttgttcctaaaaactcttcatctatattagattcatttttaaatactatagttatatcattgtccgatgatttatggtatttaagagcttttttatagtcaatattacaaatcatataacttggagaaattaaaacatattcttgcttacttttctcaatataatctatatttgaaaatatattttgaagatcacctttttttaaagtatgatgcatttgctttgttgtattttcaggactaaatacaaataatccatcatttttcaaagataagtcccaatggcttccattccctaaatgatctgttaacgatctatatttttgatctgagaatatacctatatttttcatccccgcatttaccatatttgataatgtaaaatctattatcctatacctgccaccaataggtattgatgctactattcttgaatcacttagctctcttaagttatcaccttttttatttaaattgattatccccatacattctttattcataaaatataatcccccctatactaattccatagctactacatcaaactcagacactacacttatacttccatcatttttgtgtatatagcaattgtcttctattatagcaccctctcctatcatagctttttctataactacgttcttacctattttggcatttgacattataacggaatcttttattatacttccttcccctactgttactccatgagataaaactgtattctcaacacttccaaagaccctgcatccatctactaaaattgaattttttatatttgcttcttctcctatatattgtggtggcatagccatcgtatccgtgtatattttccaattagaatcatttaaattaaatccattttctgtatttattaaatccatattagcttgccataagctttctatcgttcctacatctctccaatatccatcaaacttataagcaatcatatttaaattatcttctaacatcttcggaattaaatttttaccaaaatctaaatacacatcttcagattcgaaatatctttttatgtttttccaattaaatatatatattcccatagatgctaagttactttttggtttcttaggtttttcttcaaattcatatatagaactattttcatcagtattcattattccaaatctatttgcctcactccaatcaacttccataacagcaattgttacatctgcatttttagatttatgaaactctaacatatcactataatccatcttatatatatgatctcctgataatataagtacatattcagggtcataactatctatatagttcatattttgataaatagcatctgcggttcctttataccaattaccttctttttcattcatatatggttgtaatattgatagtcctccatttcttctgttcaaatcccaattacttcctatacctatatgagaatttaataatagaggcctatattgagtcaaaacgccaacagtatctattcctgaattggaacagttgcttaaagcaaaatctattattctatactttcctccaaacgatactgctggttttgctatattttttgtaaatacccctaatctcgaaccttgcccccctgctaaaatcatcgctatcatttcttttttcatcatttattactactcccccataatctaaaaataatattttaatcatttaaatttataccctttatgaaaatcgctcctaatggtggaacttttatatttatagagtattgcttattgtgccaatttatatcttctgattctaaaattttatcttgcatagtctgaccagatccataatactttttatcatcactattaaaaacctctatatatgatcctctatatggaacccctatacgatattcgttatatactactggtgtaaaatttaaaactgtaattataaaatcatcttttttctttccttttctcattattacaattacactttgatttatattgtgtggatctataaaatcaaaacctgaatggtgattatctatctcatacatagatttttcttctttataaagatgatttaaatcttttacataatttttcatcttaaaattttgttcattggctaataaggtccactctaatccatactcaaatctccattccaaatcttgtgcgaactcactacccataaataaaagtttcttacctggatgaatcatcatatatgcatacaacaatcttaaattagcaaatttctgccattcatctcctggcattttatttagtagagattttttaccatgaactacttcatcatgtgataatggtattatgaagttttcagaaaatgcataaataaatgaaaaagttataagttcatgatgatatttacggtaaattggatccatttccatatattttaaagtatcattcatccatcccatattccatttattatcaaaagccaatccacctttataagctggccctgtaaccattggccatgaagtagattcttcagctattataataggatttttaatttccttatgtataatttcattaaacattcttaaaaattctattgcttctatattttctcttcctccatatttattaggtttccaatgccctatatcataatctaagtaaagcatactcgatacagcatccatcctaatcccatcaacatgaaatttttccatccaaaaaattgcatttgatattaaaaaactttgtacctctggttttcctaaatcaaaatgtgcagtaccccaacctaagttttccgcctttgtttcatcttcatattcaaattgatttgttccatcaaacttatataatccatgatcatctttacaaaaatggctatatgcaaaatcaaatataactcctatatttttttgatgacatttatcaacaaatctcatcagttgctgtggatctccgtacctactagtagcactatagtagcctatagtttgatatccccaagacatatctaatggatgttctgtaattggaagtaattctatatgggtatatcccatatattctacataatctattaactcatctaattcttcataagtaaaaaattctccatcccactttcttttccacgaacctaagtgaacttcatatatattcatcggcttatcaatgtatgagtacttttcttttttctctatccaaatatcatcattccatgtatagctttttaaatcatatacaatagatgctgtgtttggccttttttccgaaaaaaatgcatatggatcagattttaacttactttttccacttttactttctatgtaaaatttatagttttctccatattccatatttggtataaatatattccatattccactatcttcaattttgttcataacgtttaagctctcatcccaattattgaatgcacctactaagctaacttttttagcattaggtgcccaaaccgaaaacacaatcccttttataccttccttttctactttgtgcgctcccatgaaactataacttctaaaacattttccctctttaaataaatttatattgtagctatttataacatcttcatattttctcaatataaaatcccccataataatctatatctttagtaatatcttatcgaactttttaaacatatatttttaattatatattaattcatactttaatatttaaagtattcatctaaaaatttagacttaaatttagttatttctttaatcaaagatacatccttacactaaactacagaatcttgatttttctgtctataaaatataattcaaacataaaaaaagttagaagatttaaatcttctaactcatttttattgcccaatttttaaatttggaactgcatttaagctcatatcatctcttcttccattaataaaactataatatcctgcacatccaatcatggctgcattatctgtacataaaacaggagatggatacttaacttttatattttctttttctcccataattgttagtttttctctaagagctgagtttgatgcaacccctccagctaaggcaatagtatcataccctttttcttttgctgcctttatagctttcttagataaaacctctactacagcctcttggaaagatgctgctacatcttctactactatttcttcttttttcatttttttagcatttaaataatttaaaacggctgattttaaaccactaaaactaaaatcatatccttcatccatacatgctctaggaaaatctattgcctttttgttaccacttttagccaatctatcaattattggcccacctggatatcctaatcccatagctcttgctattttatcaaaagcttctccagatgcatcatccttagtttttcctaaaatttcatatttaccataatctttaacctctactaagtgagtatgtcctcctgaaactattaatgttataaatggaggttttaaatttttatcttgtatataattagcacttacatgcccttctatatgatttacacctactaatggtatatctaaagtatatgataatgctttagcataagataatcccactaaaactgcccctactaatccaggtccatatgttactgctatatggtcaatatcatcaaatgttacttttgcttcatcaagagcttgttgaacaaccataggtatattttctatatgttttctagatgcaacctctggtacaactccaccaaattttttatgtaattcaatttgagttgatattatattacttaaaacttctcttccatttttaagaattgcacaagctgtttcatcacagctagattctatagctaatgttattatatctttcatcactacacctcttttaattggctccacattatcattgcatcttctttgttgtcactgtaatattcttttcttattccagctaatttaaatccatattttttatataaattttgagctactaaattagaaactcttacctctaaagtcatagcaaatatgtgattttctttacacttttcaacaagatgctttataagtttatcgcctatcttttgtcctctataatcactatgtactgcaacgtttgttatatgtccttcaccagctatgaaccatattcctacatagccaacaatctttttatctatttgcgctactaaatatctagcaacatcatttttcatttctttttcaaattcagacttagaccagtaatgttcaaagcaatttttttctacttgaaaaacgccttctacatcatctatattcatgtctcttattattaaattgctatttgtcattttctaacctcttcattttttcttcatattgaacttctgcttgagattttcttatatacattggatttacagtatagcaattatatacatccatatctttatggtatttcatagctcctattgcacataaactacttgctttgctaacattattagatgctgacgctacgtaaatattttcaactggttcaagcttttctttatataaaatcgtagcttccccaactaaaataaaatcttcatctttattagataattcttctattaatgattctatttcaataacttttatatcttctattgttttaaattctccattttcaaacttatactttcctgtataaacttgatttctttgagcatctaaaatagggcatattattttatcacataaattcatattaaatgctagagattctaaagaattgacagctattattggtaagtttctaacttgagctattgcttttgctgtagccatagaaattctaagtccagtaaatgaacccggtcctatacatattgctattgaatctatgtcttttatatttaaatcactttcttttatcattgattcaatcattaccataagtttttgagaatgtgtttttttagtatttactgtatattcacaaattaatttttcatcttctataacacacacactagttgaatgtgtagaagtatctattcctaatattttcattacttagtcaactccttaactatttcttcatacttttctccttttggagttaatatcatttctcttcctgtttctttatagttcatttctatatataagtattcatttggaagtatatcctctattaagtttgcccattctattatacaaactccttctccatctatatactcatcaaagcctatatcatacatttcgtcactgcttccaattctatatacatcaaaatgatataaaggcattcttccttcatattcatttactatattaaaagtaggacttgttatataatcatctacttctaaagcttttgctaaactttgagtcatagtcgttttacctgcacctaaatctccaattaaacaaactacacttttaggtgttaaaagttgacctaatttataacctatttctttagtttgttcttcattttctaaatatattttaaccatctatatcatctccataaataagacttttttattattttttaatgtaacagatattattatattataaccaattactattataaaggttttaaattgacaaagtttttttatataacacttatttgtaaatttatggtaatatattctatgacaaggggggattaacttgaattataaagttcttacgtatgaagattacgatgatatattggatatatcaaaaaatatttgggaaggaaaagattatatacctaaaatatttcataaatgggtagatgcaaaagagggctgttttttaggtttagaaaaagataataagattgtagcatttggaaagtatacagtattaccagatagacaagggtggattgaaggacttagagttcatatagaatatagagggcaacaacttgctcatgctattattgacacgctatttaatatagctagagaagatttaagaaatggtaaaacaactaatataggaatatgtactcaaaaagatactaaagctagtataaaaatgttcaaagctaaaaactttaaatttattcaaggttgtcttgtatgttttaaaagttatgagagtattaaaggcttagacatcaaaattgatgactttaatatagaaagttggaatatttcatatgaagatttcaaaaatcttgattacttcaaaaattttaataataagttagcttctggttttacttatttaaatatatgcgaagatgtatataatgatttagtaaaaaataattctttggtaatagttaatggacataagtgtatagttacaatgaaagcatgcccttctataatttgtatagataatacatttgaaggtataaacgatgctactaactactacttattaaaatcaaaagccagagaagctgaaatttatgtttctaatccatataatgatctagtagataaacttaagaataatcattatagatctatgtctgattttgataaagactgtgtttattatacttataaagaataaaccttaaaataaaaagactatattaaaataaattagtatgctagttagcaatttacttttatatctagcatactaacttattattttaatatagtctattttttaagtataacttccatcttcttgtataatggtagtgttattaatgatattaatactgctttaactaaattaaaaggagctatcatccaaataacaaaacttcctaaatctgtaatccttggatttattatattccccatgcttattatagcttccattggcattactttagcataaaaaggcaataacatataataattagttaggcatcccactataatcatagctatagtccctaatataaatcctattaataaacctttaatatcttttttatgtctataaattaaagatactattactacatatgatccaccaattaataaattagctatttctcctatccaagcagtagtagaagccgtcatagcttgaaataaattttttataaatactattataaatcctgcaattggtcctaaagacatacctccaaatatagcagggacatctgagatgtctatttttaagaagtctgggaatattcctggtataggtagtgatataaacatcagtatataagatatagctgacagtatcgccacctttgtcatagtatttgttgacattaatctttgttttttaattgtttgttgcatatataaaacctcctaatttatatattaggaaaaataaaagctcgaagaatctcttcgagcttagtttttgagtataacaaaaataaaattcatttatttttaaattttatacatttatactaatcctctctcatccagactttactgtcggccttggaatttcaccaagtcatgctacaaatgtagctcgcgggctataccgccggtagggaatctcaccctgccccgaagattttcgtgctatttaattttccttatacttatatattataaactttatatatttatgtcaataaattaatcttctaattttaattatttgctataaacaacttttccatcaattatagtatataatacgttactttgaatttctaatggatcattatcccatataactatgtctgcatctttccctatttccaaagaccctactctatcttctatacctaataacttagctgcatttatagttatagcttctatagctttttcatacatcatgccatgtttaactgctattcctgcacatataggtaaatagtgaagtggtacaacaggatggtctgttgttaacgatacattcatacctgcattagataaaattccagctgtatcaaaagttaaatttctaagttctattttagatctctctgaaagagaaggcccaactacaacgggatatccttcttctaataaatcttcaactattaaatgaccttctgtacagtggtctaaagttaatcttaaattaaactctttagctattcttatagctgtgaacatatcatcagctctatgtgcatgaactttaaatggaatttctcttctaagtacaggtagtaaactttccatttttatatcataatctggcttttcattttcatcgtcttcttcatgcataagaattgcatctaagtattgttcagcttcttttaatgtctctcttaacattgctgctattgccattctagtttgtggtgctttttcttcttgtccatagcaacttttgggattctctccaaaagctatttttgaagctactggattttttataaccattttatcaattcttctaccaacagtttttatggctatacactgtcctcccataacatttgcactacccggagtactacatacagatgttattcctccatttctagcttcttcaaaacttctttccatgggatttattccatctataggatttaaatgtggagttattggatctgtttcttcatttccatcggctccttcaaatcccattccatcttcccacaaccctagatgtgtatgagcatctataaatcctggatatacttgattgccattagcatctattacttgtgcatcttgcggatgtgatatattagttcctatttctattatcttaccattttctataagtatatcaccatgaattattccattagtgacagtatttataactccattttttataaaaagcatttactcctcctatatctccttaacatctctcatagttaaagaaactctttgtgtttttaaatctactcctattacttttacatctattacatccccaactgtaactattgtcataggatcttttacaaatttattgctcatttgagatttatgaactagtccatcattttttattcctatatcaacaaaagctccaaagtctactacatttctaacagttccttttaaaaccatgccttcttttatatcttcaattttcaatacgtcagttctaagaactggtttcataccttcttctctagggtctcttcctggttttttaatttcagatataatatcttttaaagttactactcctacttctagttcttcacttaatttgtctatacctatagcttcaatttttgaatctatatcacttatacttttatcttttacatcatttaatgaatatcctattctttctaaaagttttttacatacatcgtaactttctggatgcacagatgtattatctaaaggatttttagaatctgttattctcataaacccagcacattgcgtaaatgcttgaggccctaatctttttactttttttatctgggcccttgatgtaaaattcccattttcttctctataaactattatatttttagctatagttttacttatccctgctatatgctcaagtaatgaatatgatgctgtatttaaatcaactccaacagagtttactgagtcttcaacaactccatctaaaacttcttctaatctctttttattaagatcatgctgatattgaccaacgcctatactctttggatctatttttactaattcagctagtggatcttgtaaccttcttgctattgaaattgcacctcttatagatacatttatatctggatgttcttcattagcaagttctgatgctgaataaactgatgctcctgcttcacttactattgtatattgaacttctttctttatttcttttaacatttcagatacaaattgttccgattctcttgatgcagttccattacctatagaaattatatctatatcatgcttttctataagttgttttaaagttttctttgctccttcaacgtcattttgaggtttagtaggatatactgttgtataatctaaaagcttaccatttttatcaactactgcaattttacatcctgttctatatgctgggtcaaaccccattacaactttatcttttactggtggctgaagtagtaaactttttacattttgaccaaatacacttatagccctctcatgagctatatctgttaaatgatttcttacttctctttctatagaagggaatataagtcttttatatgcatcttctatagctaactttatttcatcttcattagttttattatttttattaatataattatctattatattatttattactttatcattgtttatctctaatttaacttttaagaattcttctttttcacctctgtttattgcaagtactctatgtggagctatggtctttacagcttcactataatcataatacatatcataaacagatttttcatcttttgtatttttagtaataatagttccttctcttaaagataaatctcttatatattttcttaattttgcatcttctgatactatttcagcaattatatctttagctccttttaatgcatctagttctgaattaacttctttttcaaaatttatatattttttagcttctttttctaaatctatattttcatttaatatagacattgctaatggttctaatcctttttcttttgctataattgctcttgttcttttcttttgtttaaaaggtgcataaatatcttctacttcttgaagtgttttagcttgctctatatttttaactatttcttcagttaactttccttgttcttctataatcctttttacatcatctttcctaccttgtaaatttcttagataaactaatttatcataaaatgctctaagagttacatcactcatctctcccgtcatttcttttctgtatctagctatgaatgggatagtgttaccttcatctataagttttatagtattttctatttgtgaatctcttaagttaaattctgattttaatattttatttatatccaatttaattcctcctaaaataaggcttaagaattaacttcttaagccttatgttttatgaattattttactttagccatttttaaatattcatttatgaataaatctatatttccatccataacactatcaacatttccaatttcagcgttagttctatggtctttaactagcttatatggttggaatacataagatcttatctgacttccccaagttatttgtgaatatttaccttgtaaatcttctattgtttctttttgctctaactctttaagttctataagttttgccattaacattctcatagctgtatctttattgctatgttgtgatctttggttttggcactgaacaactacacctgttggtatatgtgttattcttactgctgagtcagtagtgtttatatgttgacctccagctccagatgctctatatgtatctatttttaaatctgaaggatttatatctatagttatactatcgtccaattctggtattacatctactgatgcaaaagatgtatgtctttttcctgatggatcaaaaggtgatattcttacaattctatgtacacctttttcactttttaagtatccataagcatttagaccttctatttgtatagtagcactttttattccagcttctggatcataaattaaatctaatgttttaactttaaatcctttagaacttgcccatctatcatacattcttaaaagcatatttgcccaatcctgagcatctagtcctccagtacctgcatttatagatagtatagcattatttttgtcgtattctccacttaataatgttttaatttttactttatctatttcttcttcaagtgaatttatagaagtattgacttctttttctaaagatgaatcattttcttctaaagctaactctataagaacttctatatcatctagagaagactgtagataattaaactcatctacagtactctttaaatttttgttttcttgtaaagtcttttgcgctttatcattatcattccagaaatcttgttcactcattattttttcattttcaattattttttctcttaagccatctatgtcaaagagaagccctcaattcttgtatatttttagacatatcttctattttatgtctatactcttgtatattaagcatttttacctccagattatcttccacaacattttttatattttttaccacttccgcaaggacactcgtcatttcttcctatttcttcacctttttttacaggcttatttccttgtccttcatcagcgtttgaagacatcttatctacatctactacttgttttctttctataggtgcttccactgtaaagttatataaatatcttacagtatcttcctttatagcttttgtcatattgtcaaacatatcaaatccttctaatttgtatgctacaacagggtcttgttgacctattgctctaagacctataccttgacgtaattgatccatagcatctatatgatctatccaataagaatcaactgcttgaagaagtattactctttctatttctctcattttttcaggtgaaaccatatcttctttttctttataaattttattagctatttcatatacagcatttataagatcttcttttttcatattttcaaggttttcaacttctaaacttccttttggcataaacatatgatatagatgttctttatatgcatgaagatctaacccttgatctgtaacatatatatcgtatgattcttctattattgatagaatcattgcttgaatttgttcttgtaagttttcaccttctaatacacggcctctttgctcatatattatttctctttgcttattcataacatcatcatattgaagtacatgctttcttataccaaagtttctaccttcaactttcttttgagcattttctatagatttagttaacattttagcttctattggtgtatcatcatctaatcctatcttttcaaccattccagatattctttcacttccgaataatctcataagctcatcttctaaacttatatagaatcttgaactacctggatctccttgacgtcctgcacgaccacgtaactgattatcaattcttcttgattcgtgtctttctgtacctattatagctaatccaccagcttctctaactttattttgttcttgttctgtttgctctttatattttttaagtattttatcataatcagatttagcttttactatatcttctgttaattctattcctaaactttctatatctgcatcaactgtatttattaattcctcagagtatcccattttcttcatttcttttttagttaagaatactgggttacctcctaaaacaatgtcagtaccacgacctgccatattagttgctatagttacagctcctaatctaccggcttgcgctactatctctgcctctttatggtggtttttagcatttaacacttcatgttttacgccttttctttttagaagcatagataatacttcagatttttcaatcgatactgtaccaacaagaacgggttgattatttttatgtctttctattatatcttctacaactgcattaaacttacctaactcacttttataaactgaatcagataaatcttctcttaatattggcttgttagttggtatttgaacaacatccattttatatatagctttaaattcttcttcttctgttttagctgtacctgtcattcctgatagcttattatacattctaaaatagttttggaatgttatagtagctaaagttttagactctctttgaattcttaatccttcttttgcttctatagcttggtgtaatccttctgagtatcttctaccaaacataagtcttcctgtaaattcatcaactataactatttctccatctctaacaacatagtctacatctaacttcattattttatgagcttttaatgcttgatttatatgatggaataattctatatgagctatatctgttatgttatcaactccaaaataaacctctgctttttgtataccactttctgttaaagatacagacttttgtttttcatctatctcaaagttatcatcttttaaagtatgtataaatgtatttgcatctgaatatagatgagtcgatttatctccaggtccagatattataagaggagttctagcctcatctactaatatagaatcgacctcatccactattgcataatttaattctctttgtactttttgttctttgtgtattaccatgttatcctttaggtaatcaaatccatattcattatttgtaccataagttatatcacactcatattgagcttttctttcttgtgggttttgtccatgaactataacacctactgtcattcctaagaattcataaattttacccatctgctctttatcacgttttgctaagtaatcatttactgtaactacgtgtacacctttaccagttaaggcatttaaataaactggagctgttgcaactaaagttttaccttctccagtcttcatttcagctattcttccttggtgtaatactattccacctataagctgaactctatattgtctcattccaagaaccctttttgaagcttccctagcaactgcaaatgcttcggttaatatgtcatctactgtttctccatttttaagtctttctttaaatacgttagtcatattctttaattcactatctgacattgcttgaaacttaggttctaatgcatctatctcatctactgttttattgaacttcttcatttcttttttatctgctatattaaataagttatctaataaacccatatactattctctcctcgttcattatatgtataatatacattttaccataaaactattatattttatatttaaaaagctatcgatgttcatttttatcgatagctttaataatcaaatttaattctactcttgctctattattccatagccgccattttttctcttatatactattgatatatcatcagtttgtgcatttgtaaacatatagaaatcatgccctagtaaatccatttgtaatacagcttcttccggactcatcggtttaatactaaatttcttacgtctatctattgaaatatctatagagttttcattttcattttgtagatcttcttccgttaaatcctctatatgactaaatcttatactttcatttgactgatgtctatcttgtactctttttttatattttcttaattgtgtattaagcttatcatatacaacatccatagctgcatataaactttcttctgtatcttctgctcttattataggtccacttataggtattacagttacctctactttttgtcttgcttttttagcacttacagtaacttttacttctgtttctgggtgaaggtagtaatctaatctttctaatttttcttctactgcatcttttatagcatctgttaattccatttgtttcccagatattgttattctcataagaacatctcccttcagaatataccagtataaaaactatacttatcgtatatatttctatgcttaaattcaatttcctttatttttattgttggcttcttacaattataatattcaatttaattaaatttattttttgtcgaattgttttatattattaaccttatgtggatttatttttttaacttcctgtggataatgtgaataacattgttaataagtaatagattatttgattttacacacttttttcaaaaattatatccacagaactaatgtttatttgttattaatttgtttattattgtcatattgtcgaataaatttaacgaaatttgttttttagataaaaaaaaaagcacctataaaggtgctttcgtaatattttagctgacctggtctttgcccccacactcgcctgctggagatttcgcttgggttcgccgcactactgactctctcgactttaatgtcggcaggtcttacttctaagctgcaccatgatcattaatcccatttttagaattaacttacgtgggtcctttcgcctgcaactggcatgaactttcaaccacagacctaacatattactaatttattttaatatcttaagaagtatatgtcaataagaatttatttttgttaataatgtgcatacatatatattatttacttctttgcattgtagtattttagatatttcatttacagtacttcctgtagtaaaaatatcatctactaataatatatttttattcttacaaattcctattttatcatttacagtaaatgcattttttaattctttaattctttcttcattttttagtttgaataacctagatgtatttttatttctttttatacaatttaatacttctatatttgtcatacatcctaaatactttgctattaacttagattgattaaaacccctttttcgctctctatttttatgtagtggaacatataatatataatcatattttatgttttcactctctaatttatctttaattatatttgctatatactttgccataaatgttttatcattatatttaaatttaaataccatctttttactaaactcattatattcaatacaccctatggctttatcaaagtaataagttttatttatacaagataaacacccatcaagtaattcctttgggctaatctcttctattgattgatttattattgtctttccgcattttatacatccgtcatttataaaattaagttctttaaaacaatctttacataatgaataggtattttctttacttattggtttgttacatataatacattttatattactcggatatataatatctattaacttttgtattattaatttaatcttttaccagcagcccttctttttttaatctatttagctttttacttaagtttgagtatctatcattagtcctattgtttttaatcatatactctaagtactttacatttccaactaatacaactaatttctttgccctagttacagctgtgtataacaaattcctatttaataacatcggaggagcccaagctacaggtatcacgatagcgggaaattcacttccttgacttttatgaatagtagtacaaaaactatgatctaactcatctaattctgaatactcatatgatactatctttgtttgatcaaacaatacatatattattttattctctttatctatatgataaatatagcctatatctccattatatataccttctccactttcacttttatcctctgtttcccattttttagtataattgttttttatctgcattactttatcgccaactctaaaaattctcttttgtaaagtttcttctactttatacttatcttctttatttaaatatttttgaagttcaatatttaaatttgctactcctaaatctccttttctcataggtgctaacacttgtatatcttttagtttatctagtttgtaaaatttaggcagtctttcacttactatgcctacaatctcatttagtatctcttcatttgtatctttttttataaagaaaaagtccttacctttaacatttaagtgtagtggaagtccttgattaattctatgagcattaactactatcatactttcttgtgcctgtctaaaaatctcatttaatctaacaacattaataacttcagaatctattatatcctttaaaacatttcctgctcctacagatggcaactgatcactatctcctactagtattaatctcgttcctggttttatagcttttaacaaactatacataagaacaacatcaaccatagatacttcatctactataacaacatctgctttaatcggatcttcttcgtcttttaaaaatactaattcttctgaatccgtagcatatcccatttctaataatctatgaatggttttagcttctttattagatgtttcactcattcttttcgcagctctacctgtaggagctgctaaaagaacttcttgattattattttcaaatacttttattattgtatttatagtagtagtttttcctgttccaggcccaccagttattactactaatccactatttatagcttctttaacagctaaaatttgatttttagcaagttttatattcgtttcctcttcaactttttctatttcttcttctatatctatatttaaatctttaaactctgactgagataattttataatttgcttacatactccattttcagataaataataaggaattaaatatatatgttctgtgttcccaagatttctttcaatatgaattttttgatcatatgctagattcaaaatagaatctaagacatattctttatctattcccaaaagcttactggtttcttctactaatatatctttaggtaaataagtatgaccactagctagcgattgattaagagtatataaaactccctgcattattctatcttttgaatatttatctatacctaagtttgatgctattttatcagctactttaaatccaatccccctaacatcttctgctagtttatatggatttttgcttataacatctattgccttatttttatatttcttgtatattttcaaacaaaaattaggagttattccataaggagataatttaattattatatttcttagctctctatcatcttcataacttttggctatctgttctatctttttaatgcctataccttcaacttcagataatctttgaggagaattttgaattatatctaatgtatcaactccaaatttatcaattatccttttagccattttttctcctataccttttatcattccagaagatagataaacatatataccttctatagaagatggagtaacaggcataaaactactaacttcaaactgagtcccataagttttatgatttacccatttgccctcaacctctatactctctccaactgttagggtcggcatacatccaactattacaacatcattattttcatttgacaaatgtgcaataacataaccattatcttcatttttaaatacaatatcgcttatcattccttctattttttccataaataatctcctataaaatactaactttatcgtttacataatttattattattatacaagtaaatagttataaaaaaaatagaagactgtaaaattacagtcttcttatcttctcaattttaaaagataaattattatttacctaatgcttcacttcttaaagtttcagctttatctgttctttcccatggtaaatctaagtcagttctaccaaagtgtccatatgctgcaacttttttatacattggttttcttaattctaaatctcttattattgctcctggtcttaagtcgaaatgcttgtttactaactcaacaagtttttcttcactaacttttcctgttccaaaagtatctataaatacagataaaggtctagcaacacctatagcataagctaattctatttcacatttatcagcaagccctgctgctactatatttttagcaacatatcttgctgcatatgcagctgatctatcaacttttgtagggtcttttcctgagaaagctcctccaccatgtctagaatatccaccgtaagtatctattattatttttcttcctgtaagacctgtatctccttgaggtcctcctataacgaatcttcctgttggatttatgtatatcttagtttcatcgtctagtaactcactaggaataacttcttttataactttttctattaagtctcttcttattgtttcattacttactgtttcacaatgttgagtagatattaaaactgtatgaactctaacagccttatttccatcgtactcaatagttacttgagtttttccatctggtcttaggtattctaactctccactttttctaacttctgttaatcttcttgataatttatgagcaagagatattggaagtggcattaattcttcagtttcattacaagcaaaaccaaacattataccttgatctccagctcctattttctctatttcatcttctgttatttctccgcttctattttctaaagcttcatctacacccatagctatatctcctgattgttcatctatagctgttataacagaacaagtctctccatcaaatccatatttagctctagtatatcctatttctttaattgtatttctaactaattttggtatatcaacgtatgtattagtacttatttctccggcaactaatactaatcctgtagtaactgtagtttcacaagcaactcttgctagtgggtctttttctaataatgcatctaatattgcatctgatatttggtcacatattttatctggatgcccttctgtaactgattctgatgtaaataaatgttttgccatttaattaccctcctatacatttatattttaacttatctccattaccttagttttatgtttgtatagtttttttgatattaaaaaaacctcttctttttaagaagaggttaattatattcatcaataactaactaacctcatctttcaagatataaatatcttgtaggaattagcaccttttccattcggaatggttgctgggtttcacagggcctatccctccacctctcttaataaggtaattaagaaatttattaacttttttattttacatgtatgattatactactattaaaaattcttatcaacatatttcttaaaattttacttgttatttttttttataaatttcatatatttattttaaggggggatgttcccatgtatttggctaaagtaaactacaaaaaagatagtgttgttcaagtacttagtgatacattaaaagatataattgatgagaatacggttatagtttgtataggaactgacagagctataggcgattctttaggccctttagttggaacgatgttaaaaaacagcaattataaatatcctgtttatggtactttagataaacctattcatgccttaaatatatatgaatctctacagtctataaagaaaaagcaccccaaggggaattttttagctatagacgcttgtttagggtcaaaaagtaatataggaaatttacaaatacgaaaaggccctattcttcctggaaaaggagtgggaaaaaagctaccagaaatcggcaattattctatagtcggtatagtcgataaagttgatgaaaataataaattttcctttaacaatatccgcctaagctttattttagaaatgtctgaaataatagcattatctttaatactttcaacataacttatccccttattatataaaaataaagaagctgtataaaagacagcttctttatttttgaactaatgcaaacattaattctccactacatactaattcttcacctacatatgcactagcatgtgcttttcctatatttcttcttattgaaagcatttctacttccatttttaaagtatccccaggtctaacttcttttttgaatctaactttatctattcccgcaaacacacctagtttacctttattttcttccattgacatcatagcaattgctccaacttgtgccatagcctctactattaaaactcctggcattataggatatttaggaaaatgtccttgaaaaaatggttcatttgcacttacattttttatacctatagctttttttcccacctctaggtctaatattttatctacaagtaaaaatggatatctatgaggtattaattcttttatctgatctatatttaacatattaatatcaccctttatttatttttcttttaaatggtactgtcccacctatttctaataagtctagtgttgaaagtgattctcctgttcctttagctacacatgttaaaggatcttctgctatttttacctttatccccgttgcttcttctatctttttatctaaaccgtatagcaaagctcctccgcccgtcattataattcctgcatcacttatatctgcggctaactccggtggtgttttttcaagtacagaacgaactgtagaaacaatttgattcacaccatcttctaaagcttctaatacttcagatgaatttatagatattttttctggaagaccagttattaaatttctgcctctaacatccatagttacttcttcttctctaggataagctgtcccaatatttattttaatttgctcagcagttctatcccctataagtaagttatgatgtttcctaatgtatgaaactatatattcatcaaatctatctccacccatttttatagattcacttactacagctccacctaaagatattacagctatatctaccgttcctccacctatatcaacaaccatatttccatcagctctagatatgtctattccggctcctatggctgctgctatagtttcctcaattatatatacatctctagcaccagcttgtctagtcgcttcttctacagctcttttttctacctctgttactccactcggaacacataccattattcttggcataaaaaatctagaaaatccctttttatctacaactttattcacataatagcttaacattttttcagtaatatcataatcagatattactccgtcttttaaaggttttatagccactatatttccaggtgttctcccgatcatccttctagcctcagatcctaccgctaaaacattcttagatcttttttctatagcaacaacagaaggttcttctaaaactattcccttaccgttgacatacacaaaaacattcgccgtacctaaatctatgccaatgtcagctcctttagtcatttatttcaactcctttttatttacataaactattcgttaattttaatactctacatacaaaatatacaaaaactacttttaagtcaagaaaaaatgtaggtacattaacctacatttttgtcacatttaatttcatatttttgtttcgttgccattccacctctgatgtgtctttctgatttatttttttctaaaaccattttgacctcttttgcaagagatgggttaatttcctccaatcgttctgttacatctttgtgtatagtacttttacttacaccaaatgttttagctgtttgtctaactgttgttttcttttctaatatatactttgcaacaactatagctctttcttctatgtgagatctcaaaacttcccccccttaaatctggccttagtgatatatatgtaaattaaataaaaaatataacaagcccaatcaaatttgattgagcttgttatactttttatttaatcaatgtcatagggtctatagatttaccatcttttgttacagtcaaatgaacatgtggagcatctaagctctcaacacttgtagtatttcctactttacctataacatctccatctttaatttcttgtcctttttttacagatactttttcatctaaattagaatatacaacagatactttatcctttgattctatttttactgatactccatgttgctgatcttcaaatatatctgtaacttttccacttattaaagattttactttgcttcctttctttgcttgtacatctaatcctttatgtatttcccaaacatctaatgtacttgagtagcttggttctttttctgagtattctcttataactttctcacctagataattaagtttgctttcattttgtttactaacttctttttcctttgctttttctaaattctcttttgaattagtagtagtaggtacaacttttttctcttcttctattaaatgtatttcttcatcttcatcgccttttgcaactttatctttattatctaaaaaaccacttttagttgctaaattatccacactattttttgtaaaccaaacacctccaattgctactaaacaaacacacacaaataaagctaaataaaaaccatctttttctaatagctttttctttttcataacgcacctccaaatatattcatacattttcatacatttgtattttgtaccttttttgttatttttatacagtttttatttctttatactctatacaataaaaaaactctaaaccaatctaatattaagattggtttagagttttaatatatatctttaatttgcgtacctgagtaataatggtttaaaatctcgtaataagtgtacccttcatttgccatcccttgtgcgccccattgactcattcctacaccatgaccatatccttttactacaatatctacatactctttattaaacttcaaatcaaaattagcagaatttaaattgaataaatttcttatatcacgacctgttaagtttttattcccaactttaatttcatttactgatccacctttgcttctatttttaattcgaattttcttagataagttatcctctgatatatttatattaggataacccttttttatagtatttacaaaatctgagttgtttatcttaatattagatgcatatttaggtgcacttttatcatatggactatctacagaccttaaatatggatatttagtgctaaatacttcttcactattttctgtatttccagaagatgtagaaaagtaaagtggtagtattggttgatcattataaacaacaatgtggcctttggtttcttttacagcctgttgtatttttttatagtacttattcatccattcttgtccatttttatttaataattcttctttactcttatattcctgacaatgtttataatctgtacatacatctgcatttttatgtttattagtatttttattatatatagtaaatgttcttgctgccacagcttgtgattttaatgcttctatatcaaattcaggtgacatctctcctgcaacaacactacatagatattcttctatgtctagattttcaacttgtccttttttatggttataaacttttatattaggggactctttatttacagtttcataatttattatttttttagttcctttagatttaatattgaattgatttatagagttatcattttgttttatatctgaatcataagtaaatacagatataaaaattggtatcgctactgtaactagcactgtactagctaaaactaataaagggttcttcataaaattttcctccttagataaatacttctaatcaataaattttatgaacaaccctatgtaattattactaaatattagtcttcaattatttctatgtttccacctaatgcttggatttttttatctatatccacatatcctctttgtatatgatatatatctcctacttcagtttcaccttctgctataagtccacataatattaaagctgctcccgctcttaaatctgtagcttttactttagatccatataatttatctactcctgtaactatagcacttctaccttctatctttatgttagctcccattctattaaattctgctacatgcataaatctattttcaaatacagtttctataactacacctgtaccgttagcaattgtagccatagccataaattgtgcttgaacatctgttgggaaacctggatgaggtaaagtttttatatctattggctttaacacctcaggaccttttactctaactgcattttccatatctattatttcacaaccagcttcctttaacttagctacaacaggttttaaatgttccatcattacattttctatagttatatctccttttgtcatagctgctgctaccatatatgttgcagcttctattctatctggtataacagtatgttctgctccttttaatgatttaactcctgttattcttattgtattagttcctgcccctttaacattagctcccatttcatttaagaaattagctaaatcaactatttctggctcttctgctgcattttctattatagtagtaccttccgctaacgcagctgccattattatattttctgtagctcctactgatggaaaatctaagtataacttacttcctactaatttttcagtatttgcttctacaaatccatgatctattattacatttgcccctaatgctttaaatccttttaaatgtaaatcgattggtcttgtacctattgcacatccccctggcatagatattttagtttgattaaatcttgctaataatggtcccattactaggaatgatgctctcatttttcttacaagttcatatggagcttcacaagtttttatttcacttgcatctaccgttaatgtacaatccttatattcaacttttgcccctaaatgtcttaataaatcagatattacatgaacatcttttaagtttggaactccctttaatacagattttccatctgctaataaagttgctgctattattggtagtactgcatttttcgccccatctattttaacatttcctacaagtggattactctttttcactaaaatttttgccattttacttttctcctcataatcttattaataatctaattttattataggtgtagctatataaatcattgttttttcttcattttcactatacctaattcctatatttaaatttaccttatttcccaaatattctaagtaatcagtttttatagctttactaaaagctgtaactgacataaaattttcctcttctaccctatctatttctttagcattcatattatataatatttttttcaaaatatcatcatatttatatagttgtaacttttttttatattctccagctaaacatgtataaacatcaacccttttacagtagctgtttaaagtattttctagaactgtataaatatccactatatctttatatactttattttctaatatgtcaactataatatatgactcatttttgcttttatttgcaacaattatagatatatttttatttttttcttctatttgtgcatatacctggctttgagccttctttttgctctctatccactttaattgcgcctcttctaagcctagcatggaaataatatccacacatatatttttcatttcttctttatttaaagatctatctatataagcatttgctttaatattataaaacttaaattcactatttgtattttcaaaagaatttatcatttgcagatatccattattttccgaactattttttgattctccataacaaacaaataaccctagtaaaaacataaatactaaacttattacaattaatattttcttcatagtatataccccctagatttcatttaattcatatttataattattaacgtaaaatagaagattatactatttatgatttatcaattttaaaatgtattcaccataaaataagcctatgtaattacataggcttttatatttgttatattattcaactgtaactgatttagctaagtttctaggcttatctacatcacaacctctttcaactgcaacgtagtaagataataattgaagtggtaaaactgttaatatacttgataatacatcctcaacattaggtatatatattacctcgtcagcagccttttcaacttctttatttttctcttgagcgatagctataacatatgctcctctagctctaacttcttccatattagaaaccatcttttcaaataaagcttcttgagatgcaattgcaataacaggagtacctttttctattaatgctattgtaccatgctttaattctccagcagcaaatgcttcagcgtgtatataagagatttcttttatttttagagcaccttccatagctatattataatctagacctctacctaaatagaaagcactatgcttttcttttaaagttttagctatttcttttatatgatcttcttgctttaatgcttcttctacttttaaaggcatttcttttaatttttctatcatttcattatagtactctttagttatagtacctttctttatagcaaaatctaaagcaatcatataaaatgatactaattgagttgtataggcctttgtagacgcaactgatatttcaggtcctgcccaagtatagaatacatcatcagattctctagctattgatgatccaacaacgttagttactgataatattctagctcctctttctttagcatatcttaaagatgctaatgtatctgcagtttctcctgattgacttactaatattaataaagttttatcatctataaatggatctctatatctaaactctgatgctatatcagttataactggtattttagcaaatttttctatagcaaattttcctacaagacctgcatgataagctgtaccacatgccactatataaactctatctatgttgtctaaatcttctttagtcatttttatatcatctaaatgaatttctccatttgcatttaatcttcttactaatgtttctttaactccattaggttgttcgtatatttcctttaacatgaagtgctcatatccacctttagatgcagcttctacatcccaagttatttcatttacttttttatcaacaacttctctgttttcatttaatacagtaaccttatctcctactatatgaacgaattctccattttctaagaaatatacttttcttgtatattttaatattgcaggtatatctgatgctataaagttttcaccttctccaagaccaactactaaaggactgtcttttctaactgaaactaattcttgattgttgtctttacatataacacctaatgcataagcacctcttaatctttgagtagctttatacactgcatctaataaattaccttcatagtatttatcaactaaatgtgcaacaacttctgtatctgtttgagataagaactttacaccttcagcttgtaattcttcttttaattctatatagttttctataattccattgtgaacaacagctattgttttatccatattaaagtgaggatgtgagtttacatcagatggctctccatgagttgcccatcttgtatgtcctatacctaatccaccctttatagggtttttttgtaaatcttcagctaaaacagctagcctacctttgaattttcttatttctaattcatttccagtatttactgcaacacctgctgaatcatatcctctgtactcaagcttagaaagtccttctactagaacttctgtcgccattttatttcctaaatatccaactataccacacatattttgtgtcctcctaaaaatattatttatttatatttttaagatttaggtcagtttacataagctttattttgtacatgtaattacttacatgttttgttaaaactttccgatggtaaacacaccgcagagcatccgccgacacttcgataaactctgtcctcgtcaactcagaccaaattttcaatctaagttctggcgcttgcaaaagcgaatactaaaaatttaaatttagtattcactttaaaattatgataatttctcttgtattaaattagctaagtttgtagctaattcttttaattgaccttcatctttaccttctaacataactcttactaatggttctgttccagatggtcttattaaaactctacctgaaccatccattaatttttctattctttctatttcagattttatctctggaatttccatatatctatttttgttttcatttttaattcttgcattaactaatacctgtgggtattgagtcattactgacgcaagagatgataaagttttaccttcttctttaactatttgagctaagattaaagaacttaaaactccatctcctgtagtattataatctaggaatatcatatgtcctgactgttctccacctaaattatatccactatttttcatttcttctaaaacatatctatctcctacagaagtagtagctaagtttatattgttttctttagctgctataactaatcctatattactcataactgtaacaactagggtatccttagctaatttattgtgtttttttaggtaaatggcacctaatatcattatatggtctccatcaactatttggcccttttcatctacagcaataagtctgtctgcatctccatcatatgcaagacctaaatctgcattgtgcttaactacagcttcttgtaagctttctggatgtgttgatccacatttgtcgtttatattatttccatcaggagtattatttattgctacaacttctgctcctaattcttcaaaaaccataggtgcaactttataagatgctccattagcacaatctaatactacctttaatccatcaaagtctgcatttactatagtttttaagtaatcaacataatctctaactgcatcatgtttgtgtagtttctttccaacattacttcctgttggatgaacatctactttatctatatcatctatatactcttctatttctaactcaatagaatcatctaatttatatccatcttcattaaaaaactttattccattatattcaacagggttatgtgatgctgatataactactccacagtcagcattgtagtgcttagttaagtaagctactcctggagttggtataacgccaacagttattatatcgcatccaactgacataagtccagctataagagcagattctagcatatcaccagatactctagtatcttttccaactacgaccttaactttatctttccccttagttaaaacatatccaccagctctacctagcttatatgcaagatcacagtttagttctgtattagctattcctcttactccgtcagttccaaaatattttctcatcttaaaatactccttccaacaataaagatttaacttgaatataattttatattatgtccacgttaaatctttagttcataattgatattgtaatatgtttatcaaaaaaagacaatagtatttacactattgtcttttttatgtcactttttatatttttttcatatatttaaaattatgcaagtgcttctttattttgtacagcttctgcacctttcattaatgcttctttatttaatggaacaaacttctctttacttggtccaaaaacttttttgaaggcttctaatacagattcaacttctacacatttatttaactctaaatatgctcctagcattatcatattagcaactcttggattaccaagttctaaagctatttcattagctggtatataataagctttgacatcttctctttctacttttttctcgattaatgaactatttactagtatctttccaccaggaataacatctttttcaaatttatcaagtgatggtaaattcattactatagcacaagttgcatcatctgttataactggagatcctactggtatatcagaaatcgttactgaacagttagctgttcctccacgcatttctggtccgtatgaaggtagccatgaaacttctttttcttcaagcatccctgcataagtaagtaattgtcccatagacataacaccttgaccaccaaatcctgcacatattactctttctgtagccatattacttcgcctcctcaactttaacatctttaatgtttcctattggataatatggcatcatattatctcttagccattgtaatgaattttgaggtgttaatccccagtttgttggacaagttgataatacttcgactataccaaatccaagaccagctaattgtacttcaaatgctttttttatagcttttttagctttccttacattagctggagtatctactgaaactctttctacaaatacagctctatctaatgttcctaacatctctgccattcttataggagatccttgtaagttaacatctcttccgctttgagctgtagtagctttttgccctggtaaagttgttggtgccatttgtccaccagtcattccatatatagcattatttacaaatatagttgtaaatctttctcctctagccgcagcatgaactatttcagctgtaccgattgatgccaaatctccatccccttgataagtgaacactactttatcaggatgaactctctttattccagttgcaacagctggtgctctaccatgagatgcttcttgcatatcacagttaaagtaatcataagctaaaactgaacatccaacaggagcaacccctatagtatctcctaatactcctaactcttctaatacttctgccactattctatgtattattccgtgtgtacatcctggacagtagtgagtatgtttatctgttagtccttgagtttttttgaatacgactgtcattatctagcacctcccatagctacttcttgagaatcttcaactatttgtctagctttatcagctatctctgctggtgatggtatcataccacctgttcttccatagaaatgtactggtaatctaccttctatagctaatctaacatcttctaccatttgccccatactcatttccacagttaatatatttttagcttgtggtatttggttaaatgcttcaaatgggaatggccataaagttttcggtcttataagtccagcttttattccgtcatctcttaatgattctattgtatttttaacgattcttgaagtagttccatatgcaacgaaaactatttcagcatcttctgttttatacatttcataatcagtttcatttttctctatttctctatacttcgcttctaaatttatacagtgatcttctagagctttaggatctaagtataaagaatttattatatttggctttctttccattttagttccaacacttgcccaagtttttggagctaaatctctttttttaggcgcattaaattctacaggttccatcatttgacctatcataccatctccaactaccataactggagttctgtaataatcagcaacttcaaatgcttcttgtaccatatcaactgcttcttgtacagttgccggagcatatactggagttctgtaatctccgttacctccacctcttgttgacataaaataatcagcttgagatggttgtattcctccaagacctggaccacctctcattatattaactataacgcatggaagttctgctcctgctatataagttatcccttcttgctttaaagctattccaggagaagatgacgaagtcataactctagctcctgcaccagcagctccataaaccatatttatagcagatacttctgattctgcttgaacaaataccccttcgttctttggtaattctctagacatatattctggcaactcattttgtggtgttattggatatccaaagaaatacttacagccagcttccatagctgcttttcctatcgcttcgttacctttcataagtatcttagccattttaattcccccttaagtttatatttagtctctctcaactgttataactgcatctggacacatagttgcacaatttgcacatcctatacacttatctaaatctgaaacagtagctggattataccccttattgtttattgtagctgtgtctatctctacaattttaactggacatgcatctacacaaagtgcacaccctttacaaaagtcttggtcaaaagttacttttcccttagccataaaattagcctcccttgaactgtatatatttaaacctcttattacatccaacattccctcatgtataatttaactgggaatatttctccccttaagttgtttggaagttgaggtatcaagctttctaaacacgtgacatatcttataggtatgcccgttaaatttgaaacttcttttattaattcatttccttttaaaatatcatctacagtagtttccctaactaaatgtgtattattaacaagtcctgtcactttaagatttgaagttttttctatagatttaatatgatttataacatcttgtgctgtttgagttttctctctatttgcatttactacacaaaacatatcataatcatctttttctattaaatgactaaatcttcctaaaactctagctcctacatcatctccacctacatcaattacataattatattctttatcagttattggactcgtaacttgagcagatactgctggtaaatctaatgtagttgcttgaactgaactatctattggtaatatatctttagattgtaaaaaatcccttttttccctagttctaaaatagacatttactacatctaaatcagatattgcaacttttgtatctataagttccctaagacgtgtaacataattcatggaaaactcacttttaccactaccatagtgacctatgatgattctaattctcttgtcatttactatcatttaatcacctttttataatgtattagctatagctagttctttaccataaactttagcttcttcttcatttgataaaactctaagccccccttgagctaaagctatcatttcatcttcgccagggtaaacctttacctcagccacaaatttaaccttatctattatcatatttgtaaacatctttgaatatgatataccacctgttaataaaactgcatctacttccccatttaaaacagttgcacaagcccctatttctttagcaacttggtaagccattgcttcatatactaatttagccttttcatctccagcttctatcatagcttcaacttctctaccgtcattagtatttaaatatgctattaacccaccattaccctttatctttttctttatatcatcatgagagtattttccagcaaaacacatctttactaaatctccaacaggaagccccccacttctctcaggtgagaatggaccttctccatctagagcatttgcaacatcaattacagagccttttaaatgtgctccaactgatattcctccacccatatgtgctactataaaattacagtcctcatactttttatttaaatctttggcagctcttcttgctgtagctttttgatttaaagcatggaatatactctttctagtaatctcaggtatacctgaaattctagctacatcatttaactcatctacgacaactgggtctactatatatgaaggtatgcctacactatctcctatttcttttgctattaatccacctaaattagatgcatgttctcctaaaactcctacttttaagtcctctaccatttcctcatctacactatatgtaccacctgttataggctttaaaagtcctcccctacctactacagcgtctaaatctgatacttttattccaccttcttttaaggcatcctctattacttgttttctgaattcgaattgatctgatattctttcatatttgtttatttcttctgaagtgtgtcttaatgttttctcaaataataattcttcattatcaaaaacagctattttagttgatgttgatcctggattgattgttaagattttaaattttttctccatattaagccccctgtatatttatttaaccttttgcagccattaaaacccctaacgctatggaatttagcttagtttcctcactatccgctctagaagttaatattattggtgctttagctccaactatgataccagcatttttactttcagagaaaaatactaatgatttatatagtatatttccagcttctatatctggagctaaaagtatatctgctttacctgcaattggattatctattcccttatgtttagccgcttcttctgataccgcattatctaaagcaaaaggacctcctactatacatccttttatttccccatttttgcacatatcctctaaatttttagcatctactgtatctggcatcttaggatttactttttcctttgcacaaactactgctactttaggaatttctatatctaaagcattagttacaacacatgcattttctataatttgtttctttgattttaaatctggtgctaaattcatagcagcatcagttataaagaaaagtctatcatatcctttaacatcaaatactgcaacatgacttagtatattcccagttcttaatcccacttctttatctaaaactgcttttaaaattattgatgtatctactaaacctttcattaccatatctgctttaccttcagatactaaacttactgcttttaaagatgctttagccaagtctttttcttctattaattcatattcactcaaatctatatttaattcatttgctatactttttgttttttctatatctcctactaagatagccttagctataccctctctttttgctatatcgacagccattaaaacttccttgtcttgcgaacaagctactgatatagttttaggacccctttccttagcatatttaattacatcattaaaacttctcaatacttcaccccattttatatataaagttttatgaaattgttttcctctacatttttatcatatatctaaaataaaaaagatgcaacaataattatttatttaacttagtaatttttgttgcatcctgttatattaatttatatctctactatttgagggtctatctttacttctttaaaattatatttacttttatattttataatatacttcccttcacctttcgacctatcagtcatatctatataaagttgtatatcatctttacttaaattgctaatttcatctgaatgtacaatagtaacttttatgtcgtcaggaactttacttaaatctacttttgtgtctatgtcactttctttatcaagaatatctatatttgattttggtataataaattcacttgttatacttttatctatatctatcttaacacttgaaatattatcatttactctaattccatttggaatatcaagtccaacatcaacactatttgcatcttttaaatcttctattttgacaggtttagtacttatactatttattttatctagtgattctttttttccttctatagtaatttcatttggagatatcttataatcttttatattattgtctccttcactacttccttctaactttaatttcacaggaactactttttgttgcaagaacttaactgtagcaactacaaaatcatcttctaattttacatcttctacttcattaccagatttgtctacaggtactaatttaacctttgtagaaaagtctttttctttgttatctacatctacagttgcctttatgctagttactttattaacaacacttctaggtccagtaacatttgctgtttttttattaatttctatattatcaatgtttatatttgattttccttttgtacttacttctatacttcttttttcatctacaactttttctaaatccacagttataacactaggttttatatcatacttgttaacacgttctggtagattagcttgtagatatatagcattttttccttccttgggatcatctaatcttccatatatatatatattatctctgtttatagtcctaaggctagacaagtttgcttttattgatatatcagctaataattcttcttttggatatatagctaatcctctatcttctaacatactcatgtttgttatggttataggtatattattaaaagttcttaattcaacaggatcttctactgtcataacgtataaccataaaactaatgcacttagcaatgagattaactttattttagtattgttctttaaattttttatcatctaaatataccacctttaaaaaagcctttttcttgattctgattactagatttcaaattgcttcgtaatatattagttaatctttctttagtcatatttctatataactttcctgatttagctatagatacagctcctgtttcttccgatacgattagtgataagcaatcagaaatttcacttacacctatagcagctctatgtcttgtacctaaatctttacttaaatctttactctctgtaagaggtaaaaagcatgctgcagctttaaccttaccatctctaattacaactgctccatcatgcaatggagtatttgggataaatatatttattaataattgccttgaaatatctccatcaattatagttccagtatttatgacttcacctattttagtatctctctccattattataagagctcctattttttgtcttgataaagaatataaacactctactatctcttctatatctttatttagcatatcttctgttaagctataattatttttacctaaaaagttaaatttagttctacctatatattcaagacctgatctaagctctggttggaatattataagtacagcaattaatcctacagttaaagtattttctaacatccaatataatgtatgtaaattaaatatttcactaagctttgtagctattaataaaaatagcataccttttaaaacttgttctgctcttgtatcttttataaaggtatatactttataaaagatatatgtaactatgattatatcaactaaatctggtatgcttacattcttagccaaactaataaaaccctgccaaaaagaatctatattaaacacagttttgtcctcctgtttataatactcaaatcgtttacaatatgtattatactatattaatccagctatattcaatttataatatataaaataattttataataaaaaaagagtttcactaatgtgaaactcctttaaatgattggtgagcgcacagggattcgaaccccggacacacgccttagaagggcgttgctctatccagctgagctatgcacccacgatagtggagcgggaaacgagattcgaactcgcgacttcaaccttggcaaggttgcgctctaccactgaactattcccgcatattaatttggcgacctggaagggactcgaaccctcgacctccagcgtgacaggctggcattctaaccagctgaactaccaggccgcaattggtgggattaacagggctcgaacctgtgaccccctgcttgtaaggcaggtgctctcccagctgagctataatcccacatttaatggtgacccataggggaatcgaacccctgttaccgccgtgaaagggcggtgtcttgaccgcttgaccaatgggccttgttacctagctacgtcctactctcccaggcagcttcccaccaagtaccatcggcgctaaagagcttaacttctgtgttcggaatgggaacaggtgtatcctctttgctataataactagattatgtttgttctgtgctgaacaagtattatattaacatttttactttaaattgtcaatatcttttttttaatttttttaagatatttagtaaagtaatatcctagagttagcaccctgaaaactgaataacatttattagattaaataatctttaagcaaccgaagtcattgacttggttggcgccatgaaaatcgattttgaaagattttcattttggtcaagtcctcgatctattagtatcaataagctacatacattactgtacttccacctttgacaaagaggtgtaaccattcaatggaagaatggggagcaagtaggatttaaaaagaatgacagtcttagtgaattaggaaaaatgctaaagactatgcttgaaataaaagtaagaattggattaatacctacaccaaaagtagatgatgacgatgaaatttaataaacatatagatagatatattgatttagttgaaagtggatctcttatagttggtgaagatataaaaaaacttatagttttaattaaagaaaaactttctcaacctaatgtttttatagattcagaaaaaattgataaagcaatagagaagatagaacaatattttccatataagcttttagactgggaaaagtttattataggcttagtacattgctattacgatgatgaaactttagtatggaatacttttttattagtaatgggtagaggtgctggtaaaaatggatttattagtgctttaagttggtatttaacaacctcttttcatggtaaaagggaatacaatgtggatatagttgctaatagtgaagaccaggcgaaaacatcatttgaagatgtatataatgttatagatgataataaaaaacttcaaaaagcattttattatacaaaagaaaagattgtatttaaaaaaactaaatcatatataaaatataatacatcaaatgctagaactaaagatggtttaagacctgcatgtattatatttgatgaaatacatgaatatgaagattattcaaatataaaggtatttaaatcggcattaggtaaaaaagaacattcaagaacatttatgataaccacaaatggaaatgtaagaggtggggtattagatgattacttagaaatagcagaagctatattaaaaggtgaaaataaaacaatgaggttacttcctattatttatagactagatgatgataaggaagtagatgataaagaaatgtggaataaagctaatccatcatttaaattctttaaagatttaagaattgagatggagcaagaatatgaagatatgaaatatcaacctcaattagcaattgaatttatgacaaaacgtatgaatagacctgctcaagatagttttactgttgtagcagaatgggaaaaaatagttgctacaaatcaaaagattcctattttagatggatgtacttgtattggtggagtagactatgccagtataagggactttgtaggatgtggacttttatttaagtttggagataaaagagtatggttacaccatacatttatatgtcataaggcactaactttacctggtaggaaaataaaatttgatattgagttagcaaaaaaaatgaatttatgtactgttttaaaagaagattcagttaatcctaaatatatagtagattggtttttagaaatggcaacaaaatataacataacagatatcaaagctgatagctatagaaaatcattattagcgagtgcatttaatgaagcagggttacctttaagtgatgttcgtaatggatatataactcataataaaatagctcctttattagaacagttatttgctaatgaaaatataatttttggtgatgatcctatgatgcgatggtatacaaataatgtttatgtagatatggataaaaaagggaataaaagttataaaaagatagagcctaagttaagaaaaactgatggcttttttgcttttttacatgcattaagtgaagatgaaaatatccctcaaagtgttgttaatgaacaaagctattatgggtgctattcatattaatggaggtgattaaaataggaataagaaacttttttagtaatttatttagtacaaaaatgaatggtactggtacaagttctttacaagctgaactattttataaagaatttgctatacaaacttgtatatccataattacaaatgctttgattttagcagagtttgaaacttttgaaaaaggtaaaaagcttaaaaaaaataactactatttatttaatattgagcctaatatgaatcaaaatgctacagagttttggatgcaggttatttcaaacttagtttatgataatgaatgcttgataattcaacatgatgatcagttatttgtagcagattcatttgaacatgatgaatatgtgttttatgaagatacatataaaaacgtagttgtaaggggatatcaattaagtgatacatttgaggaatcggatgttatttacttaaaacttaatgatgccaatataaaaacagttatagatggcttatatagtgattacagtaaacttttaggagtttctatatcttcatataaaaaatcaaatggaagaaaagggatattacaaataaacggacaagctccaattcaagggattgcaaaagaaaactttgataaattaatgcaagaagattttaaaaattacttagaatctgaaaatgcagttttacctcttagtaatagttataagtttgaagaaagtaaaaatgcaggaactattaaggatagtagggatataagagctgttatagatgatattatagactttgttgcatcggcttttcatgttccagcaggagttataaagggagatatagcaggagttgaaggacaaactgataacttcctaatgttttgtataaatccaattgcaaagcttattacaactgaaataaatagaaaaatatatggtaaatctgattttattgaaaggacatatgtaaaaatgaacactcaaagaattagagatgtagatatatcaaaaatatctaaagcagccgatttactatttagaataggtgttaactcaattgatgataacttagaattgataggaaaagagccaattaatacagactggtcaaaagagcactatgtaactaaaaactatcaatctgtacttaatcctgatttgaaaggaggtgaaagacaaaatggaaaagagaacagtaaatctacaatttagaagtactgacttagaagcaagaaaaatagaaggttatgctgctatatttagtgatgaatatacaaaactaaaggatagatggggagattgcttttatgaaaagatttcaccaggagcattcttaaaaacattaaatgataaaactaaagataagtttatgcttattaaccatgattggaataaagttgtagggagaactaattcaaacttagaacttgaggaagataataaaggattaagatttagtttagaagttcctaatacaacagatggtaatgacttattagaaaatgtaaggttaggattagtaaaaggctgtagttttggatttaatatagtaaatcaaaagactagatgggatgatgattggaatttttaccgagatattacagaagttgatttatttgaaataacagctacacctattcctgcatattcagatacagaaataagttgtcgctctgaagaactatcaaatatttcaattaaagaaatgagagaaaaagaaaaaaacttagaaggtacagaaaaacaaaataaaattaatgaaaatagaagtgctgaaattatttcagcattttttaatgcatttaaataagaaagtgaggaattaattaatatgggaatgaaaaatttagataaaacagtagatatgggacaaataagagcacaagtagatgaagccttaaaaaagaataattcagaagatatatcagcagctttagttagaatggcagaaggaatacaagataatatattaaaagaagcacaaacacaagctagagcattaataagagcacaagttaatgatagaaatgtattaaatgaaagaggaatgaatgttttaactacagaggaaagaaattattatgaacaagtaatagaaaaaagagcttttactaatctagatgtagctttaccaaagactgtatttgatagagtatttgatgaattagaaaaagagcatccacttttacatagaattgcgttccaaaatacaacagctgttactgaatgggtaataagaaagacagattgtgaatcagcatggtggggaaaattaacagatgcaattaaaaaagagctttcagaaggttttgataaggtaaaaacagatatgtataaattaacagcatatatgccagtttcaaaagctatgttagatttgggacctgaatggttagatagatatgtaagagcagtattaagtgaatctatatcaatggctttagaatatgcaatagtcgcaggaactggaaaagaccaacctataggaatgttaaaagatttaaaaggctctgttgttgaaggagtataccctgacaaggcagcaataaaattaaatgactttaaacctactactttagggaaaactgtaatggctccactaacaaaaggtgggacaagggcagtaccttctgttttaattttagttaaccctctagattattgggaaaaagtgtttggagcaactacattcttaacagcacaaggtacttatgcacatggggttatgcctataccatcagaaattatacaatctgtagcagttccaaaaggaaaacttatagcaggaatgggaaaagattactttatgggaataggatcaagtcaaaaaatagagtattcagatgaatataagtttttagatgatgaaagaacttatttatctaaacaatatgctacagggaagcctacagataatgaatcattccttgtatttgacataacaaaattaagtgcagaagttccagcagagagtaaataatgttagatgaattaaaacaaaatttacaaattacttgggatgatgaagaaacaaataaaaaacttgaaagaagcttaagttcaggtaaagaatatttaaattacatagcaggggttgaaattgattttgataacagcccctttgctaaaaacttattattagaatatggaagatattcttataataatgctgtagagtattttgaaacgaattttcaaaaagaattaacacatcttcaaataatgagtgtggtgaaaaaagatgtataatgatttcaaaactaagcaaaaggaattattaaaaacctttaaatataaaattgaaataaagaccataaaagataccattgtaaatggtagaagggttaaagaagcagaagaaaactttcatccttgctatgctaatgtgcttgatttgtatggcaaggaactttatagtgctttggaagctaaattagagaatacagcaatatttgaaataaggtattgtgaaaaacttgaagttttaagaaataaggaagattttattatagtatggcaaaacaaaaaatataaaatttattatcctgatttcttaggatataaaaagaactatattcatttgaaatgtaaagaggttttataaatgagtattgaaatggaatttgaaggtttagatgaacttataaaaacagttgagtctttagctacagaaacacaagttgaaagtattaataaaaagatattaaaagagtgtggagagttagcctatgatactgttaagccattaatccatgaaagtgaagataataataagagtggtagaaaaggaagtagacctaatggtcatgctcgagataatgttccaaaacctaaattaaggaagaaaggtggaagaacttatgttgttgtaggatgggaaaaatctgataacagcccttattattatatgaaatttgaagagtgggggacaagtcaaaggcctccacatcattcatttggattagttaatgaaatgttaaaaaagaaatatgatgatatagctaaaaaagaatatgaaaaagaaattaaaaagttagaggggtgatatagtggaaaatgaggaatttgatattatagcacttgttgctcaaactttagagcctacaaatgttccagtatttgaggggtggtatgatgaagaattaaataaaacccatataactatacatgaatatttagatcaagatggtgattatgaagatgatgaagcaagttgcatagaacattatattcaagtagatatatggagcaaagatagtttagaagcagataaattaaaaaaacaagttagaaaattaatgatagaaaatgactttataaaaaatgctggtcaaaatttttatgaaaaagaaacaaaaatttatcacaaagcaattagatttacttatacagagtatttgtaaatcttttttattttagaaaggagctgaaataatgacagtagaacaagcagtaaaaactcgtagaatgggatgtaaagatatttatgttgctttagttactaaaaatacagctacatcatatgaaacatctacacctattaaattaggtagagctataggagctaaagttacaataaaaactaatatagaaaaaacatatagtgatgatgttgttgaagaggtaattgaaagttttgaaagtgctgaaatagaaatagaaagtaataaattatctcctgagcaaaaagctttggtaagaggtgctacatataaaaatggttttttagtaaataatacaaatgataaagcggcagaaatagctataggatggagagcaagacaaacaaatggaaaatatgaatttgtttggtactattgtggaaaatttaatcaaggttttacagaagaatatgatacaaaagctgataaaacaaaaacacaaactgctaaattaaaaggtactttctatggaagagaattagatggtaaatacaatactgaagtagatgaaacttatttaatagaagagcataaggatgcaaaagaagctataaaagattggttttctaaagttcaagagccagctgaaactcaagcagcataaattatatataaatttttaagttaaagaaaaaaatctttgtaaaatcaaatataagaagatataaaattatattcgatgtattaatcaataataaggtacaactctttaaaatggctttgattagcttatttaaaagagttgtatttttattaaaaaataattaatttagaaggtgaaatatatgaaaataacagtaaaaaataaagaatatgatagtggtaaaatgctacgaaataaatataaaaagtatattgaagttagagatagactttctcaacaagaaggatatacagatgaagatttaggagatatgataggtgttttagttattctgtttgataatcaatttacagttgaagatatagaatcagagtttgatgtatctgaaataatttataatttcatgagggcagatatagaaatagctgaaaaacttgataagaaaatagaacaaactaatatactttttatgaaggacaagaaatagacttttgtaatataactatttcttgtctagatataaatatatgtacttgctataaatataaaaagaccatagaactatttaaattaatagattcaggaaaagatgaattaaataatatctataagctaatacatattttctttgataataaagtaaaaataagagatttatataatttagaaatatatgaaattttaagtatattttatttaataaaaaaagttattttaaatatcaatgataaaattggagatattttctttgagaaagtagaacaacaaaaaagtgcatttgatgaatatgacaaagaaaatggatatgatgatatcgaagaagaaaaaaatgatatatatgatatatatttaaatattttaaataacttatttaagatttcaaaaagagtatttggtaatagtttaaagcaaagcttagagatggatcttaatgagttgctagattattttatgtattacactgaaaatttagatgaagaaaataacgatgaagattatgcagatgcataatctttttattttttgaggaaaggaggaaaaattaaatggctgctaatgtaaaaataaatgctaatagtactgagtttaataggcaaatggctgaaatggctagagaattaaataaagtaaaaagtagctataacttagcaaatacacaagcgaaactatttggaagtactacagatggtttaaaaagcaagcaatcaggacttacaagcaaaattaacatacaaaatagaatgatagaagctcaatctaaacacctaaaagaccttaataaagatttagaaaaacaaaaaagtgaaagagacagattaaatataaaaatagaagaaacaaatagaaagtataaagaaagtgtaagccaaactggtaaaaatagtgaagaatcaaagaaattaaagcaagaattagataatttaaaaaaagaatatgaaaaaaatgatagagctatagatagtaatattaaaaaattagataatgcagaagttaaattaaataatagcaaaaaagcattaatggaaaataaaaaagcattagaagaagttaataaacagctggaaaaaagtaagcttgataaatttagtgaaggacttgaaaagactagccaaaaatctgaaaatatatcaaataaaatgaaaccagctagtgcagttataactgggttaggaactgcagcagctgtagcaagtatggattttcaagaaggtgttgcgaacataaatacacttttagatgatcatagtcacttagatagctataagaaaaaaataatagatgtaagtaatgaaactggaataaatatagatattgttacagatggtatgtatcaagctatatcatctattggtgatggtggggctgaaacggaaaaaatatttgatactatggctaatagtgccaaagcaggtggagctgaagttaaagatgctgttgctttaataagtgctggtatgaaaggatataatacggttaatgatgaaacagctaaaaaaataggagatttagctttccaaacagctaagcttggagtaactactttcccagagatggcttcatcaatgcaacctttattcccgttggctaacaatttaaacttatcaatgacagatttatttactgatatggctacattaacaggggttacaggtaatacttcagaggtttgtactcaattaaaggctgtttttagtaacttaataaaacctacaaaagatatggaaaagttaatgaagaaatatggatattctaatggccaggctatgttaaaacaaaaaggtttaattggaacacttaaaatcttacaaaaagaaactggtggtcaatcagataaaatggggaaactgtttagtagtactgaggggttaactgctctaacagctttaactgggtctcaatttgacacattaactgaaaagtctaagaaaatgggtaatgctttaggaacaacagattctgtattaaaaatagttaattctacatataaaaataatttaagaacttctttaaatagagctaaaaactcactaattgaatttggagatataatagctccgtttgtatcaaaatttgctataggtttgtcagctgtaacaaaagctataaatggaatgactaaatggcaaaaaaaattagttgtaggattaggcgctggatttgttgcaacaaatttagctataggtgcatttgcaaaactaacaaaaggattgagtaataatataaagtttatgcaaaaatcaactacagctataaaagattatataaaagctacacgaaatggtgagactaaattagttaaatttggtcgaggtatattaaatgtaactagaaatataaaagaatttactattaatataggaagaaaagctgtacaaggtgtaaaaagttttggtagaggtatattaaatgcaactaaagccgtaggtaagtttgcaattagtataggtaaaactgctttaaaaggtgtgaaagcttttggaaaaggaatcttaacagcaactaaagctgtaggtaaatttgcaattagtgtaggtaaaacagctctaaaaggattaaaggcttttggtagagtttctttatccgtagctaagaatttagggagactaacattaactattttaaagaatacagctcaattatctaaaaatggttttatgtgggtaggtaataaagctaaaatgcttgcttgcaaaagtgctcaattagctgtaacagcagcaactaaagctatgactttagcacaaaaaggcttaaatttagttatgtctatgaatccaataggtatagtaataacagccttagttgctttaggagcagtatttattactttatataataaatgcgattggtttagaaatggtgtaaatgccgtgtggtctaaagtgaaaaatgtatttattggatttgcaaatttctttaaaggtgctttccatagagactttacacaaacatttgggttattaggagttcctcttaataattttttttcaattgtaaatgcaatttggaatggaataaaaggagttttcaatggagtaatatcttttttaagtggtacatttactggaaattggaaaaagatttttagtggacttagacaaataatttcttctatatttggaactataggtggaattattaaagctcctattaatgctgctatatcaggaataaattcagcaataagggcagttaataagattagttttgatgttccaagttggattccagttgttggagggaaacattttggagttcatcttcctacaattcctgcgttggctgaaggtggtatagtaacaaaagctactatggcgcttgttggggaaggtaaagaacatgaagctgtaatacctttaagcaaacttgataaattagttactaattcagtacaaaaggttttaaatgctaaagaaaataaaacttatgaaaaagataataaagaaaataaaataattcaagttgttcttcaagttggaaataaacaagtagctgaagctatatttgatgaatttggaactttaataagtaaaaatcaaaaaagtagaggaatagtcagggggaaaattcaacatgtttaataaatattatttaatatttaatgatttaaattcatatgaagattttggattaagtattgtaaaaagacctgacattcctaatccaactttaaagaaaactacaaaagaagttcctggtagagatggtttattgtatgaagtattaggtggatatgaagatattgtaatttcagttgagtttaattttattgaaaaaattaatataaaagaaagatttagacaagtaaaagcttggattagtggaatacaaaatgataaattaatttttagtgatgatttagattggttttataaagtagttgatgttaagttaaatggtaattttgaaactatattaagaaagaagggaagctttaaaatagattttacatgtagagcttttatgtattctatagatggagatgaatttgaagaaatatataataactatcaaatagtaaattattatatggaatctaagccacttctaagaatacatggtcttggaatgattgatataaatataaataataaaaagtttaaagttgatgtaaatgaagaagtttatatagatagtgaattagaattagcatataaaacagttgatgatccttttaatttaattgaaggggattttcctgtttttgaaaaaggaatgaataaaattaattattcaggtaatgtttttaaatttgaaattaaacctagatggaggtgtttataatgcaatgttacaaggcatctaattctagttttgataaaaatggagatatcaaattacaaccagttaatgcagttttaagaatggagttaaatggaatttgtgaaattgagtttgaacataattttgataaagaaggtcgttggaagaaaatagagaaactgggagtaataaaatgccctgtttgctattctaaaaataaacagctatttagaatatatgatatatcaaaaagtatgtttagtttaaaggtaaaagctagacatatattctttgatttaattagacatgttattttagataatcgagcagtaaattgtaatggtcaaaaagctttagatacaatcctaaaaggaactaagtttaaaggacattcaaatatagaattaaatacaactgcttattttgtaagtacaaatgcaattgcagcaataactggagatagtgataatacatttttaaatagatggggtggagaaattgtactagataattttgatatacacataaatgataagataggaaaattacataataaaaaagttaagtattctaataatatgcttgatttaaatttagatgaaaatacggataatattgtaactagagtttatccaaaagcagcagatggaattatgttacctgaaaaatttatagattcacctaatataaataaatatcctttagtttttgaagattatttagaaatgaatgatttaaaattaaaaaatgaaaatagcaaagatgatgataattcttttgaaacaaaagaagaattatttaaagcaatgagaaaaagagttcaagagtattttgataaaggcatagataagcctaaactttcaggtaatgtagatattgcattacttgaaaatactgaagaatacaaggagtttaaaaatcttgtaaatataagtgttggagatatacttccagttgaacatttagacttaaatgtaaatatttcaactagatgtgtaggtttagaatgggatatgattacaaataagtataactctataacacttggcgaactttacactggatattttgataagcaagatataacaagagaaaaacttgataatattttaaatgaaaatggaagtgttagagctgaaactttacaaggtatagtaaatgcttttactacaaaatttaaagctcaaagggaagtagcagaaaaacaacatgttagagctatgctttttgaagatttaaaccctcaaagtccaacatatggagctatgtgcttgggtagtatgggatttgaaattgctaataaaagaactaaagatggtaaagactgggcatggtccacatttggaagtggtcaaggctttgtcgcagatcatattgtagcaggtgtattgagtactatattaattcaaaatctcgatggtagtttacaaatagacctatcaggtaaagatggagctttatttaaaaattttggaaaagatgctgtcagaatacataacaattcgatcgatttattcaattggcaaaaaaacggagactttataggctctcttactgcattaactagaattgaagatggtaaaggtaatcctgataaacctctaattggacttatacatgatatagatagtgctttatcgattggttattttacaaaggaaggcgaaagtaaatcttgcatagaatgtgataaatataatatcttaaaaaataaaataggaaaggccttaagaatatttgaagatattgattttaacaataataatttatatagagctgtaataaaaagcctaaatgataaaaactttataaatgtaacagatgaccaactatcgatttcttttaataataaatattatttagttctttcagataaaggaataactttaggtcaagaaggggctagtttagttataagtgatggaaagatttttctggaaggctcaatatttgacaaaaatggaaattcaataggtggctctgagggtggagaagttggtggaggtagggcatcagctaatattatatattatataaagggtatagaaggatttgctccaaatgtatatagagattcagttggtgtaaaaactctaggctatggtatgactggaagtgaattaaatggagttagtactccaatgagtgaagatagtgcgacaaaacatctaacaaataatttaaatagtagctattattctaaagttttatcaatattaaaaagtaaaggagtaactaattttaaacaaagagaagtagatgcttttacatcatttgcttacaacttaggagttggagcttttgctaaatctgaattattagcaaaatatgtaaaaggtgaaagaggtgaatcaatacataaagaatttaaagaatatgtccatgcaggtggaaaagtttcagatggattagttagaagaagagaagaagaatggaaaatttttagtggaagctctgaaaaaatacatggttataattgttctcctgaaattgcaataattggaggtagaggagttgtaacttcaaataatggttatggagctaaaccatattaaataagcttagaactttaataagttctttttttatgcaataaataagtaaatgaaaaggaagtgtttttttatgaaggtaggaaaaatttataatatagattttgcaaaggtaacaaaaataccgagatttaaagttacattaaagactggagattctaaaagaatattaaatcttagattattagaaaacaatacacctattaatttaaatctttttagagttactgtagcagcaaagaaaaaagatggtggaaatatatttaatgctgttactataacagatcctttaaatggactttgtaaagttgaattaactaatcaaatgttaaatggatttgatttaccttgtgagattgttttatatggaattgataaaactgttgctagttctagtaactttgttatagataaggttgaaagtcttagggatgattatagtattgttagtagtgatgagtttacagccttaacagaagctttatctgatgtagcttttgttaagtttgacttacaaaataaaagagataagaacactaaaataagtcagtcagatttagatacgtcaagtgatttaactaagatacaattacataatttatctgattctgttcttagtgcaatgactgggaaaactccagtttcacctattttagcaaataatagtgttactcctgaaaagacgactttctttgaactaattaataataatttatatgataaaaggtttgaaactacagggcattatgtatctaatacaaatggtgaattagtttctgataataattataaagctagtgattttgttttagttcaagaaggatttaaatattatactacagatactcataatatagctttttatgataaagataagaaatttgtatcaggtgttcaaggtggatttacacgacctatagtagttccagttgggaaatctataatgtatatgagagttacgtttaatagtacttcaaaagcatatatttacgaaaatgaaaatccaggaaaatattatgaatatggagattatactttaaaaatatcagatccaaagtttttgcaatcaattttacaaaatacagaaattgagctagataattatgaatttgatttaaataagatttatggaattaaagaaaagaaaataaatttatttaacaaaaatactataattcaacatagtaagattgatgaagttactggtaaagttgatttagttcctggatttgaatattcaacaagtgattttatgaaaatatctcctgatgaaaattattgtggtagtgataattaccatctagccttttatgatagggataaaaatttaataaaattttatactggtggctcttggactaatccagtcaaaagtcctatagatgcttattatgctcgtatatgtgtaatgggtgatggtcaaactcatatgtttgtaaaagatgataaactaccattagaatataaaagttatacagatagtattgtagaaatctaccataagggatttaaaaaagctttagaaagtttacctataaaagctaaagatttacctttagatactttagaagcttttaaatatgacagaataaacttatataataaagatgatgattacgttcctaatactgctgtagattatactaacggtggtactattgaagcagaagggtacacagcatctagttttatagaaattgaaccaggtaaaagtttttgttgtactagaaacttccacagagctttttataatgataaaaaagaatttataagtggtaatgtaggtaatacatggacaagcccttttgtagctcctgaaggtgctaaatttataagagtaactttttatgctaatgatcctgaagctatgtttgtagaagggacctcattaccatctaaatatataccttattcatataagatattaaactttacaaatgagcctgatagaaaatcttttttaaaagcattaaaagtagatggatctagcaaactgcaaaatataaaatggaatgttctaggtgatagtataacaagtgtaaattattctagacctaactggtgggaaattttatctagaagaaataatatgaaagttaataattacggtataagtggaacaacactagcacattcagatgatagacatttatttgattatgattttaataaattagatgcaaataaaataggctataaaaaagatgattcttctacatggaaaactggaaattgtatagttgaaagatatgtgaaaatgaatgatgatgcagatattataacggtaatggcaggaactaatgacaatgatgttgttttaggaactccaacagatacaaagactgatactttttacggtgcttgtaatactttatttgagggattaattaaaaaataccctgaaaaagtaataggaatatttacacctattcaaactgaaaattgttataaaacaaatatagtcggtgatgttggaaaagttttagactctaaacctccaacagctactatatcactacaattaagagctgaagttataaaaagagttgctaaaaggtttggtttaccagtccttgatttatttaatgaaagtggatttaatggggtaggtgatagagcaaaatatatgtatagggatggattacatccttctaacgcagggcatgaaagattagcatctttaatagaaaactttttaataaaaatattataaggagtaaatttatgaatgaagaagtaaaggatcatatgttagaggtacatgaaagacgtataaataatcattctgaaagaatagatagattagaacaaagttatgctaaaatggctgttcaaatagaaaattcatgtaagagtatagatggactcgtaagcgcattaaaatggggcttaggctttatttgtagtggtggtgtagggttctttttttatgcaatacaaaatcatatatttaaataaaaggagatgttattaatgaaaagtagattaaaaaatccatatttttggctaggtttaggtggagttatattttcatcagctggaattgattttaaaactttaacaagttggagtttattaggaagtgcattattagatatattagctaatccagttgcagttgtagctgttatagcagcattagttggagtatttgtagatccctcaactaaagggttaaaagataataaataatttatataatttaaaaataatgtttataaaaattatatgtaaattaattttaaattatatataatttaaaattaaacaaaagtcagtaaattagactcttagaagtctttttttattggctttttaaatataaaaatataaattttaggaggtagtaccatgttaaatataaaaagaaaaataagtccatataaccactatgaaggaaataatcctcaatatatcgtaatccactatactggaaatataggtgatactgctaagaataatgcagattatttctttggaggcaatagaaatgcatcagcacattattttgtagatgataatgaaatataccaagtggtagaagaatataacggtgcttggcattgtggagatggtaacaatagatatggaataaataatagaaattctatagctatagaaatgtgtggaactgataatggaagaatatcagaaaaaacagtagaaaatactttagagttaacaaaatatcttatgaaaaaatatggtatagatgcagatcatgtttgccgccattatgatgcaagtcataaggattgcccttctgcttttcacgataataattgggctagatggtggaattttaaagacagattatcaaatagtctaataactaaaaatattgatattacttatcaagtatatgtaaatggaaagtggcttcctaatgtaactaacttaaatgattatgcaggcattttgggaacaccaatacaaggtatttatgctaatttaaatgaaggcagtataaaatatagagttcatacaataaatggaacttggttgccatgggtaacaaatagagaagattatgcaggtatttttggaaagaatatagatgccttggaaatgcaattaatagggttagagggatatagtgttaaatatagagcatatgtaggtggtagatggcttccttgggttactgatttaaatgactacgctggtatctatggtaaagctatagaaggaatacaagtacaagttattataaagtaaaaatatgatataatatttatattaagaaactcattcaacctactaactgtcgtagtaaaatttagtagttgctagacctattaactagaatgtaaaaggagtatcaatgccaactggtactcctttttattatactaaatctctataacttcacagtccaaatcttttatatcaagaaattcttttgacatatctgagatacttaatagaattgcaccatctatatatctaatatataaatgattttttaactcttctgttagttttatttttatagcaaacttatatttatttgttggaaattgaaatattgtaggaatttttctaaatccaaataaatttttagaactaagtttagaataattaacaagtccctttgaaggataaattttcccagaattaagaatatcattatatttatctgtaaaatgaataagataatatgtattatttaaataccttcttgatggcttatgtgctttagtaatccagaatataaaaaaaagatataataacaatgctattaaaaaagatgtagattcaaaataaatagctcctataaaaaagatacaatagagtaatacaaaaataaaaacatagataaaatttattattttaattgtaatattagaatatttagtacttatataaattccctcctttagctaaaatttatagactagattatttttcttcagttattaatttttctaatataattttattcccatcaaaagtcattttcatttctctattttcttcatttatacccatttcatcaagccaaggcattggaagccctatattagctctttttgctcccttagatgcattaccacctacttttgagatactcacatttctttttctgatttccattacctcacctcctataattatattataggagcattgcagcgcaatagtcaatacttttcataaactttttcttttttttcaaaaaaaatatgctccctgggagcaccttctaaaaccgtctaagttgttaataactttttaaaacctgttgataagtatatatttttctgttgataaatttaaagtactgacataaaactgacataatttacaattataaatataaaatgttgaaatttaaacatttataataaaattcacgaaacaataagttttatgtcttaataaagcaaaaaaaaataactacaactgacatgtcagtcgtagctataaatctatcttattcttcattttcacttttttcatataaatttaaaaacttatctaaatctatattgtataagtttttatttcctatttttgattttattattaaatctttttcttctaatttttttataatttttcttaccgttgttttacttatctgagatgctttcgctaaagtatatacacttatcccatcttctccaaataactcattttgaataagtataaataatatatcttctaatttcacatctccatcagctataatttcatttatatttccataaaaatcaagtttctctcttctttctattaaagagctacataaatctatcatagactctattataaaatccaaaaatgttattacaaaactagtcatatctcctttattcttttcatcatttacaatatcaaaacttttataatactttttaagattttctctaatggtatatgatattctgtatgaaactaaatactctaagtctttacataataaataactacttataaatcgactcgttcttccatttccatcataaaaaggatgaatatatccaaacatataatgaaatacagctattctaattagaaaattatagtcatcattgtttaacatctctaaactcttggtcattgtatctataatatcctcttctggattaattcctcgatgtattattttttgtttattatcatatatatatacaggttcttttctgaaaataattccatcaggtttattttcgggcttttcatttattacatcatttaaagtaaactcattgtataattttcttatatcttcacatgtttttaagttaatatcagattgatccattaacatctcatattttttcactattccatacaatctctttttttcacttttttcagaagcatcatttaaaatatcatttatttcttttcgagtactttgtacaccctctatatcattagtcatttttatttcatctatcaaacatttttttctatattcatctagtgcaattggaggtaccgatttagtacaacgtaaaagatgtttatcaagtttgaaaattttatttattctttctaagatatcattgtttataaccacaaaaccagtatttccttttattttaaaatcaaatttataagtagattcgctatttaatcttttttcataagtttccatatatgattttttatcagcgtaatataattttgataatagtttatatcccataaaaatcactcctcttataactattatgatttattataggtaaatatatgctttaagtaaatattttcttatcttttttaatatattttgataagtatattaaagttttaatataaattgttattaaaacatctaaaatttaatataattattcttaattaaataattaatttatttataatatttttgaataacaaaaaggcataaaagtattactttcatgccttaaaaaggtgctccctgggagcaacttttcaatataaattatttttattatttataactctacttacagttgctttactccaacctgtttctttcgatatgtaactataactttttccttgtttctttagttcttttattcgatctatatcttcatcagaaatctgtttctgcttaattttaaatttactttctttttacattcgaactcatttgttattgtaaactaaatttagtttttatttattttagaatttcttttttcaattccatttttagcaccttcaggtaatgattggaaaagttcatttatttctttttcatcagtaatcattgatttaactataaaatttaataaagaaaacaacttaattacatcttcctttttttcatctagatttatttctcctggatgaactgcattatttccaattactcttataatatccaatgatctttcaactctcttatccagtccattttcaaccattatttttattgcatcatttatattcattttttcataccctagctcttcacacaaatattgagtcgccaatctcaataatgctccagaagattttactgatgtgttaaatacttctgctgcttcatagtaaatctcttttactttttccggcatatcttcatttgcttccgggacttgtaaagcctttggaactactaaatttccatcaatccaaattgttgcttttgagcaatttgcacatatcgaaatatcaaaatcatttagtacttttctttttctttctttttcttcctttattgatctaagcattgcatctcttggtcccaaagagccagtgtcatccaaattaaataaatgtctatctaaaatatcataaactaaaaaactcccatagttaccattgactcctaaacttttagtcacccatgtctgcatggctaaaactttgcaatgtgggcatgtaaattgtttttcattaattgttggtctaatatatcccttcataacttctcccttttactttttatttcatcatttttctatatccattggcatttgcaaatacatgtgtttgaatatcatccataactattattccaggtatgttttgcttaaatgcacttcctaataacttagctccaccacccattacaactactgcttctgtatttattggatagtttaatttaagttcattatatattttcttaaataattcttttgaagcatttatatttacatttatatcttgtttttcacctttaaaataaaatcctttatctatgtaatcttgaaccttatctctatctacagttacttcaccttcaaatcttgtatctttttctatagatttagatattacatcgtatatgtttatagttcctatatccattgaatgaggtttagttgctctattgtctttaattaatgctatatcagttgtttttcctccaatatcaactattacaacatctctattacctatcttatcttgtatgtttttaccaaaatataaatatccagttacaccttctggaaataccttaacactatttatgtatatctttcttttagtatcgccaaacttaacatcatattctttatcttgtaatttatcaattacagtttgtttaaattgagtatattgtttaattggtaatccaagtgctaaatctacactatcttcatctgttgatttacatattgctcctagtaatagtggtagaaaattttctttttcaaattttttagcatttatttcttcttcaccttcacctaagaaaaatacctttccgtctaaagttaatctatcagcatttgttccatattcacctactgttgtaactttactttcaaatattacaccctcacttgttttaactgcaaagtttcctatatctattcctaatttagccattgtttattcctcctaatataattaatcatctaaatcaaaattgaatccatctgctggatcattagtattttcttctttttcatttgatgtttttggggtagaaactatttctggattatttccattcattactgcccaaacaagttctttcacatatccagcaggtgaaagtttaccatctaaaaattcttctatttttttctctttttcattatttttaaatgtcaaaactactctactcaagcttttcacctctttttatttttgtaaaatttgttaatctttagttatattttataaaactttacaaaatttgtcaatcacatttcagttttatttttgtaaaaaagtgcattttttataattttttataaaattttataaaatttaaactttgtttatatcctttatggcttttattatgctcctattttttttcattgccattatatattcttctactaactcagatgccgataccccttcatcaattgctatgtgtttcaatgtcttttttaatttttcatctatacttaaatttaatggaactttactcataagatccaatccctcctacaattaaataatcatccacttaaatatttgtatgcgcatataaataaacccttttataaaattaaaagtacctattttaatttacaaaaaaaatagtagattaatttaaacctactatttttaccaatatgcatttttatataccttaaaaatacataaaacatcattaaaggtatatttcatcaatcacacgattaaagtttcttacaagctaaataaatggatattttccctatatttaacttgcaataaatcaatatcattgattttaaattcaatatctgatatactatttttattaacaaattaatttcaattaaattaacacttttaatatttgtggagaatattggaagtgtttttttatatttaatttaatcataattttatgctcctatatctaaacttataagtccagcatcttgtaactcatgtattaatttcaactcttcatcatttaacgaatcatacccagaatctatgtattttatatatgccaattgatgtaattcagttttaacaaactcaaaatctgatttatcatcttcaattatgtcatcaatactttctacaacatcagtttcaaatgttacattttcttctagaattgtgttatatgtcattaatatatagttcaatgtgtttgctccatgaagtaatgatctatctatggcattagttaaaacttcataatctaaacctaaaatatcaattttttgttttctacctaatcttatgtgtggggccatttccttaataagttttacatttggatgttcatttagttcttttaactgtttagttcttctagatttatcttctctttgttttgcaatattttcagcaatttctccaattgtaactgctccaactaatttataaacatttgtattattttcagaattactttcattttttctagttactttttttataactccttttttttcaagagatttaatagcatctattgcagttcttctagtgcatctcattttagatgcgatagtattatagctaggaaaacaactatcatcactattggcatatctagcaagtaccatgtaagctaaaacttcacttttggtatatctatcaatattgtctataatatcattttccaacatcgtaaagttaaattttctaccctcttgaattttaacgttcatcaactgttactcctttcttttttaattcttgttcatatttatacaatagatctttaaccatttctgcaaagttattgtattcaaccttagataacttataataatgttctctttcatcttcagttactttaacttttactattttatcttttacagttcctctaggcatttaattcaacctccttccataaagggtaccctaaaaacactatatcataaagggtaccctttaaacaagtattatttttatttatttttaatatcaaaaatatctttgttagataagtagatattattaaaaaatataggtcttattaagtaggtcttatttgggtgaaataatttcactaggtgatgaaataatttcactaggtggtagtgaaataatttcactaggtggtgaaattgtatatttatcaacaagtagtgtcatgtggattatgttaataagtaagtatgtaagctgaaattactgggtttgcattgttaataagcatgttgataaatataataaaataataaaaaattatttaaattatagctaattagacgtagatgtcccaaaaaatgggacaccgaagattattatttttcttgtaaccaatttaagaaataaaaaatatctaaattaaaatcagaacgtacgtttgactttatgttaaatatgtgttaatattttcctataattacacagaacgtacgttctgtgtaataaacgaacactagtattttcagtgtgtttaggagaagggatttttaaatgataactttaagtcaaaatcaaacaaaaattttagaatcaataaagtgtggagttaaattaaaaggatatcctccatcagttagagagatttgtggtataacaggtattaaatctacatctactgttcacttccatatgaacaaacttgaagaatttggtctgataaagagagatccaactaaacctagagctatagaggttttagatcaagaaaatagcatacctggtttcaatcaagagattatcgaactaccaataatagagtttttagaaaatgaattttgcattggagaaagcatagtggaaactatgaaattaccatcgagtatggttttaggaaaagataattttatatgcaaagttttagatgataaattgattgaagtcggagtattaaagggtgattatattatcgttgatagaactaacaaaattgataatggaagtctttttattggagaaatagatagtaagattgttttaggaaaatatttaaaaaataaagattatattgaaatacaatttgaaaattgtttttttgatcctttgatagtacatagtagtgaattaaaaataataggacaaattagaggatactttagaataataaagtaatattattttagggagtgctagcgtatatgaaaaaagaaataacaaaaattgcagagaagttattaattttaaataacagtaataagtataaattagaatatataaatggctacatagatgctaaattagaaaaaaagaagaggacttagtcctcttcttttttttgctcttcctcaataaacgaatcaataataaattctaattttttttgatctgattcatttagtaaaaaaaactttttcaataatgcttttatttcatcaggagcatcgatatcttcagttaaatctttttttattttaccttctcctgttctcaaccatttttcatttatattaaattcatcacaaatatcctttattgtcctatctgtgattttccttctcccattttcgagagatgaaatatggtcttgagataaacataatttagctccaaagtctttttgagaaagtcctaatgaatttcttatttcttttaatcttgacttcacaaaaacacctcctattgacatattatatatgaaaaaatatgtcaatgcaattaaaaaaataaaaaaatatgtcaaaagcaagtttaatcttgacttatatgtctgagacatattataattaatgtcaaagacatatcgaaggaggttgaaatatgtcaaaagatgaagttgaagagatgaaagaaaaattaattttacttaaaaatttaaacccttttaagtttgaacgatttaaaggaaggctagacgctatatatgagattgaacatgaaaaatctaaattaaataagaattaatatggaaacaaataaaaggcttatagataatatagttttgattttaaaagatgttttatgtggaacttgatatataagcttaagccaaaatctataagcctaaaagcttttttaagtaaaaaatatgggatgaaaaaaagtgtgtgatttttataaaaatacattaaacaaaaatataatcaaagtctgatttttcaaaagtccgctgggcttttatcggacttgtaataagtattaacgtttgaagaaaagttaagaaaaaaatagcaatagttatggtgattaaatgagtagtaagagaactaaaaaaagacatttaaaaagagatagatatacagggatagattatgaagtattacagaaaaagatagatgaagaagaacttactgtaagtgagatagaaaaattaatagatgttactacaaatagtatttatgaaactaaaacgataacttctggacctataagagaagtggaaatatatccaagtttcttaaaaagagatataccagaagagtttagagtaaaaaatacaaagcaagctcaaaagaacttaaataataaaaatgctgaaaaatactttattagaaaagcaaatactaactttggaaaaggagactattatgcaagcctaggatatttagagaagtataagcctaaaaactttgaagaagctaaaaagcatatgagaaagtatatagctagacttaattatctatatcataagcaacaaatatctcggggcattccaaagaaaaaatgtaaaaacataaagtatatgtatgtaactgaaatctcacaagaaggaaaaggcaagtgtcatcatcatattttaattaattctgttttaccaatggaagttatagaaagtgaatggaaatatggtagaagaaataatatcagaattatctatccagatgagttacatataacaggattagctaagtatctatcgaaagacccaaaaggaaagaaacgctggggatgtagcaaaggattaaaagagcctattataacgagaagtttatcaaaattctcaaggaaaaagataaatcaaatgtcagaaagctataacttaattgaatatgaaatgcaaagggttaatccaggatataaatttgtagatgcaaaagttgtaaggaatgagtttaatggcaagtggtatataagtgctagactcagaaatataaaagattaagtttgaggtgaaacatgaaaaaactaataaaagaattagagcaaagtaaggttcaagttttgaaattaatatctaaaaaccctaaagagaatgaaaacaaaagattacttgaattagtagaaaagactattaaatggctagaaaatgaaaatcaaaaatttaaaggtatagaagcttatggatctattgaagttgaaatagaaaattatagttttataaaagatgaaagaattgataaaggcatatcagtatatctagttgattctgatggattatatgagtacatagacttaataaaagtatgtaaaaagcatcttaactctataaacaatatagaaggccttaaagagcttgctattgagtggtatgtggagaatatacaaaatgaaaaggtggagagcatatgcaagggttagaagttttagataaacgaaatatattggataatgaagttacaacttatggagatttagaaaatcctttgtttttagcaaaagatgtagctgagtggataggatatgacccatcatcagtaaataagatgataaatattgtagatgatgatgaaaagctaatcggaaaaatattccgttcaggtcaatttagagaaatgtattttttaacagaagatggattatatgaagtattaatgcaaagtagaaagccaatagctaaattatttaaaaagcaagttaagaagcttttaaaagaactaagattaaataataatccactagctaatttaagcaaagagatgcaagctatatttattttagataaaaagcaagaagaaacaattaaaaaagtagattacatatatgatgttatgactattgactatgaacaacagttaaatctatttcaaatggctagagacaaggcagtttctattttaggaggtaaacatacacctagttataaaagacacagtagaaaggtatttcaagagctttggagagactataaaaagttttttaaagtaaatagttataagaatactgcaagaaaaaattatgaagaagctattttatatttgagtaattggaatcctagctataacttacaaatggaaatagacactacaaatagccaaatagcatttaattaagggggagctaaaatgataatacataagtacataacacacatattggacaagcaatcagatgtaccaattctaaacgattttgaagggaagataactttacaagtagataagtttttacaaaaaactttaaagaaagttttaaaagaagattcattaagaaaagcaaaatttttagattatgaaaataatgagataagaaaaataacagatgaaattatatataatgaaaaaacatttatagaaaactcaaaagaaatagctgcatatttatttgatttaatgaaaaaaacagaaaacatagaatcatgcgatttaatagttagcttaatcacgataaaagatgaaaagatcatagcaattattaaagttgattataagaaaatatataaccatacagttgagtttgaagatgataagtttaatattcaaatgatagagaatgaaataggtatatcagaaacatttagagcgaaacaatgtgcattaataggtgtaaacggcttaaatgatgaatatgacttaagagttatagatatagaagctgaaaaagaattagaaaagtcactatttatagaggaatttataaaagccaaaaacataatagatgatacatacaagacaatgaaatttattagtacgacaagttcttggataaatagttattttgataatttaccgagtaggtatgaaaacttcaatttcttgtcatatgtaatgcttaatacatcagcaatagacatagaagattttagcgagaaacttttaggaaatgatgatgcagctaaggaaagttttattaattcaattgaatctaataatataactaattttaatatagataaaaaagtagctgagaaaagatttaaaaatattaatctaaaaggattatttaaatttaaatgtggattagatgaatttaataacccaaatatagtaaagattgttgcagatggagataagtacaatttagtaataaaagatgtaggagctttatttgtagaaagtggaagctaataaggtgatttaaaaggagagaacaatgagtataacagaaagtgcaatagaactaatagagattgttaatgagatatgtcaagagaaggatttagatataaaagaaattatagagaataaagattatgaattttatgagatatggaaagaagcaggaagaagatttgatgatattaagcagcctatagatgatgattgtaaaaagtgcaaaaaacatgaagctaatataaaagatatagagttactttgtaatagaaagaaagaagattggtcaggaaaaggaaatttaattaaagatggagttgttataggtctagatatggcactaacaatgttgagataaatttataggagagagatagatcatgaagaagctaaagaaattaaccagaagacaaaagaacttattagcaaacaatggatttgattttatgcagtatttattagaaagacaggaccataacagttttacatttgtacatagagaaacaaaagaagtattaaaacttaattttaaataaaagggggattaattaatgttgaaacttataactaaatatagacacgaaactattataaaagaaatggaagaaaaacatcagcaagagttaaaacataaagaagctaaatataaacgttataaagaaaataatgataatgaaaaatataagttggaaaaagaaattaaaagattaagggaagaattacgtttgaaagatataacacttcaagcactagatttttctgcgaaaaaattagatgatgcattaactgaagaagaaaataaaaataaagaactaaatagaaaaaatgaaaaattagaaaaagaaaagaaagatttacagtctaaagtaaacttaagtatcatagctaaacatcagctacaatcgctatgtatatgtaaattagataagaaaaactttatgtattcgcttgatttaacaccagtgcatattagtgtatctggtagaaaagtttatgatatagcaaagttgttaggataggaataaaatgaaagatttatatatatttttaatttatttagtttttatatttggaggtttagaaattttagtacaaatagcctctaaaaagggggagtaggatttgaatatattaggagctagagaaaagaaatgtcctatttgtgagggcatagtttataaattaaaaaccaaactaggtatattttatcaatgttctaactgtggatgtatgcacaaataaaaaaaggagatgagcttaatggcttttcatgtaattatatgccctaattgtaagcaaccagattgctttgaaaaggataaagaatttgaatctaataaaacatttgagtgtgagtgcggagaagagtttactttatcagaagctgaaataattgaactagaaagaaagtaaattataaaggagctgagttaaatgtacataaagcaatgtgagtattgtagcaaagattttaaaacaactcaacctaatgcgaaatactgtggtaaatatcacgctggtaaagctagagcaaaaagacaagcagctaaaaacgaatcaaaaataaatattaagggatgaaatcatgaaaattaaattaaatgaaaaatcagttgttcaaattgattcagaatataaaaaaggaaataagttatattgtggacaagtaaaatgcagttataaagaaagtcttgtaaactgtgttgattgtaatataaatcatattcaagaaaagaataaaaagggtaattttatgtgggttaaatataaagatataaaacatttactaacatattaagaggtgagtatatgaagaaatatatcatacacgaaggatatgtaaaatctaaaaatgatggatgtatacaccatataacagaacaacaattaattagtttgtataatgtgccgatatctgaatgtttatcatctaaacatacaataggtgtaaaagatttagacagttacatacatttatatcctagaaatgatggtaattatacgataaaataattcgtttatatttaatataattcttatttatgtttggagggttaatatgaagtcaagatataaattaaaagaagttgtttgtgattatggaatatatgaagatgataaattagttttaatattaaatgattatatgaatgctaaatatatattagatgtattaagatgtgatgaacaaaataaaagatatccaaatatggttactatgagatagattaaataaaataattcatgtaatgattttataaggagatagaatatggattacgtttgtaaattttatattaatagaaaattcaaattaagttgtcatagcaagcattatgaaaaaaactatattaaattatgtgaacaatatggagaaaacaatatatctgtagaaaaaatattgattggtagaagatttgattcaaaattaaatactttaataaaacaacttagaaatatatataaaatataatttttatttgaaaggaaagggaataacatgactacaactgaattgattgaattattacaaagtgttgaaaaaggtgcaagtggtagaagtagagaaataagttttacagttggagaagaatatataattgaaccaaacataaaaatcataggcactggtgatggaatatgtggagcagaattagatttagaaattgaattaaatacaataaaataattcatttatataaaatggagtgagatcatgaaaataaaaataataaaatcagaaggatataaatggtataaagattgtataggaaagcagtttgaagttcattcagaaagtaaaaaaggtggtaaaggtaaatatgtagttaggataaagaaagaagatagacatttaatgaatggatatatttatggttgggttaaaaaagaagattgtgaaatagtagagtaaaataattcatttatataaaatataatttttatttagtaatggaggagagtatgagagaagaagaaaaaagagaactagctaaaaaagtagcaccaactacacaattatcaacaagtcaagttcttgaaattataaatgaaattattgatattcaaaaatatggtacttgcattgagtttaaaatagatgaagattatatacacagagttatttgggctaaaactgtgacaggaagattataaaaataaagagtaaatcaaataagatattacccagtaggtataaaattcttttagagaaggtgagttaaaaatgaatttaaaacctttacaggttagatatactaggggaaaaatttatatagaatgtagagagtgtaatacatattttgaagtggacaagaagaatcaaaaatatatatgccctatgtgtagtcatgaagaagttttagttgtaataaatggcaaaaataaagaaaaggacaaatagataatgtatagatatatgaaaagaagtgaagaaacggaacaaatgacattaatagactggtgcaatataaatgtttgtaagtatccagaattaaagttaatttatcacattccaaatggaggcaaaagaggtaaattagaagctgctagattaaaacgaggtggagttaaaaaaggagttccagatttatgtttacctgtttcaagaaaaaattatcatggattatatatagaaatgaagtttggaaatggaaggacaagcaaagaacaaaaagaatggatagcagatttaacagaccaaggatatagagcagtagtttgtaatggatttgaggaagctaaggaagaaatattaaaatatatagctagttaaggtggagaatatatgagtaatgacaagtttaaagaggcagaaggaaagttatttaaatacaatttaacaaaagcagaaatgaattgcttaaaactagatatagaaaagatagaaatgaattacgaatataatggattagtatcaatagggtttgaagagagaacagggaaaacaaattctatatctaaaccaacagaaaaagaagtaatacaaaaagataaagtaattcgtgaaaaatataaagttatgaaagaaaaggaaattgagataaagaagatagaaaatgcattaacaatattaaatgatgaagagttagatcttgttaatagaagatatttcagcaataaaaatgtagggtggacttacataagtaagatgatgtctatgtctgaatctaagtgcaaacaaatgagagttgaaataattgataagataaaaggattattataacataacttaaatacataaattatatatagtttgtacacgaatcgtacacgaattatgtacgatttgtgtacgattcgtgtacgatttatatacgatttgtacataaattataaagtataataatagcatggaagatttgtagtgcttctataaaccacacaatatctattgctataagaccagataaatcccagtatctggtcttcaaaatgaggatatagtttaagtggtaaaacaaggcaacttgataaactattaatattttcgccatttacagtttttgatgctctaaatatataaatggttatctggtaattgttgcaggttcgactcctgctatcctcaccaaataatataacttacggctctttgagcaactctgtagcggcatggagtataaataaaatttaatatacgttctcgtaaaaggctagattaatttctagtctttttaatttgtaagaataaataaaggataagaatgttaaagaaattttgtagatgtgggaagattattcctcaagatatttctatgtgttctgaatgtgaatctaagtttaataatagacaacagaaagtatataaggattatagaaagcgaagagtagactttaaagaacagaaattttattgcagtaaagaatggaagtttactagagactctgtaagacaaagagacgatggaatatgtaagctatgtgatgataacttaagtgatgtagtacatcatatagagacattaaaagattgttggagcaagagattaaatatgtataaccttatatgcttatgaaatgggtgtcataagaaggtacatagaatgtacgataaaggagaagcatctaaagttaagatgcaaaatgaacttaaggaattgataaaagaaaattattaaagggtaggggggtagtcaaaaagttttaggcatttgacgtaagtccacggttgcagtttttttccgcggaaactccctaaataaaattttcgagagcaggatagaaatagctgtaatttagaatttatctaaattgcagctattttaaattttgtaaaatttgaacaaaaaaataaggaggtggtgaggtggctagacctaaacaacctatttctttgattcaagctaaaggtaaaaaacatttaacaaaagcagaaatagaagatagaaaatctaaagaagttaaggctgctaacgataaagttgagccaccttcttatttaccagaaacattaaaaaaggaatttaaaaggttagctagtgagttgataaaggtcgaaataatgactaatttagattgtgaggcattagcaaggtatatagtttctgaatataactatcagaaagtaacaaaaaagatgctaaaaacaggtgtagataatgataaatattttaattatctattaatgcaggataaactattcaaacaaagtagacaagcagctagtgatttaggattaactatatcaagtagatgtaagttagtaatacctactaaacaagatgataaacctccaaataaattttctaaatttataaaataagggggtggttgtatgtgaagatagacagggttactaaatatgctttagatgtagttgaaggaagagaaattgctggaaaaaatgttgttttagcatgtaaaaggcatctagaggatttagaaaaatcaaaattagcaccttatatttatgaatttgatgaagagttagcattagaagctatagaattctttgaaagtcttaggtttacagatggtgagatagcaggtcaagaagttgagttatttggatttcaagactttatagtaggctcattatttgggtgggtttctaaagaaactggatatagaagatttagaaaaagttatgtacaacttgctagaaaaaatgcaaaatcacttttaaatagtggcttatctattaaattatcagcatttgacaactatccaaatgctcaagtttattgtacagccacaaaaatgaaacaagctaggatagtttgggagcaagctagtaaatttataaatgcagaaccagatttaaaagaattatttaagataaaagaccatgatgcaattatagaatctctatttagtggcggtaaaataatggcactaggaagagatactggaactatagatggttttgaccctcatggaggaattatagacgagtatcatagtcataaaactaatcaaatggttaaattgcttgaagatggttctgttaaccaagcagaatctttaattagtattataactactgcaggatttaatttaaatggaccttgttacaaagagtgggaatactgtaaaagtgttttagaaggattagtaactaatgatgaatactttatatacatagcacaaatggatgaagatgatgatatttggaatccagaaaactggtgcaaggctaatccattagttgcgaagttacctaaaggattagaaaatttaaagaggtttgcaaaagaagcaatgcaaaaaggtggagaagatctaaggaacttcttaactaagtctttaaatatatggtatgagttttcagatgaccagtatataggtccagaaaaatgggcaaagtgtaaatcgaaaaagacattagaagatttcagaggtcaaaaatgttatgtaggtttagatttaagctctggaggagacttaacttcattagctttaatatttgtatattatgttgaaggagttaaaaagtattttatacattcgcactcatttattcctaaaaatagggttgaggaacatataaaaagtgataatgtaccttatgatgtttgggtaaaagctaaattgttaacagttacagaaactcttggaggaataaaaacagattataaatatataattgcatatttaaagactttaattgaagaatatgacttgaaaattgaacagttaggctatgacccacacaatgcagatgcatttttatctgatttagaagaattaggatgtgattgtatagaaatatatcaatcacataaatggctaaatgatgctactgaagattttagattagaagtagaggctggaaatgttgaatataatgaggaaaatgaactattagcatggtcagttgtaaatgcaaaaacagtttctaactcaaacggagaaattaagatagataaagataagagaaacaaaagaatagatccagtagactctgttatagatgcatataaactagcatttaaagaagaaagattgtctgatattaatgaaacagttgataaatacttcgatataatgggatggaattagaagggaggtgcaaaagtgaactttataaaaaacttaaaaaatcttataatgcctagatcacaaactgttgatatgagaagtgagaaattattagagtggctaggtataacaactagaaataaaagtattttaagtgaagttacttattttacttgcttaaaaatgctatctgagacattaggtaaaatgcctattaaaatgtatcaagaaacggaaaaaggtgtaataagagcagcacctaatgaagtgtataatctattaaaagttagacctaacccatatatgacaccttccatattttgggcaactgtagaaaataatagaaatcactttggaaatgcttatgtttatataagaagagaatttaaaaaattaaaatatggagcaacatatgaaataaaagatttatggattatgccaagtgataatgtacaggttattatagatgatgcaggtattctgggaaacaaagatgcaatttggtatgtatatacagacagatatactggagaacaatttgtatttaaaaatgaagatgttttacattttaaaacatcatttacatttgatgggatattaggtgagccagttagtaaaattttaagatatacacttgagggtggagttgaaagtcaaaactttattaataacctttataaaacaggacttactgcaaaagctacgttggaatatacaggtgatctagataagtcaaaagaagataaattaatagaaggtatttcaaggtttgctaatgggtcagataatgcaggtaaaataattcctatcccattaggtatgaaaataacacctttaaatataaagctaacagatagccaattttatgaattaaagaaattttcatcacttcaaatagctggagcttttggaataaagccaaatcaaataaataactatgaaaaatctagttattcaagtggagaaatgcaacaacttagtttttatgtagatacagaacaatttatattaaaacaatatgaagaggaaatctgctacaaattattaagtgatgaagagaaaaatgaaaataagtattataaattcaatgaaaaagctattttacgaacagatgcaaagacacaggcagagtgtttaacatcctttgtaaataatgctatatatactccgaatgatgctagagcaattttagatatgccagcaaaagaaggtggagatgtattagtttgtaatggtaactacatacctataacagatgtaggaaagcaatatgcggaaggaggcgaaaacagtgagtaaaatactaaatttacaaaataaagatataaaaactggagaattaaaaaatgttggtaaaatagaaataaaaaatcaaacagaagaaaaagcagaactttatttttatggagacatagtttcagacagttggagtagttggtggacagatgaagataaatgccctcaagatgtaagtgactttttaaaatcactagaaaactcacaagatatcgatatatatatcaactctggcggtggatctgtatttgctggaatagcaatttatagtatgttaaaaagacataaaggtaaaaaaactgttcatgttgatggattagcagcaagtatagctagtgtaatagcccttgcaggagatgaagttatagtacctaaatatgctaactttatgattcataaccctttatgtatgctatggaactcgtataatgcaatagatttaaggaaaattgctagtacattagatagttgtaaagaaagcatattaaatatttatatggagaatgtaaaagaaggagttactaaagaagaattatcagctttaatggatgaagaaaagtggtttactggagaaagtgcagctgaactatttaatataaaagttgaggatgaatttgagttagtagcttgttcatctgagttcttagataaatataaaaatactccaaaagatttgtttaaaaacaaaattaaagaaaatgaaaataaagaagtagatatagatgaaattgtaaatagagtaatttcacaattgaaaaatcaaaaacaagacaataaaaaagtagaaaatacaattgaaaaagaaaaggaagatatattaaatgatttagaattatactaaatctttttttattgccaaaatcaaaaatatatagaaaagtgaggaattgcaatgccacaagaactattagaattaatgaataaaataaaagctcaaaaggaattaataaaaaatttagctaatgaaaataaaatagatgaagcgaaaaaagctaaagaagaattaaagaatttaagtgaaagatttgatttagtatatgatctttataatgaagagaatgaagctgctaaagaaaatgtaaaaaataaagctaaaaaaatagatatatcaaatgctaaaaaagaatcaaatgcttttgtaaatgctataaaagctagattaacagaaagtaagataagtgatgaagataagactatcttaaaccaaatgagtgaaggaagtcctgctgatggaggattaactgttcctaaagatatgagaacagaaattaaagaacttagaagaggtgaagattcactagaagaattagtaaatgttgaaccagtaacaactttaagtggatctagagttatagaagtaagtgcagatgaaactccatttgataatatagatgaagcagcagactttccagatgtagaaacacctacatttaaaaatatagaatataaagttaagaaaaaaggtggaactttaaaagtaactagagagttaattcaagactcagcagaaaatatacaagcatatttaaaaagatggattgctaaaaaagctaaagttacaagaaactttttaatattaaagaaagctgatgaaatgacaaaaggaaaagaaaaagatgttgcaactttagatgatttaaaagatatatttaatgtttcacttgatccagctatagctatatcatcaaaagctataacaaatcaagatggttataattatcttgataaattaaaagattcagatggtaaatatatacttcaaccagatccaacacaaccaacaagaaagttattatttggaatttacccagttgtaaaactttctaataagacattaaaaacaactgaaaataaagctcctatatattgtggagattttaaagaagctataactttatttgatagagaaactctttcagtagaaatgaatactcaaggagattcttattggaataaagatttagcaggaataaaagtaagagaaagattagatataaatgatgtagattctgaagctatagtaaaaggagttataactataacaccagtaaaatctaaataaataaaaaataaaatttagactaataatacgttgaaattacaaggtattattagtctattaaagttttcgaagtaccttagaatcgatttaaataggtcgtttttttggctatttttcaagaaatgagggattaaatgattctaactttagaggaagctaaaaagttcttaaaagtagattttgatgatgaagatgaagaaattcaagactgtatagatgcagctgaggaatatcttaaagaggctacaggaaaagaatttaatagtgaaaataaaagagctaaaagatattgtaaagttttagtaaatgaatggtacaaagatagaggattaatggaagataaaaaaacaagtaataaagtaagatttacattacaatctattatgactcaattaaagtatggttaaagtatggtgattaaatggaatgtaggttaacagaaagaataaaaatagaaaaattatcagattcaaataaaactaatgaaaacggatttgatgaagaagtttggaaggaacattataaatgttggagtggctataaaagagtatctggaaaagaatatatagctgctaaagcaaataatagtgaaaatatagttacatttacagttagatactgtaataaggtaaaagagttactagatccaggagcaagtaaaatatttagaatagaatataaaggtttttattatgatattttagatgttttagactttgaaaatagacatgaatttgtagatattaaagctaaaataaattgttagatttccaaataataccttttaggttataatgtagcttggaggtgttatgacatgaaaaaaacattaattttaatgttatcattaatttcgatatttattttagttggttgtaataaaaaattaactacagaaaatgaaaaagttacatcagaagatttagtaaagtctattgaaaaagtgcataaagaatctaatatttactatgtaaaagacaaagaaagattatctattgaacttacatataaaaatactaatgctgagaaaatatacaatcaatttaaagatgatactaaaaaaataataaatgataaattattattagattataagcaaatacaagaagtagattttactcctttagtagataagcaaactttagggtgtagtgatttatataagttagaggataataaatttgttttagataaagatcatgatataaatattaaaaatatagatagtatcaaaacaggacttgatattttaaatggtaaatatgattcaagtagcaatactccagaagagaataaaactactattgaaaataatactactaattatggttctgtttctgttcctcaaagtggagaatttaagccagaaacattaataaatgaccttaatataggaaatacaggattagatcattctacttttgaagttaaagaagataaaggtaaaaaagtaatatcagttgatttgctttataaaaaagatgctttagttaaaggaatagttacaaagatacaatttttacttgaaagagcatttaaagatagtggatatgatatagatttatgtatatctcaaaaacatccaatggatttatatagatgtaaatatatagatggctcttggagtgaataaaatataaggtataagctttaagcttatgccttttttatttggaggttttatatgtcaagcactatagaacttgaaggatttgaagagtttgaacaatatgtaaaaaatatggctttagatgcaactataaaaagacaagctataaggtcaggtataaaagtaattggagaaggcttagaaaatgatactccacgtggaccaactggggaacttgctgaaattaaaatatcagttaaagaaaatgctctagcaacagaaggaactgcaaaaagtgaagcattctatgatgtatttcaaaattatggaacaagtgaacagaaagctcatgttggatattttgacagaagtgttgaggaaaacactgaggaagctatttcaaaggtagctcaaactatatttagaaaaatggggtgatattttggaaagtaatatagaaatagatgcctcgattataaaaaagaaattaaaagaagttctaaatgataaagatatattagatttaacaagtgataaaaaagtatattttatccatgctaaaaatcctaaacctccatatatagagtatcaagttattagatctagaggaagtgaatatagtgagggtaatatagattatttaaatcatttagtccaagttgatatttttagtttaggagactatacaaaactagaaacaattatagttaataaatttattgaagctggatttgaatataatccaggaagtccagacttatttgaagaaaaaacaggattatatcataagcctttaaggtttaatattgatttaccaactagctaatttaagctagtttttttatttgtaaaaagaaaggaatgaggaagaatgtcagcaccacaaaaaatattaccagttgtaaacgtaagtaagttgtatgtagctcaattaaaaactgaaactgataaaaatataacttttgatgaacctagatacttagaaggggttaagcaaataggaataaaaccaaaacaaaacagtgatccatactatcatgaaggaagaaaagttttagaggagcaaacattacaggatgtaaaagtaactttaaatataacagatttatcagatgaagatgaatgttatgttatgggtcataaactagcgaaaacaggtggggtaataaaaaatgataatgatatagctccaacacttgctattttatataaagcagagaagtctcaaggaatagataaatatgggatactattcgctggaacatttgggttatcagatgaagatttaaaagctaaggaaggtaaagcaaacttccaagctaagaaaatagaggcaagctttagacctttaataaatggattatggcaatacaatgtatgcagcgactctcctaatgtaacaccagagtttttaaaggatttctttaagaaagttactatacctgaagaaaaaacagatgaagttagttctgaacattaatataaataataggaagtgaaatgaaatgaaaagaaaatttaaaataggaaatgaaaacttagattttgaaatgacaaataaaactatatttgatatagatgaaagatttgataactttggaaatataataaatggtcttatgtatggacaaaatgtatataataatgctttaaaagttatggtatgttcttgtgtatcgaaaagacatgatgaagataaaaatgaaataccgttaactatagatgaattaaaagaaaaattaactccagatcaaattgtagatgaaataatcccttttacaagtaatttatattatgattatagaggaattaagaaatcagcaaataatgaaaatgactcaagtgaaaatatagaagaggaaagtaaaaaaaaatagattttaatgaaaagccatttgatataaataggcttttttttattgcaaaaacacaactaaatttcacaagacaagagttctttgatagcacatttaaagaaattgttatgttaatcgaagaactcaacaaaacatatgaggaacaaactcaatcaaattcagatgatggatatgttgagaaggttgtgagcatagatgaagtacctttcttatagaaagagaaaggagggtaaatgagtgatacagaaaaacgaataaccgcaaagatgattttagatgattctggatactcaggaacattaaaaggtataaattcagagttaaaaaataataaaagtgaattaagagctgctcagagtggtttagaagcatttggtaaatctactgaaggtgtaaatagagttcaaaactcattacaaaagcaattagatttacaaaataagaaattagaaacttacaaaaaaagtattaaagatgctacagaaacactacaaagcaacatacataaaagagatgagttagcaagatctctttctaaagcagaaaaagctcatgaaaatgctataaaaaattatggtaaagaaagtaaggaagctaaagaagctgaaaaagctttagaagaattacaaaaagaacatgataagctagatagaactgtagaaaacaatgctaaaaccttacaaaactatgaaactcaaatgaataaagcagaagcagaagtaaataaagctcaatctgctataaataagttcaatagagaagtagaaaatactcatagtgtaggtgatgcatctaaaagacttgaagatttaggagataactttaaaaaagtaggtagcaaagctcaagaagtaggtggaaaacttactacccatgttagtttaccattaacaggagtaggaatagctgcagctcatgtaggaatggaatatgaagctcaaatggataaggtgtcagctataagtggagctactggagatgacattaaaaagttagaaaataaagctcaagagatgggagctaaaactaaatttagtgctgcagaagcaggcgaatgtatggagtatatggcaatggctggttggaaaactggtgatatgctcgaaggtatagaacctatactaaatttagctattgcatcaaatgaagagcttggaactacatcagatattgttacagatgcattaacaggattcggattaaaggctaaagatgcaggtatgtttagtgacgttttagcagctgcttcatcaaatgcaaatactaatgttggtatgatgggtgaaacatttaaatatgcagctcctgtcgcaggagcattaggttataatgttcaagatacatcattagctataggattgatggccaatgctggtattaaagcaagtcaagctggtactgcacttagagcaggattaacaaatttagtaaaacctacagactcaatggaagctgctatgaaaaggtatggaatatctattaaagatagtcatggaaaaatgaaaagctttagagaagtcataactgaacttagagataagttaggtaatttagacaaagctactcaagcatctactgcagcaactatatttggtaaggaagccatgtctggatggctttcgattataaatgccagtgatgcagattttaataaattagctgatgccattgataatagtgaaggtgctacagctaaaatggctaaaacaatgagtgaaaatgcaaaaggtagcattactgaaatgaaaagtgcattagaaggtgctgcgataaaagtattccaagttttagcaccttctataacagatgtagcaaatggagttagtagtttagcaaatagttttagtagcttaagtccagaaacacaagaatttatagtaaaaatgggaatggcagctattgcaattggacctgttacaagtggaattggtaaggttagtagcggtatcggtggattaattggaactgtaggcaaatttaaagcattaaaaactgaggctacttttggtgattttgcaaaaactttaatagggattgctccagcagctgaaactgcaggagctggattagctggagccgagattgcagcaggtggttttggagctacagtaataggtgcattaggaccaattgcattaggtgcagctgcagtagctggtgttggatatgcaggatataaggttgcagaacatttaaactcaagtgcaacacctgcagtagatttatttgcagataaagttgaacatagtcgagataaatttggaaactatgcacaagctacagaaaaagatgtaattaaaatatcagatgcaacaaaaaaatcagttcaatcttatcttgatttagataaaaaagctagtgagtcattaatgaatttaaaaatgaactctgataagtttactaaagaagctaaagatagtgttataaaaaactttacagaaatgagttcaaaatctagcaatttatctaaagatcaaagagaaaaaatgactgtagattttaaaaagctagtatctgatacaggaattttaactagcaagaataaaaatgagataataaaacaatatactgcaatggttaatggaactaaaaatcttactaaaaaacaaaaagaacaaactataaaagactttaaagatacattaactcagagtgtaggattaacaaagaagcaatcacaagatttacaaaaactttatactgagatgggtaataaaattaaagctggattagataaaaaaagagatgctgaattaaaaagtcagaaagatttctttgctaaatcaaatgcacttacgagcaaagaagaagctgagattcttaaaaagactgaaagtcattggaatgcaaaaaaattcaaaatagacgaagctcaaaataaaattaatgctatctatgctaaagcagctgaagaacatagaaaaattactgataaagaagccaaagacattaatcaacttcagcaggagatgaaaaataatgcagtaaaaattttatcaaataatgaggttgaagctaaggtaatacttgagagaatgaaagatcatgatggaaatattacagctgaaatggcatctaaacatataaaagaattaaataaatctagagatgaagctattaaagctgctaatgatgaatgtgataaaagaatatctgaaataattagaatgagagatgaaagtaaagttataagtaaagatcaagctgaaaaacttatagctgatgctaaaaaacaaagagatgaaactgttgatgctgctaaagatactagagaaaaagcagttaaagaaattacttctatgaactctaaattaaaagatgatgttaatacaacaacaggagaagttaaaagtaactgggataagttaaaagattggtgggataattggcatcctgttcaaaaggtatttagcataataactagacaacctagtcaatctaaagttcaaggcaactggacaggtaactctcactttagaggtggattaacatatctgcacgaacgaggatatgagctgtatgacctcccacaagggactagaatatataaccatgaatctagtgaacaaatggttttagaaactgcaagacaaactgcacaaggagttataaactctatgatgaaaaataaaggtgattccagtggaaatattataataccaattaatattgcaggagaggaaatagatagggttgtagttccaagggtttcaaacaaacttgctttaaatacaatgagaaggaggtagacaatgttaataaataatatagatataaataagtttaatgctagggttttggaggttaatattcaaaactcgaacattaataatttaaaagactttgaatgcaaaaataaattgctacctcttttcttagattctaaagtagagttaaatttaattactgttactcttttaattaactctttagataagagacaatattatttagacaaaagtaatttgataagtactatgataaaaccatttgaaatttattttaaagatagaaacttaagatttaaatgtgttttaaatttaaactcagatcaatcaagtttaagacaaattagaggaaggttacaattaagttttataggatataacatagaagatggagttgtagagacaataaatagaattaaaagtaaaactataaatgtaaatggtaattcaaaaataccttgcatagtagaaataacgtctatcatagacatgatagacgtaactataactggtttaagtgaagatcctattataattaaaaatttaaaaggtaataaaaaaataataataaatggcattgagggaactgttcttcaggaaggcgaaaataaatttgctgatactgatatgtgggagtttccttttttagtacctggaacaaatactattacagtaaataaagatacttgtaatatcacaataaaatataatccaagatttatatagaaaggatgataaaaatgttaaaaacaactaaaacaataagtataaatggaaattcagagatagatggacaagtaattgtatatatgagtgctagtttatcaactactggtactggtagtgaaaacataagtaaaactataaataatcaagaattatataatgcaaacaaatctgaggtaagaaaagatatgagagaatttgaagatttagtatatgctgaacaagatagattagatgtagatttaactaaaatagaaaaggtaggtaaataattatgaaattgactaataaaaaaatattaaacgatgctatgactataggagcaatatctaataaggaattaccagtaaaagtttcttatgctttagctaaaaatatatctaaattagagaaagaattacaaatatataatcaagaaagagataaattaatagaaaaatatagtgttaaagatgatgataacaaaactgttatagatgaaaacaatcaaattaaaatacaagataaatacttagaagattggaataaagatataaaagaacttcaagaaatagaagttgaaatagatatacataaattcaaattagaagaactaaatggatataatatgacacctgctgagttaatggcaatagagtatatgatagaagaatagttataattaaagttttatggaaaggagggtgaagcctcttttgatacatttaaaaggaaaaaataaaaagaaaatagcaggattggtagactataaagatttatgtatagaaaaaatattagagagtggtgatcagctactctctttttcttatcctaaaaaatcaaaatattactttgatatagtagaggaaggttatataactactaaagaaaatgaatatgtaataaaagaaaaaaacgttgcaagtgattatactgaatttaaatgtgttctaaacttagaggatttagaaggtagaccatttgaacgttatgaaagtgttgaacaaccaattgataaggctttagcactggctttagcaggtactggatggatagttggtaaatgtagcctaaaaaagaaaagaactgttagagctaccaattgttctagtttagaaattataaaaaatataagaaaaacatatagatgtgatttagtttttaacacattaactagaacaatagatgtatatgagcgtttaggagaagataaaggagcttactttatagattctttaaacttaaaagaattgtatatacagggtaattcatacgattattacactcgaataattccgattggtaaagataatcttagaatatctaatataaacaatgggaaagagtatgtagaaaactatcaatattctaataaggttaaaactatttattggaaagatgacaggtacactatagtagaaaatttaaaagaagatgcagaagctaaattagatgaaatatcgaagccatacagagcttatgctgctgatattataaatctagcaaaacttaatgataagtataaaaatattttagattatcagttaggagatacaataactcttatatctaaagataataaatttagagataaacaaaggatagttaaaattaaagaatacccagataaacatgaacttgatagtgtagagattgctaacactatattaagttttgaggaaaggcaaacacaatttcaagaagccgcagaaacaatagataatataacaacagacaatggaaccgttgatggttctacaatagatagtattaaaactgaacaaatatctgactttgaaacatctgtagctaagattacagatttaactgttgttaatgctaaaataaaaaatttagaagcttttaatgtaactatatctggaaggttaactgcagtagaagctgatattggatcattaaatgctaacattggggttatagacaaattgactgtaacacattcagctcttatcaatgatttgcaagctaataaggctagtataacgcaattggaagctgtaaattcaactatacaagtattagaagctaatgtaggtaaaattgaaacacttgtaaacggaaatttatcatctaaaaatttacaagctggatctataactgctagagaattagcagctaatgctataactgctggatctagtgtaataggagaaggagctataggtaatgcacaaataagcagcttaagtgccaataaaattgatgctggaactatagatacttctagagtcactctagctggaccaaatggtcatttaaaacttatgggtaatagattacaggtctttactggtcaaggcaattctcaaattgaaagggtatctctaggagatattttaggagacggtagtagatatggattattagttcgaggtgtagataataaaacaattattttcgatgaaaatggagttactaatgctggtataacagatggctctataactaatgataagattaattcaagtgcaaatatagatggatctaagttaaatattaattctgttataactaagattaatgaagctactgaaacaatatctggaactaaaattcaaattggagatagaactctagatgtagagttatctacacaaaacaatactattactgaacatggtaaagagcttagtactcaaaagtctacaatcaaagctttagataataaaattaatttaaaagtagatgaatctatctataaatctgaaatatttgatatgaataaaaaatatgaagatataaaaataaaacaacatgaaactgatgaaaaaataaacaatgaaattacagatttaactacaaatttaaatgaattaggtaattacttagataatgattttaaagatggagttttagacacccaagaaatagaaattttaaaaggatatattaataatttagaaaaagaaaaaatggatatattagctcaagtaaatataatagaatcttataatgagttattaggatcaagtgaattaaatgaattaattaactctaaaatggagtttataagcaaacaaaaattgtttatagataatataaatttattaatagaaacttataaggaaactaacttaaaaatacactttattaaaactgatgaaactggagatgcaatacttatccagactgataacggtaaaaatataatgctagatagtaatggcgtaagttcttcccaaagaataattaattatatgaaatcttgtaatgttaaaaacttagattatataattgtatcgcatcatcactcagaccatgttgggggaatgcctaatataataaatgcatttaatacagaaaattgtatagcttatcaaaggactccagattggtcaagaatgccagctattgagactgaatggaaaacaaaagaagtatacgacaattttatagatgcttgtactaataaaaatatacaaattgttactccatttgaaaatcaaagagtacaaatttcagataatacatatatagagttttataatacagatttcgctgattataatgactataatagtttatcaatttgtgtattattagttcacaaaaataaaaaatatttctttattggagatataaataacactgctcaagcaaatatagtaacaaaagttccgaaggctgatgttttaaaaggaaatcaccatgattttaatgattctgcaaattatgatttctacaaaaagattaatcctagcaaagttattattacgaatccacttaaacaaaaacctagagctttaagtggctattgtcaatataataatattccatattttgcacagtttgataatggaactattgttttaacaagcactggttattcatacgaattaaatactactactagaactttatataaagatgattggtggaataaagatggtaagtatactgaatggtattggtttaaatcagacggtgcttatgctaaaaatgaagatttagaaataaatggcaagctatatcatttcgataaaaatggaatatgtacaaacccatattaaggtaggtgattaaataatatggagttaaataagaagccacttcaaaaattttggagtgactatgttatttcgattgaaaatataaaaaaatcattacaaaaagcaaatgcaaagtatgcatctattaaatcaagtgttgcccaagagaattcttttagttatactaactcccaaataaacatagttaaaaaagaaatctcactcaaagttgaacaaaatgacataaatctagcaaaaaatgaactagaacaaataatcgagactacagtttctaatgcaaaagctgaaattaaaattacaacagactctatatctcaaaatttaaataaattaataactactgtagatagtaaagcagataacaacattgttagtaccttatctaacaaagtaagttctttagaaactaatctcagtggaataaaaggtgaagtaagttctttagaaactgtaacaagaactattactaataaagttaatcaagttcaatcagacactaatgctaataaaagtaatataacaactttaactactgaaattacaacagttaaatcaaatatagcaactttagatgttaatttaaaaggaattacacaaagagttagtgctacagaaatgtctacaaattcattaactaattcaatgagtaatataaattccgagattaccaaaactaatagtaaagttgctagtatagaaactaatttatctagcattacgaataaagtttctaatgttgaacaaaatttaattttaaatagaaaagtaggaagttttagatatataagagattacttaaatggctctacttctaatgctaataaccatatagtagagttacaaatatgggcaaataatataaatatagcacaaggtaaaacagcaacttgtagtacagggttatcaaatggaggagctataacagatggaaactattcaaatcctgataattatgcagcttttggagatggatggcaatacattgaaatagatttaggaactgaaagaacagatatagatatggtgaaagtttggcactattactatgatggtagatcatacaatcataaattgatggtttctagagatggatctacttggtttgaattatataactcggaaaaaaacggcaaatataaagaaactaagtatggaagaacatatctactaaatgaaagttatactgaaactagattgaaaactgcagaacaaaaactgacagattcatctataatttctactgtaagtactcagttttataaaaaaggagaaactgactctagatatgcatcacaatctcagataactcaactgtttaatcaaatttctagtaaagttgatgtaaatggagttaaatctataattcaacaaaatccaactagtgttcagattggatttaattcaattaacactagatatcaatatactgatgacggtttttatatgaaagctaacaatggaaataataaggcatcaatgaagagaggttctttttacttatataactatacgaatggagtttttttaggagggtttacacctattgtatttaacggatgggataatgcaggtcaaggtattataaatgcaaaggaatcttattttttcactatttcaaaagataattctttaacaacagatactcaggactttgcaactaacttaacatcttttgtaaccataaactttagagataggagtggcggtgctggcaatgcttataaattcggtactcaaatatttactcctctttatgtccatgacaatgctaattttaataacaaggatgtaaaaaatgtaaaagatttatatgcacttacgggcagttttacaagtgtttgggatacatttggaaataaatgctttgagttcaatcaatctactgcaaataactaccgacactgggactggggcggaaaaaacttaatcaattgtaattggattgcaagctattctttaatggctacttctcccggacattctgtgggagcagatactattagtgtagaaactatgttattacaagaaaatttttctgaatatgatgaactaaataatgcagtattagtaaatatgaatgaagcaattaagtctgtatataaaaacaacaaaaaattagaaaatgagaatgaaaatttaaaacaagaaaataaaaatttaaaacaagaattaaatataactaaaaatgcactagatgcagtactaatgggaggaatataaaatggctttatatatagcaaatagaataatagaaaaagcaaatggtggaagtggactagaatataaattaatagttccaaagtggattaaatacaaagatgaaatagataaaattttaatatcagaaggtagagaagatctaatagtttctttagaagcttaagggaatcttatatatgattaattttattttttaggagggtatatgaatatagaagttacagttatatgtacgattgtaggtgcaataattggttatatgagttatcaaaagaagaatcaaaaagatattgagaatgatgcagctcaaaagactttattagctacaaagcttgattatattagcaaaggagtagatgatattagagttgatataaagtctcaagatagaagtattaaagatttaacagttcgcatggtcaaatgtgaagaaagtactaaatcagctcatcatagattagatgaattaatttcaaaaggagatgttacaaatgaaaaatagagtaaaaaatccatatttttggttagggttaggtggtgtaatttttagtgctgctggagtagactttaaaactttaaccagttggagtttattaggtaatgctttattagatatattagctaatccagttgcagttgttgcagttgcagcagcagttataggggtatttgtagatccatctacaaaaggtttaaaagataacaaataaattaaatataatttaaaactagtttttataaacattatttttaaattaattttaaatcaaataaaaagcagtaaattagactcttagaagtctttttttattgccctttttaataaaaaaatataaattttaggaggaattaattatgagaacaaatatgacagatgcaggacatggtggaaaagatagtggagctccaggtttacatggatgcttagaaaaaaatatagctttagatgttgcgaataaagtaaatgattatttaaaaacacaaaatataaaaaatataaatacaagaactacagatgtatttttaactttaaatgaaagaactaataaggctaataatttaggtgtaaattcatttgtatctattcattgtaatagttcagataatccaaaagctaatggattagaaatattctgctataagtttaaatatagacaattagcagattgtatcttagaagaaattaaaaaagaaggtttatatactcaattaagagaaggaggggttaaagaagataatttacatgttgtaagagaaacaaatatgcctgcttgtttagttgaattaggttttataactaatgaaaaagattacaacttaataatgaacaataaagatagattcgccaaatctattgctaaaggtatatgcaagtttaatggagttgcttggaaagaaacaactggaccatcaagcgaaggatttaaaaatggtgattattctggaagaaaagcaatagttactgcagatgtactaaatgtaagatacgatagaggaattgagcacgatgttatcggacaagttaaacatggtgatatagtcaacttacaatactgtttaaatggatggataagtatagaaggatttaaaggtaataagggattaggatatgtcaattctaagtatttagaattaatataatatgttataatatatataactaattagaatataagggattcgattagtcattcaacctactaactgtcgtagtaaaatttagtagttgctagacctattaactagaatgtaaaaggagtaccaatgccaactggtactcctttttattacactaaatctctataacttcacagtccaaatcttttatatcaataaattcttttgacatatctgagatacttaatagaattgcaccatctatatatctaatatataaatgattttttaactcttctgttagttttatttttatagcaaacttatatttatttgttggaaattgaaatattgtaggaatttttctaaatccaaataaatttttagaactaagtttagaataattaacaagtccctttgaaggataaattttcccagaattaagaatatcattatatttatctgtaaaatgaataagataatatgtattatttaaataccttcttgatggcttatgtgctttagtaatccagaatataaaaaaaagatataataacaatgctattaaaaaagatgtagattcaaaataaatagctcctataaaaaagatacaatagagtaataaaaaaataaaaacatagataaaatttattattttaattgtaatattagaatatttagtacttatataaattccctcctttagctaaaatttatagactagattatttttcttcagttattaatttttctaatataattttattcccatcaaaagtcattttcatttctctattttcttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaatataattttattcccatcaaaagtcattttcatttctctattttcttcatctatacccatttcatcaagccaaggcataggaagccctatattagctcttttagctcctttagatgcatttcctcctacttttgagatactcacatttctttttctgatttccattaaataacctcctacttgaatatagataataaaattgatattatagttatatcaaagattagctacaacctaaactttgatacaatttttttatggttaagattaaaattgctatccaaccgaataagaaaattggtttaaaggtgctccctgggagcacctttttactttgaggaaattaaaagttattagtatctccttaaagcaatccaattactgcttttatagctaatactaaaaaggcaattaatccaattactacaataatttttgaaaatagtttcaaataaatatttttcatattgattataaaggataaattaatttttttaacaaggaaggttagctacaacctaaccttcctatttagttaaaacattccttttatggttaaaattaaaattgctatccaaccgaataaggaaattaatttaattacaagtttttctattaagtctagtatttcgaaaaactcttcaaatttatccttcattacctcacctcctataattatattatatactattgcagtgcaatagtcaatgcttttcataaactttttcttattttttccaaaaaaatgtgcccccggggagcaccttttaaaatccactaaactgttaataattttaacaatcttgttgataagtcgcattattctgttcataaattcaacttttctgttgatgcagttaattataactgacataaatctctaaaccccttgaaaatactaaacagcataaaactgtatgttttatgtctttagaaatttaataaaaatattacaagttaaaatttaaatatcaaattaatttatttatgatataattttgataaatatacattttgaaaatacaaagggagatttaaatggaagaaaatataaatttagaattaaaagatatattattaaaaagagattttgatagattaaatgtcaagacaataagaatatttagtttaatcttagaaaaaagttatgaaagtggtagtgatttgtacgatgatttagacaatattttggataatgaagatgcactgaatttattaaaatcaaaaatatttgcttgttcaacatctattaaatattgggggttatctagacctgatttaaatgagtattcagtaagcttaagaaatagaattgaatcattaaaaatttacaataaaaatatactaaataccttagaacctaagataaaagatagaactcttgaatcacctactccttatacttgtctaaagctaaatgatgatgtttacttaatgagatttattgttccatgtggaaataggaaaaatgatgatggaataacagatgctaaagtaagacaatataaaaatgtaatatctattataaatattaaatatagatatattgaaattagaacagaagctacttatgcagaccgtatagtagaagtgatgcaatataaacttggtatagaaggaataagaaatattaatatattaaataattttgaaaataatatagaattttttaaggattcatttacagatgctaaatttataaatagcaaatctattcctgaatttgattttgatataagtcaacaagatagtgaaaatttggtagagatgttattaatactagaagattttattacaagtgataaagatgaatcttttttagaggaattaaaaaatataaactttgacgataataaaaatggttttattccattattactagctgggctttgtgggataggtatttccacaagaaagacagacttaaaagatataacaagtcaacctatgtataaaattatagaaccatatataaatcaccaaatcggaagacttcatgttactgatgaggatactggtcaaacatattctatacaagttagcttaaaaaataatagtatatccttcaaaagtgaattgactgatgaaaaaattataaaaatagtcagagaaaaaatattaaatataaaggaggagtaaaatgagtagcatagtagttgaagaagctctgagaactatggctttaaaaaatataaaaaggttttatatagaatatttttcaaaaaattttaatgtcgaacttacacatgctgcatctatgctatatgaattttctaaagaatcaaatagattaactataaaatatgaaattagatgctctaattgtatcaatatattagatgaactagatgacatatcagaaataaaacaatatactgaaatcgaatgtgatgattgcggacactataaccatatagattttaataatatatatatggtatattatatttcagatgaatatagaaaagaaattttagagctctctaaacaacactttccttctaggttatctagaagatctagaaatagaagtacattatctacacccagtattagtataggtactttagaaaaaattgatgcattagatttatctgaaaaagatggtaaaatatcagtatgttataattattacaattatggcaatgtaggcgcaatgggacatgactcagaggcaaaagattttgaaatgaataactatgagaaaggaagttgataaaaatgaatggaaactatacaaataatggccaagtaggtgcaatgggggaccatgcaacagctagtaattttacttttggagcacaagttaaagatagttttacacttacaaaagataatttagaagatttaaataaacttactgaaagtttaatgacttatactggaaaagaagttaagaaatcagaaattatcaatgcatcaatgttagttcaagagctatctgagagcatagaagatgataatactaataatcaatctaaagcaataggaaagtggagatcgtttctatctaatgtaggacctaatgtagtagatactataaaattgttatctgcaggaattggtcttgctgatgaagttaaaacattattaggtttatagactaaaagtaaagatcattaaaatttgattatgaattcacatgctatcctattttaataaatataatttaattttgataaggtaaatgcataaataaaaaaggcataaaagtaatacttttatgtcttttttctaattagttctataatagaattaaaaatgtatttgtgagggtttaatagtgttacataaattaacaataaacatatgcatggatattttcacttacatttctatataatcaactaacttacgatatatattttatattatattattctaattcttctatagattttctccctaaatatacaaattccatcaaagattggaatatttcttcctcggctgaagaagtatttatatatttctctttatacaaattgtagtgcttaagagcttcttcaaaattatgatacatttttccaccttcatttattccagtttcttcagctttaattttatcatacagtaaatcatacatattattatatccaccaaaatttatacttactatatatttacctggatatacttctttaccaactgttgtaatatattcttcaatttgttctttatttggataagagactgaatttatatattttttattacgatctatccattcataagcatcgtttttactatatgctttaattattgataatactaatttatctaatatctgtaatttattttcatgtttatctaataaatagttccatgttttatatctaataattggaggtaaaaaagaaaatacatgtaatatatcattagaaaaatatttatctttctgatattctaaaaaatatctaataaatagtaaagcatataaatctaaaattgcatcctcaaccttttctacttcttcgttcgaaaattcatttgtacgctgtgtatggtttccttctcttgcaattggattaattatttttatacgattaattaaatagtcacctagatcatgacctaaaatatttaatcctttatatactgcaatatttcttgaattatatcttacttctcctaacgtcaatttatatgaacttccaatatttaatatttttctcaccatcacttcagcatgttttctaagtcctcctattttccccatattagagactttcacatattgtgtatcatttaataagttacttattaatcccgtatattcatcatcattaaaattattcattagtgtcctcctcttaaatttagaactttattatttctactaatgctaaccattgtaaagtcatttttgtttgtattttattggttaaattatacatggaaattattgtagaataaagccttaattttaatgtcacggtagaaaaatattagttttattaattcaattagaaatagctatattttaaataatatatattaatatcttaataccaaacaattataagtaaattcaaataaaaataaaattttatattatgtaaaatatgagtgtacatgtagtaccaaaaaacaagaactaattaaaattataattaattcttactttttaaacaactttaatttttatggattttttctagttcataggatataatataaatataaaaaggaactcaatctattgccattagagtgatgtttccaaaaattattttttagatattttgaacttgaattctaattcaagttccataccactcttagtttgggaaggcttagagtggttttttattttatcatctatgtaattagctgataaacctgatagtataccaactaaataacttatacattgagatatgataaaatttattatttccatacttctcacctccttccgaaaagaagtaggtttttgttgttagcatggaaacgccactctatagattgagttccataagagattataccacaaaaataaaaagagatgatacaaaaaatagtatcatctctttttattatatattgagcgtgaattgaaaaataaaaataataaatttatttgtgcaatataattatagcaaaatttaggtaagttaaaaataataaaatttttgatagttaatttattttttagtataaaaaaatacatggaagtattacttctatgcctttttaatatattccttttgtattatttataactctacttatagttgctttgctccaaccagttactttgctaatataactataactgtatccttcgctctttaaaattttaatttcttctatgtctttgtcacagatctgtctttgtttaattacaaatttacaattttcttttagccttatattctctttttcatatttagatattgtttttatatgatcttctataatatttattgcaactaaagttcctactaactccccttcaatattttgactttttgtatttctaaattcactactaagcttttcttttctttcttctaattcactttttaaacttcttaatgttattaatgtcatatccattttacttttccccttatataatttacaaatgcttaaacaaatctatgtataagtagaagtttctattttattaatactttatttttaaattaaatttaatttaaatttaatttattttctatttttttttactttattttctctatcatattttgatgcttgtttatctatatcgaatccctctggtagactagctttagtagtgtctacagcaacttttattatattacttatagttttacttatagtagtattttttatagaagatacagccttcagtaactttaaatcgtcttcttctaagtaaactgtttgaggtgtttttactacctttttttcttcttccatatctaataaatttaaagtgcctatagatatatcttcctcttttatgtttttttcaacggctttatctacttttatttggtaatcattttttcttatttttatatctttaacatcttctttaaaaacatctaatgccatttctataacacatccttctctactaattcttttattaaattattaaactcttctctaaccttatgagctttcttttgttttctgcaataatcttctaaatccatattatttaaaattgcatttttaactactgttgtatcactaatcttagtttctaataaatctctttttatatcttcaaactcatttagatagttattaaataaatctccagtacttaattttctacttgtatatgagtttataactacagctctttttacatttgtttgtatgtctaagaattctaaatcttgcttgaacttttgatagaataattcacatcctcttatacttgcaatatcttgatattcgattggagttataatgctatctgaaattaacataaagtttctagctataagatcataagatggagataaatctacaaatatatagtcatatttttcaatagattctatgttgtttttaaaccatctccaaacggctttttctcttcccatttgtgtagatagatattcagatagaacacttaagcttatatcactaggtattaaatctatattttcaaatcgttctaatacactttctaatattacttcatctgctgttgcattttctgttagcatttggaaaagtgtcttatcttcatgtactactttatataaaaattgtgttaagttagcttgtgtatctgcatctataagtaatactttctttccttctttacttagtttcattgccgtaagtattgttaaagtagtttttccaactccacctttaacattgaaaaatgaacaaattttcataatttacacctcatttatttttaaatcaaaaataatttatttttaatttatatttaatttattttgaatttaaaattactttttaattttaatataaatatacattttttacaagttataaataatgtataaataatttatttatacattatttatattttttgaataatttatattaacttttattttaaatgttcgatacttatattgacattccttcaataaaccgaaaataaattattaacaacttataaatacattaattataaattatttttgcattctaactaatttacataaacaaaaaagacgcctataccaggtgtctttttgtttattagtattctatttcatccaaaacagctttccaatctttatcaattccaatcatctttaaaaatttatttactatatttaaaacttcgtatgactcttttgtcggttcgaataatgaattaattattgaatttaaaaattctaaatctaaaataaaatctagtgtatttaaaataaaatttttatttttatcttgtctataagatatatctagtctaattactgctccagatcccttcatttctaaggttgaaaaacttatatctaataaataacgacatgaaatcaattcaaataattgttgatcccctttgaatttaacagttactcctgacttggtatacttaacctctttagggtgattttctagtaataatgtttttaacaaattattattttcgatattcactttatagtcaatcccaaatcttttacctttttcgctagcattttttaaaaaatcttcttttgtatagtttttccactctggatcaaactctattttaataaactcatgatccattttcatcttgccaaatgtattataatttggcatttctttattaattaagtacatttccaaaaaatttaaattatacttatctggcacttctatatatttcataaccgttaacctattacaccaagtttcatttttattacaaagatgatttaaatgtcttgtgtagagatttttagtctgacctatatacaaacattcatctgtttttggatctaaatatttatataagtaatacatctttatctcctctttccctaccaattcaaatccatttctttttgatgtttaatatcggcttcttgttcttttttatattcttcaatcttattgtctaaagttcctttgaaaaacttatatgatgtagctttaatagtttctatatcatctctatctagagttatcattactgcatcattaaatgcttttagcatatattcatctttaaaatctatatttacaaaatctaatttaaaacttcttaaagttcctttagtaaacacagtttcatctggaatataaaagtctttattttcgattttaagcgtttctttttgtttcaattgagtatttataccttttttatcttctttcttgtctaacccctcattttttccattttttccattttctaaaatctctttcatatcgtttttgtcaaaatattttcttttatctaagtcttctactgtaaaagttatagaatctacttttcttcctgatttcaattcttcatatgttattttaaatttttcagtgctattcaatgcttctaatgcaggatctattactctttctttaaaattattgtatcttgggtatttatctcctaaattaaagcactctcttaaataatctactgtatagtttatactttctttctttcctgaccacaaacgtaacaactcatatattctttgagcataaaaattattaagacctaataaaacatttaagtttagtggagtatacccaacttccatatattctaataataaatcatataaaatagttgataattctatagtataggtattatctttagaattaaatttatgtcctgtaatgattggaaagtcatattcagttgattttttattctgttttttaaactcttgtatttgaactcttttattagctaatgactctagtattctgctaatgcctatatttgtattattggttgttttcttacttaatctaataaattcatcttttggtataatgcctacataatttcctcttgctgttttttgcatgttaaaaagtattgttaaataaaatttattttctacaaatgacaaattgtagtttgcttttattagcaagttatttttattcaatatttttaaatcatcatttgttgtttctaacattttctacattctccatttccagtatatattttatataaatataataacattaatactagtttaatacaacaaattatttaatttttgttgtattaaacttcccttttgttgtattaaacttcccttttgttgtattaaacttcccttttgttgtatttcgtatgctacacatattggaatcacttaattacagctcgtctaaatactattaaatactattaaatactatttaaatactaagtaaagactagtaaagattccttttctatactttttctgaccttttacaaaacaaataaccaataattccctttaaaatgatataatcataacatatcagctataggaggttttgcatgaaaaaattaattttaatattcacattaatactatgtacaagcttattggttattggatgtggaacgaaagagattaaagataatgaattagataagcagtttactattaatggagctttagatttaactgaaagtaagtattatgtcaataaagataatattgaaattcaattacgatataaaggtgatgtgttaagggttggaattgtaaatcaaattagaaattcagtcgaagaagaatttaaaggtaaatataaaaagatagatttgactatcaaacaagaagatccttatgattcagtaaattatatattcacagatggtaaatgggataaagatataaattaattaataaaaaatactatgaatataattctattcatagtattttttattataattttttataaatatttttaatatcagtacgtcctaataaataatctactgatacatcgaaaaaatcggctataagattcaatgttctttcgtctggaaaagtttcaccagtttcaagtctggatatagatctttgtgtcatagatagaatttttcctagttcggtttgagataggttattactttttcttaattcaatgagtctatatttaaacatcaataatctcctatcactatatttcttacataattttatactaaaatttatggtaaattatccgtattgacaaaatagacgaaaaacgtctaaaatgacaatgctgtaaattttttaaaaaaaagttgcaacttaagatggaaaatagtagaataaaatcgaactaacgttctttttggtttgaattcttactatttggcgggggctattatgataaaaaaagaaaagaaagataaaaaagaaattatagaactaattgaatctatagatgattgtagatttttaaagcacataaaatttataatcttaggatatatacataaaaaaaagactaggtaatacttcctagcctttttttattttactgataaatttttctagaaactgccagtcttcatcatctaaagtcaacattgttttaattacttttttcttaaacggatcatcatctgcatataaacgtccaactagtatatcgaattcttcctcttcagatagatcattgaatacaggctcttcactatcagaaccatttcttaaccaatcttcagatacattatgaactgaacaaattgtttttatcattcgttcagtcaatgctactttaccagtttctatattagttagatttggacgacttataccgattgattcggaaaattgtttctgagtcatttgcaagtactctcttaatttttttaatcttgtattcataatattcaatctcctatttgtatttaaaaatctatgcacattatataaattgggtttttaataaattatatgttttataataaatgattcgataatgtttgtcaaaaacattttttatgaaaaaaatgacaatatttgtagaaaaatgtttgacaagttacatattatacccttataatgtttgttataaacataaaaggagtgatgaatttgtctatagaagaaaaagaacaaatacttagagttgtatttgatgcaactgaaaatatgagtgaatctcaaaaaaattacatacttggatacattgcaggatttgaagataaagcatctttagatagatgtaataaagtaagctaaggaggtagaaaactgtgatatctattttagataaaagagaagttttaggtaaagaggttttcacatttggaagtatagaaaatcctattttcttagctaaagatgtagctaattggatagggtatgatacatcctcagtaaataaaatgttaaatactgttgatgaagatgaaaagctaatcggaaagactttccgatcaggtcaaataagagaaatgtggtttttaacagaagatggattgtatgaagtattgatgcaaagtaaaaaacctatagctaagcagtttaagaaaaaaataaaaaaaatacttaaagatttaaggttaaaaaataatacatattcaaatttaagtaaggagctacaagcaatttttattatagataaaaagcagcaagaaatagaaatgtatatagatgatgttagagagaatttagaagattttaaacaagatatacctttattctcagttgaatgtgatgaaatatctagattagttagaagaataggaactaatgctttaaaaggaaagaatagcaaagcttataaagataaaagtattcgaagtaaggtttatagtgatatatacaaacaattgagaagagaatttggagtaacttcatataaagcaattaagcgaagacagttagagcaagcattacaatcagttgaaaattatagattgccaatatttttagaagaagaaataaatttaataaataaatatgaaagtagaggggatttaatatgttaaaacaagtaatagcagaattacagtgttttgagagaaagataaaaaatttagaagaagccatagatatagaagataaagatcaaatagatattgaatttgcaaatataaaaaatgaatttgaagcattacaagatgcaatttatacagcaaatgaagatatatcagaggtggaaaacactatgtttaatgtggaacgtcttgtaccaatgactatagttataaagtaaggagattgataatggaaagaggatttaaaggagtctggataccaaaagaaatttggttaaatgaatcacttagtattcaagaaaaagtatttttggttgagatagatagtttagataataatgaagatggatgttttgcaagtaatgaatactttgctaatttttttaaactatcaaaaaatagatgttctgaaattataaaatctttagagaagaaagggtttataaaaatttcctatatgtacaaagagaattctaaggctatagataaaagagttataaatatactcgaaaaatcgaataggggtattcgagattccgacagaggtactcgaaaagccgaaggggggtattcggaaaagtgtgaagataataatacatatcttaataatacatttaataatatatatagccttgtaataggcaaattaaatagtttagctaataaaagttataaaagttcttctaaaaaaacacaacaattaataagagctagagtaaacgaaggatttacagtagaagatttttataaagtaatagaaaataaagtatgtagttggaaagatgatcctaagatggaccaatatttaagacccgctactttgtttggaacaaaatttgaatcatatttaaatgaaaaggcaactaagccaattaagggtgaaaactatggaaagtatagagagtatgagcaacacttggatagaaaagataaagaaatcatatcaaatgaggaaacacagagaacagcagcagaactcggaattgacttataaatgtgaaatttgcaaagacaaagaatacatatttgtagatgatgcagttaaattttgtaaatgtagagagataagacttgccaaagaaagattagaaagaagtggaatagctgatagggtaaataaaaatacctttaagacattcaaagttaaaaatgaaccacaaaatgtagctagaaatatatgtataaaatatataaaagattttgataaagagaaagttttgctactacaaggacaagttggaagtggtaaaactcacctggctatagctacatgtaataaacttttagaaaaatatgcagttaaatatatgagttatacgaaagacataaatgaattgaaatttaatatgactgatactgatttttataataaaaagttagatgaatatagaaacgtaacaattttatttatagatgacttatttaaaggatttgaaaagggagattacagtagagctagagcagaattaaggataatgtatgacattataaattatagatatgacaataaaaaagctatgataataacaacagaattatctataagcaagctattagagctagatgaagcattagcaagtagaatagtagaaatgacaaacaaccttgataatgatgctaaatatagatttgaatttaaagggaaagagttaaactatagaatttatggagaatagaaaatgaatattttagaagaagcagaaaatttaagaagattagcagaagaagcagctaagaaaagaggaataacagtacaagaagcttggaatgaagctatagaaatatttaagagtagaaataaacttaaataaagaataaaaaatatgaaaatagcttatgagaaggttaaagaatgaaaagagaaatattagcaataatttggtatatatcagtagtctggggtggattagaattgcttgtatggattgccaataagcgaaatactaataggtattagttaataaaatataatttttatttaaggagaataacaatgagagttgggttagatgatgatttatatgaaaaattagataagataggagaaaagttcggaatgacaactgatagtcttattgaacttgcagtagaacaattaattaaagaaatagaggggattaataaataaaataattcttttagttaataagcatggaatacatatcattataagtatatctgtataggtatattgataatgataaccaaatgatattagagggtagtatgagttgtaaaaaaatatattttagggtagggagatgtttggaatgtataaaaagaaatgcgcttggtgtggagtagagtttaaatctactcagccaaatgctaagtattgttgcaaataccatgcaggaaaagctagaaaagctaatcaagaagctaagaagattaagaataaagagtaaaagggaaattcaaataaataaaatcctagtagacataaaagcataggaaatttatagaaggagatatcatgatggatataacagatgaattatgcaaagcaacttctgtaccacatagtctttgggaatttgaggacctgatgaaagacgttgggggatacaaacataagagcctggaggagattgagaatgaacataaaaaaagattacatagaaaaaacaaaagagtatctaatagatctaagaaaaaaaataaacagaaaaaacatgcttaatgaagaaataaaaatattaaaatcaagacaaagcttaaacggaggaatagaccttagtgaattagatataaaatcctcaccaggaactagagatataagcgatttaataataacttgtgatacaaagataacttcaaaagaagcccaaatagataaaatagatcatgatttaagaatgtatgaattatattcaagagatttagaaagcatagctaaaaatataatagatttaagatatttaaaaaataagaaattaaaatctttcgcaaaaatagctaaagaagtgaaatactctaagagttcagtagctaataagcatgatgaagctatagaaacattagcatattatatatatggagagacagcaatatataactaaattggaaatttagtggatatttgttggaaatttagtggaaaaaaagtggacacacattggaaaaaatatatgttaaaatattaatatagcaacggtgtataaaaaaggattaactcattgccgatctagtgagttagtccttttttaatgcaaattttaaaaataaaatataaagttttttaaagttacaatcaaaaacttaacctaatttaatcagtgcaaggtttttaaaataattaagttcaatcaattgatttaacttgattatataaaaataaaaaacttaacagtttatgtattatgtaacgttatggaggtgaaaaacattaatgtcgttcaacctattagagataaagaaaagataagagaagctttaaagtttttagaggagtggaactctaaatatcaccttatgtttttattaggaatacgtactgggcttaggataacggatatattggaactcaaagtaaaagatgttatagaaatagatagacataataatataaaaattaaatctcatatcttaaccaaagaaaataaaactaaaaaaagaaagagaataaaagttcatatagagctaaagaaagctttagaggagtttgttatagataaagaagatgaagcttatttaattcaatctaacaagaaagataagtttggagattataaacatctttctagacaaagagcctgggaagtattgaaaatagtagcagactttataggaattgatgaaataggatgtcatacacttagaaagacatttggatatcattactataaaaagaccaaagatatagcattgcttcaaaatatatttaatcattcatcacctgaaataactctaagatatattgggataacagatgatatgatggatagagcttttgataacatggagtactaaacatgagcgaagttagatttaaaaggtatatacatgacgaagaaactaataagttttataaaacatataagtggagaaagaaaaggaaagaagcattactaagagataataatgagtgtcaagaatgtaagaagaaaggcggacaacataaagctgaatgtgttcatcatattaaggagcttaagaagtatcctgaacttgcattagatataaacaaccttattagcttatgtaatagatgccataacttaatccatgaaaagcacttagccagggttaaaacaaaatttacaaatgaagaaagatggtaattaaaatttttataccatagcccccctattaaaaaaatcgactctagggtaagccgtataggtcggagtataccccggacaaaagagaaaaaatcacttttcatgtgaggggggtggcaaccttaaaaaatatagggtgcaactaaatttttcatattaaaattgaggtggtgaaatggctaatgggaaaagtttagaaaaacacgaaaaagcttatattgactatatttcaggtatgaagtataaggatatagctgagaagtataatgtaaaagtaaatacaataaaatcatggaaaagaagacatggttggtctagagaaaatgcactaaaaaaggtgtgcaaagatgcaatggtgcaagacttgggaaatattttagaaattaaagaagatatgatagaccaacttaaaagcaagggtactgatactaaagataatatccatttagtagaacagtatataaaactttgtgtgattgtagatagtttaaataaggatatagaacaaagaggtgtaaccattcaatggaagaatggggagcaagtaggatttaaaaagaaagaactggtagttgtgaaacttttataccaaattatagaataatataaaatctataaataagggagtaccattttggtactcccttttgtattttaaatctaatgatatatattttttactataatataaatatgaaattgcatttaaataaaattagaaattataattgattcgataatatctataagacaaagattgacaaaatatcacaaaatatataatattaaaaaatgattatacacaataaaataggaggcttaaataatgaatttttgggagaaagtatttaattcaataaacggattagcaggacaaaattcaacattagatagtataatgatttttacttcaagaaaagtgcctttaatattagcattaatggtagttatattatatattgttggagtgataaagaaaaatagaaatgcaagagaagtagctgtaaatacagtaatatttacaattttaaatatggttttatcggctgtattagctggtatatggtttgcaccaagaccttttgtaaacaatagttcagctaatttattataccctcataaaccaaactcatcttttccaagtgatcactcattagctagtatgagtattgcattaggattaaacgtatatagtaagatacttggagttgtatcaatatgtctatcattattaataggattttctagagtatatgtaggacatcattacccagagcatgttgtaatatcatatataatagcgattataacaagtattttatataataaattcttaagaaaaaaaattaaaaatctatatttcaatatagaaaagcgtacaccaatattaaaagatatggttaaagataaaaaataatataaattaattatacagatatggagtatcattttgatactccattttttatttaaaaataaatataaaaataattatatatattttttttataatttaaagaaagtaaataaaatataaactaaaattataataaaaccaatataaaaaggaggtagttatggagataataataaggtcagtaaaaatagaagattcacaggctataaatgaaataagaaaaatgaaaggtgtaaaagaaaataccttagcaataagttctgaaagaatagaaaaaactaaaaaaataactgagaatttagatataaataatcatatgatggtagcagaagtaatagaaaataatgataaaaaagtagtaggagtagcatcgttaaatgtaaatgcatcgccaagaataagacacagtgcaactatggcaataagcatacatacaaattatcagggaaaaggtataggaaaaaaattaatggaggaactaatagacttagcagacaactggcttatgttagtaagattagaattaggtgtatataaagacaatgaaaaagctattaaattatatgaatcgctaggctttgaaaaagaaggaattaaaaaatactcagcgataaaaaatggagagtatgtagatgaaataataatgggaagatataatgaaaagttaattaatttatacaaataaattttctttaattgaataatatattaaaagcttttagggggaatgatatggagcgcaaagttagtcttctaacaaagaattatgaatcattaaaaaatgtaaagactgaaccctgtattaaattaacactacatgaacgtgcacttaaatatacactaaaagataaatatataaattttaaagaagtaaatgaatgtacagacattataagagaaagcacttcgatattttcagattttagaggagatatctctataaatacagcaataataatatcatttcaatcacaattcaaagaaagcttagaagaaattcttaaaatacacaaaaaacttagacaaaataaattttattcaggagattctttggcactaatttcaaatatgatttttgaaaataaaaataaaatagatattgatgaatgtatagaaaaaacaaaatatgtatatgaatttatgaggaataaccatccgttttcaacatctatagatgattatatcaaggcttgtgtaatagctattaattcacaaaatatagatgaagaattaattgatatggaagaggcatatgtttatttaagtaagaatggtttttataaaaataacacactaaaaaatttatctcatgtaatttcattaactagaagaaaagaagtttgggaaaaatgcatatatgtaaaaaaggaattagaaaaaaataattgcaaatttcataaatttggatatccattgattggagttatgtcatttttagaaataaaagatatgaaaagtacaatagaaaaaataaaaaatatatcagataaattaaaaatatataggggatatggaagctttgcattagatgaaaattatagaaatattatagcaggatttttagtaattcaaaattatatatctaataaagataaaaatagtattttaataagtaaaacaattgatgatataaataaggctatgaatatagctataatgacagcaactacaagttcaataattttaaataatacatgaacttaatttatacgtataaaaagatagagttaagtaaattattacttaactctatcttttatttattattattaaagttggacattgtatacaaaattgaattagtttgataatctaaatatatgtattaaagtataaaagattattttaaaagacaataataaatatgatataataaagtttacgaaaaactggaattttaaaaggagcgtgtacataaatgaaatgggcagaaattacaataaaaacaaccactgaagcagttgaagctataactaatatattatatgagcaaaatgtaggaggagtttctatagaagatcctaaagatttcaaattccaaaagaaaaatgaatatgattgggatttcgttgaagaagaaatatttaacagcggatacgatggagttataataaaaacttatataacagaagaaagagacgttacggatgatattaaattaataaaagaaaagatagacggtcttaaagaattcggaatagatgtaggagaagctatagtagaactttctcaagtagatgaagaagattgggctaatgagtggaaaaattattacaagccaactaaaataggtgaaaaaatagtagtaaaaccaacttgggaagaatatgaaaaaactgaatctgacttaataatagaactagacccaggaatggcttttggaacaggaactcatgaaactacaagcatgtgtataagagagttagaaaaatacgttaagccagaatcaaaggtatttgatataggatgcggaagtgggatacttgcaatagcagcagcaaaacttggagctaaagatgtattagcagttgacttagatgaagtagctgtaaaagtatctaaagaaaacatagagttaaataaagtagaaggtagtgtaactgcacttcacggaaacttaatggaagttgtaactgataaagctgatatagtagtagcaaacattatagcagatataataaaaatattagctaaagatataaaacaattcatgaaagatgatgcagtatttatatcttcaggaataatacacgctaaagtagatgaagttaaacaagctttaactgaaaatggacttgaaatagtacatgtagaatctttaggtgagtggaatgctatagtatctaaaatagcaaagtaggtgaaattcatggatagattttttgtagaaaagaaaaatgtaaaccttgaaaacaacacatgtatcatagaaggtgaagatgtaaaacatatttctaaggttttaagatgtagagttggtgaagaattagaaatatgtgataatgacaacaatgaatatatatgtgaaataactaatatagataaatctcaagttgatcttaacatattaaaacgtgttgatataaaaagagaatcagatttaaaaataaaagtatatcaaggtcttccaaaaggtcctaaaatggaaatgatacttcaaaagttgactgaagttggagttgatgaaataatattagttcaaactaaaagaactgttgttaaagtagatgacaaaaaagaagataagaaaatcgaaagatgggaaagaataatctatgaagcagctaagcaaagtaaacgtggaaaaattcctaaactaagaggagttttaagctttaaagaagctttagctgatatgaaagaaaatgactttaacatagctccatatgaaaatgaaaaaacaaaaacgataaaacaagccataagaggcaaagacataaataatataggtattttcgtaggaccagaaggtggatttgaaggtactgaaattaatgctatagaagaaataggtggacaatcagtttctcttggaccaagaatattaagaactgaaacagcatcacttgtagcttcatctatagtattgtacgaattaagtgacttaggaggaggcgagtaaagtgaaaaaggtagctttttatactttaggatgtaaagtaaatcaatatgaaacagaagctatgcttgagatgtttaaaaaagatggatacactcaagtagatagtgaagagtttgctgatgtttatgttataaacacttgtacagtaactcatatgagtgatagaaaatcacgtcaatatataagaagaatgaaaaagaaaaatccagatgcaataatagcagttgttggatgttattctcaagtttcaccagaagaaatacttgaaatagaagaagtaaacttagttatgggtactaacgaaagaagacaaatagttgaagaaattaaaaaacttgatgcttctaaaaaagctagtacagttgatgatataatgaaagttagagctttcgaagaaatagaaataaatcaaactaatggaagaactagagcatttatgaaaatacaagatggatgcgatagattttgttcttactgtataataccttatgctagaggtggtaaagtaagaagtagagatttagaaagtgtagtaaatgaagcaaataaattagttgataatgggtatacagaaatagttctaacaggtatacacgttgcatcttacggaaaagatgtgactgatgcagaaattaatttattaagtgttataaaagctataaatgaaatagaaggtgtgaaaagaataagattaagttcagttgaaccacttcttatgactgatgaatttatagatacagtttctaaaatgccaaaagtatgtccgcattttcatttatcacttcaaagtggatgtgatgaaacactaaagagaatgaatagaagatatacaactaaagagtataaggaaatagttcataaattaagagaaaaaatgcctaatgtagcaataactacagatgtaatagtaggattccctggagaaactaatgatgagtttaatcaaacttataagtttttaagtgatgttgaactttcacaaatgcatatatttaagtattcaccaagaaaaggaactccagctgctactatggaaaatcaaatagatccacaaatgaagcatttaagaagtgacaaattaatagctttaaataagaaaaacttcaataagtttgcaactaagtttataggtgaagaatttgaagttttatttgaacaaaacataggagataacaaatacgaaggattaactcctaactatataagagtagtagttgaaagtgatgaagatatacaaggtaaaatactaaatactaaaatatctgatgtaaaagatgaatacgtagaaggaattttagtataatatgtagaaataaataatataacagatgggaggtgtaagtatgagttgtatattttgcaaaataataaatggagaaataccatcaaataaagtttatgaagatgataaagtcttagcttttaatgatataaatccagttgcaccgtttcatgttttagttatacctaaaaaacattacgaatctatattagatatagatgataatgatatggaaataattgcacatattcataaggttattaataaattagtaaaagaaaagggatatgataaaactggatttagaataataaataactgtggaagtgatggatgccaagaagttaagcatattcactaccatgtattagctggaaagaaactagattggtacgacgcttgtaaataagtttttataaattaaaattttaactgtattattcataaaaatacttgaaaaattaaaaaaattagtttataataaacaaagtgtgaggttgtaatgcatattatgcagatataatcgagttacagtcccagcataatttgcgctatcggagggagggaaaaagaatgtcagaagtaagagtaagagaaaacgaaacattagacagcgctttaagaagatttaagcgttcatgtgctatgtctggcataatgtctgaagtaagaaaaagagaacactatgataagccaagcgtaagacgtaagaaaaaagctgaagctgcaagaagaaaaaacgctaagaaataatttttgtagataagaggtgaagggatatgtcccttaaagcaaagttgcaagaagacttaaaacttgctatgaaaaacaaagatacagttaaaaaatctgttgttactttaataagagctgcaatcaaacagcaagaagttgatactagagtagaacttgatgatgacgctattatagacgtaataacaaagcagttaaagcaacgtagagatgctatgactgaatttgctaaagcatcaagagatgacttagttcaagaagctgaagctgagattgaagtattaatggaatacctacctcaacagctgagcaaagaagaattaaatgagatagttaaagaaactatatctgaagtaggagctacttctatgaaagatatgggtaaaatcatggcagctataaaacctaaaacaaaaggtagagctgacggaaaaatgataaatgagttagttaaatctaacttacaatagattaaaaagcctagagcaaaagctctaggctttttgctttgtccaaaaaaatagtaataactttaaatatttgtacatatttataaattaagtatagataaggaaagggtgaattcattgattgtatctgcaaaagatataaaaaaatttatagtaagtgttttaataccgcttataataggtttctcaagtaattttatagcagagattataagtaaaacagattcaaatattcagtacttagagttaataaagccaggatttttccctcctccatacatatttcctataatatggactattttatatatacttatgggaatatcagcatatttagtttctaaaaaagatttaaactctcttaaagttagagatgctatgttttattactatttacaactaggattaaattttatatggtctatattattctttggattaggacttagacttacatcactagttgttataggaattatgatagttgtggttatggtaatgataattaaatttactaaagttgacaaaagagcggcttatttaaatctattgtatttagcttggttattttatgctttctttttaaattatgttatatggtcaataaatagataaaaaataaaagccgatctggctttattttttattaaataaaaagtccccaaatttatatttagtacatagtattatatatagtttacttattaatacaagtaattaaaattatgaatatacatagaatatattaagggggtataagtatgatagaggttccaactgatttacaggtaaatcagccaagtgtaactatattgagcaattcatttataagtatagaaaactataagtctattcttgagtatgatataaacttaattaaaataaaaactaagataaatactataaaaataagtggagataaaatgtatctaaagtacattacagatacagaaataggaataaaagggattatatatagtgtagaatacactacataagggggagttacttttgataagttatattaggggatactatgtgataactgtagagggtataaatactgaaaagtttttaaatattcttataagaaacaaaataaatatatatgaagttaaacgtgtaacaaatactaaaattgaaattaaattggatagaaaagatattaaagcttttaaaaaaatatatagaaatagtaaatatgatattaaagtaaagcaaaaaatgggattaccttttttagctaaaagaatatataaatataagggaatgtggatttgtgccataatttccttattaattttaatgagtacatcgatgtttgtaacggatgtttatatacaagcaccagaaggcatagataaggtgcttgtaagaaaagaattagaaaaagctggcgttaagcctggggtttacaaaaaaagcatagatagaaaacaagtaagagatattgttatgggaaaatttgatgatatagcatacgtttctataaatgtaaaaggaactaatatatttgttacagttactaaaaaagatgagtctctaaaagagaaaaaagaaaccaattattgtaatgtaattgctaagaaaaatggtataatagataaagtaataccaagaagtgggaatcaggtagttaatgttggagatatagtaagagaaggtgatgtattagtttctggagctaatacaaagtctatcccagaagtttgggctgttactttttacgaatctaagcaaagtgcaagttacatagataaggtaaaagtaaaaactggaaacaaaaaaactatatatactcttagattttacaataaaaaatatacattaagacgaaatataaattataaaaactatgaaatagaaaataaagattatgaattaaaaattggagattatactttcccgttaaaaatacaagctagcactttttatgaagttaacataaaagaagtaaaaagagacaaaaataaagttaaaaaagatttagaaaaaaaagctcttaaagatttagaatacaacatgccagttgatactagaataaaagatgtagaacatcaacataaagtaaaaaatggtaaacttgaatacatattaactgttaaaactttagaaaatatagctaaagtacattctttaagtaaatcagaagcagaggaattaataagacaagaaaatgagaaaaaacaaaaagaagatgaagcaataccttcaaatccacaaaaaagacctataaatgacataagaaatgaatttgaggatataaataaagataaggacaatgaaaataaagataaaaataaaaaggaactagaaacaagggataactaaggaggacataaattgatagtacaaaagagttttgaaataactgatgataaatttgaaagagaattatttggaaactttgatgaaaatatacaaatcatagaaagaagtttaaatgtagatgtacttttaagagaaggtaatatagtcttaataggtcaatctaaaaatgtagacaaaactatagaatttataaatgaactatataagaattttaaaaaaggcaaaactctagataaacaaagtattaattatgctatatcactattaatggaaggcaataaagagcaaatagaagaactagaagacactatagcagtaactaaaaaaggaagagaagtaaaaccaaaaacaatcggtcaaaaacactatataaatcttattagaaacaatgatataactcttggtgtagggcctgcaggtactggtaaaacttatttagctgtagctatggcagttagagcatttaaaaaagatgaaataagtaggataatactaacaagaccagctgttgaagcaggagagagtttaggatttttaccaggagatttaaaagataaagtagacccgtatctaagacctttatatgatgcattatttgatatgctaggagatgaaaagtgtgctaaatacctagaaagaggtataatagaagttgctccattagcatttatgagaggtagaactttagacaatgcttttataatactagatgaagcacaaaatacaactccagaacaaatgaagatgtttttaactagacttggttttgggtcaaaagctgtagttacaggggatttaacacaaatagatttaccaagtaaaacaagaagtggtcttatacaggctatggatgttttaaaagatgtagatggagttggtataaataagtttactgaaaaagatgttgtaagacatgaattagttcaaagaataataaaagcctatgaaaagtatgatgaaaaacaagaagaaaaaaagatatctaaagaagaaagaaacaaaagaaagaaataggagatgcattatggaaattatattagacgacagacaagataaaataaaagtaagtgaagaccttttagaaaaaatacatgatataatagtagaaactctacattatgaagggtatgatgataactacgaggttagcttatcttttgttgacaatgaagaaatacatgagttaaataaagaatttagaggggtagatagagctacagatgttttatcttttccacttttgacagatgagtttgatgttgaaatagaagacgaatctttaggagatatagtaatatctttagaaagagcattagaacaaagtgaggaatataatcatagctttgaaagagaagtatgctttttagtatgtcatagtatgttccatttattaggatatgaccacgatacagaggaaaatactaaggatatgagaaaaagagaagaagatgtattaaataagcttaatataacgagggagtaaatttatggggaagaaaaaaggtaagcaaggcataatagaagcttttaatgctgctattgcgggaatattatatacctttaaacatgaaagaaacatgaaaatacattactttgtagctgtattagttcttactgctagtttattttgtgaatttaacagatttgaaatgattcttttactttttactataagcttagttgtaatatctgaaatgtttaatacagctatagagaaaactgtggatatgataactgatacttatcatccgctagcaaaaattgcaaaagatgttgctgcagggggagttttaatagcaagtttaaatgcatgtgtagtaggatatttattatttgttgataaacttgaaagtttaggaaacacagtatttttcacaattagaaaatcacctatacacgttactttaatatgtatagtattggttttaatagctgtagttgtagtgaaatcactaacatctacgggaacaccattgcaaggtggtatgccaagtggtcactcagcgcttgcttttgcactagctacacttgtgacatttatgacagaaagagttgtcgcttcaactcttgcatacttaatggcaatactagttgcacaaagcaggatagaaggcaaaatacatactttttgggaaactgtagctggagctttacttggagttttagtagctatgttagttttacaaatagctcaatattagaaagtgggagatttattcccactttttttgaaactaaatataaatttactttgttctttttttctattttggtataatgtaatatactacttgaaaatattaagggacagataccttactgggaggttaaatatatgaacaataaagaattattagaaatagcagaaaaagcaagagaaaactcttattcaccatactcaaactttaaggttggtgccgcacttttaactaaaagtggaaaagtatttacaggatgtaatgtagaatgtgcatctttttcaggaacaaactgtgcagaaagaactgcactatttaaagctatatctgaaggacacaaagatatagaagctatagcaattgcaagcattaattcagaaaaaaatgaacctacatatccatgtgcaatatgtaggcaagttataatagagtttggaccaaatataagaataataactggatactcaaaaggagatatacaagaacatactatcgcagaattaattccacattatttctcaggtagtgactttaaataaattaaaaaagacaaaagacaagttgaaaagaggaattgaaatgtttaaatcaggatttgttagtatagtaggtagaccaaatgttggtaaatctactcttatgaatagtgtagtaggagaaaaaatagcaataatgagtgataaacctcaaactacaagaaatactattcaagcagtgtacacagataaagaatgtcaaatagtatttttagacacaccaggtatacataagcctaaaaataaattaggtgagtttatggtaaagtcagcaacagatgcatttaaaaacgtagatgtagttttatatgttgttgatgagtctaaaaaaattggaccaggagacagaatgataatagaaagcttaagaggcataaaaactcctaagatattagtattaaataaaattgatatgttaagtgaagaagaattatttgacttaataaaaatgtatgatgctgaaaatatgtttgatgatatagttccaatatcagcattaaaaggaaaaaatacagatagattattaaaagtagtagaaggatacttagaagaaggacctcaatacttccctgagtatatgattacagatcaaccagaaagagtattaatatctgaacttataagagaaaaagtacttcactatgttcatgatgaaatacctcatggtgttgctgtagaaatagaaagaatgaaaaaaagacctgataaagatataatagatatatctgcagttatatattgtgaaagagattcacataagggtataataataggtaagaatggaagaaaattaaaaggtataggaaagtcagccagagaagaaatagaattattattaggttctcaaattaaccttcaaatatgggttaaagttaaagaaaactggagaaacctgcaaagctttataaataactttggttatactgataaatagtaaaaggtgggttttatggataggaaagacgaacattccaaggagctattaaatcaagttgaagatttaatagacaataataagatattagagctaagagaattaatggaagagtatcataatagagatatttttgatattctagaaaatttagatgaagacaagcaaataaagctatttgaaatattgccaatagacatggcggcatcaatacttgatgatgctgattctgaattttttaagtatattctttcaaagctaaatacagagcataaagctaatatactagaaatgatgtcattagatgatatggctgatatattagctgatttagaagaagatgaaagagaagaagtaataaatcttttaaatcaagaagatgctcaagatgttaaagaacttcttatatatgaggaagaatctgctggaggtataatgactacaggctatatagctataaataagcatatgactgcaaaagaagctataagctatatgagagaaaatgccatagatgcagaaactatatactatatatatgtagtagacaactttgaaaaattagttggagtattatctttaagagagcttataacttcaagggatgatagtataatagaagatttaatgagtgaaaatataatctccgtatatgtagatgaagatagagaaaaagctgttaaattagtttctaaatatgatttaatagcaatacctgtagtaggtagagatgatactttaagagggattataactgttgatgatgtaatagatgttatagaagaagaagctagtgaagatatgtataagtttgctggaacatctgagcaagaaagagatataatagagcaaagcaatgtagatcctaaagatcaagttatatcatcttttaaagctagaataccatggcttatagtaaccttattaggcggtcttttatcaactttaatactatcaagttttgattatgtaattgattcaaaatatttccctttaatatattttgtacctgtagtaacaggtatgggtggaaatataggtactcaagtttctgcacttactgttatggcgctatctaataagcacttagattttaaaaatgttttattagaaggattagttggggtattaacaggaataatttgtagtttaattttaagtataactacttatgtttttgtcaaggatataaatatcgttttaatagtttctttatcactttttataaatatgataattggagctatgttaggatcttttgttcctatgatattaaaaaaaatggatgcagatccatcaatagtatctgccccattaattgctacggcccttgatataattggaatgatgatttattttataatcacgacaattatattggcaaaaattgtctaacaacttaatgcattttttccccctttcttactaaagatataatataagcgtaagaagggggtttttaaaaatgaacaatttatgttgggaagtttttaaaaagacaggaagtatagaagcatacctatacataaaaaataaaactaatataaatgaaataaatgataatataaatagggagatagaaatcgactatgataattgtaaacacccaggggatagtactacgatcagcgagatataaagaaagcgatttaatattaactatatttacaagaaaacttgggaaagtatcagctatagcaaaaggtgctaaaagaaataaaagttctttgttatcatcgtctcaagttttctcttattctaattttactttaaaaaaacaaggaaatatgtatagagtaagtcaaagtgaaactattaaaagcttttatgatatagcttatgatatagatgctttttcatatgcaacatatataacaagcttagtagaaggatctatatatgaaaatcaaagcaataataggctatttgtactattagcgcaaactctttatttatatactcaaaaagatatagataaagaatttataacaaaagcatttgaactaaaatttttagattatgcaggatttaaacctattgtaaatagatgtgttaactgcaataccactaatcttaaaaacagtgtatttaatgttgatgaaggtggtatactatgtgaaaagtgtaaagaaaatcatgtatataattttaaaatagatagcacaaccataaagcttatggattatgtatttagaaacgacataataacttgtagtaaagcaaaggtatctaaatatatagtaaatgaactagacaaaattttaaaagtatatattcaagtttacattgacaatgtaaatataaaatcgttacacttatttcaaggaatagaaaataataagggagctgataataatgactgatataacattagaaaaaatagatcaagtattagaaagagttccaagtgcaagttacaaagaagccaaagaagccttagtagttacaaatggaaatatagtagatgcaataatatatttagagcaaaacaaaaaatctactaaagtaaaagctaaagctaaagaaaaaatggaaaatgctttaggcaaagatgcagaagaaatgaaatgtcaactaaaagagatgttaaaaagaagtaatgttataagaataatagttgaaaaagacaacaagacaataatgaatatacctttaacagttggagttgttggtttagctttagggccattagtcacattagtaggactttcagcagctgtaataggtaaatttaatataaaagttgaaaatgaagaagataaaacagttgttgatttaggagaactaaatgaagaaaaactgaatatattaaagaatatgttaactagtactgcaaaggaagttactggtgtagttaaagaaaagaacaaagacgacaaagatataactgaagagttaataaaagaagaagatgacaatgtaactaagtattaaaaagcattgacatacactagcttaagaatattgacaaatttcaaggattttgatattctaaaagttagaaaataaccatttaatggcctttcgtatagcacgaaaggctttgtttttagtataggagggtattcgtatgaattttcaaaatatgatactaacattacaagattattgggctaagcaaggatgtataatgatgcaaccttacgatgtagaaaaaggtgcaggaacaatgaatccaaatacatttcttagatctttaggtccagaaccttggaaagtatgttatgtagaaccgtctagaagaccggcagatggtagatatggtgagaatcctaacagattatatcaacatcaccaatttcaagttatattaaagccatctccagataatatacaagaattatacttaggaagcttagaagctataggaatagatacaaaagcacacgatataagatttgttgaagataactgggaagcaacagcagttggtgcctggggacttggatgggaagtttggttagatggaatggaaataactcagtttacttacttccaacaagttggtggtatagagtgtgaacttgaaactggagaaattacatatggactagaaagattagcaatgtatcttcaagaagttgaaagtgtatatgatttaaaatggaatgatgaaattacatacggagaagtgttccaaagagcagaatatgaaaactctgtatatgcatttgaagagtgcgatgcagatttattatttaacttattcgatgtatatgaaaaagaagcattaaaacttatggaaaaaggattaataactccagcatatgactatgtgttaaaatgttctcatacattcaatactttagatgctagaggagcaataggtgtaagccaaagagcttcatttataagtagagtaagaaacatggctagaacagtagctaaagcttacgttgaattaagaaaagaaatgggatatccacttttaaaggaaggtgacaagtaatgaataattaccttttatttgaaataggtgttgaggaattaccagcaagatatgtaaattcatcaatggaacaattaaaaaataatgttgttaaagcatttaatgaaaatagaataacttttgataatgttaatgtatactctacaccaagaagattaactgttatagtagaaaatatttgtgaaaaacaatcagatttagaagaagaattaaaaggtccagctaaaagaatagctgttgatgctgatggaaacttcactaagcctcttttaggatttatgaaaagtaaaggtataaaggaagaagatttatactttaaacaagcaggaaaagaagaatatgcttttggtaaaataaagcaagaaggaaagttaactagtgaagtattaaaaactatacttccagaggttataaaatctatgacattccctaaagctatgcgttggggtggaaagaacatgagatttataagacctataagatggatggtttgtatattaaatgattcattacttaacatagaattagaaggaatagtatcatcaaatgttactaaaggacatagattcttaggacaaagtgaatttgaagttaatactttagatgagtacttaactaagttacaagaaaactttgtaatattaaatcaagatgaaagaaaagaacttataaagaaacaatgtgaagatgttgcaaaatctttaggtggagaaatagaatttgatgaagaattacttgaagaagtaactcatctagtagaatatccaacagctttctatggagagtttgatgaagattatgctaaacttccaaaggaagtggtaataactcctatgaagcaacatcaaagatatttcccagttttaaaagatggaaaattacttccaaactttatagctgttagaaatggggacagccataagatagataatgtaaaaaaaggtaatgaaaaagttctagaagctagacttgcagatgcattattcttctacaaagaagatactaagaagcctttagaagattacatagaaaaattaaagactgttgtattccaagctaaacttggaacagtatacgataagtctttaagaatagaaaaattagcaaatgatataatagatagattaaatttccaagatataaaagaagatacacttcgtgcagctaaattatgtaaagcagatttagttacaggtatggtgtttgaatttacagaacttcaaggaataatgggaagagaatatgcaaaagtaagtggagaaaatgaaaatgtagcagaagctatattcgaacattatttaccaagatttgcaggagatatactgccaaaaactaaccatggagttatattatcaatagcagataaattagactctatagcagggttctttgcaataggaatacaaccaacaggatctcaagacccttatgcacttagacgtcaagcattaggaataataaatatattaatggataataatctagatataagtttaagagaacttgtagatttaactttagataactactcatttatagagtttgacaaatcagaagttgcaaatcaaataatggaatttttcaaagatagaataaagaatctatttagagacttaggaataagatatgacgttatagatgctatattaagctctaatatagatgatatagcagatatgtatgctagagctatagcactaaactcatggatagataaagatgagctagttgaaatgttaacagcatttaatagagttgcaactttagctgagaaagctgaaactaatgtggttaacataggcttaatgagagaagaagctgaatttaatttatatcaacaattccaagaaatacgttctaatgttgaatatttattagctgataaagaatacactaaagcacttgatgcctttgcatctttaagaccagcaatagataatatgtttgactctgtcatgataatggacaaggacgaggctataaagaataacagattagctatactaagacaaatatatgatacaatgttaaatatttgtgacctatctaagatagtatataagtaatctgcttaaatgaccgagggaatttttcctcggtttttatatctttataaaaaatatatttaattttctttttaaactaaatataaagttcaacttattaaatttaagtaacatacctattttaagccacttatggataaaatattttaggtatttagttaataattaaaataaattttaatttctgtatttacattatactataaaaaatatataatatactatataaagataaatgaataaatagtatatcacaataatgaggagtgtgattattattcaacttaataatagacaactaaagataattgatatagtaaaagataatgagcctataacaagtgaaagtatagcatcaatgcttaatgtaactagagctactttaagatctgatttagctattcttacaatgacaggtgttctagatgctagaccaaaggttgggtatttttactcaggcatagataaagtcaacttattaggcgataaaataaaggaaaaaactgtagcagatataatgagtatgcctataatggtaagacaagatactaatgtatacgatactatagttaatatcttcttatctgatgtaggtagtatatttataatagataacaaagaagatctatgtggaatagtatcaagaaaagatttattaaaagcaactataggtggaggagatataaataaaataccagtaggtatgataatgacaagaacacctaatgttgtaacagttaaagcgaatgatactgttgttttagcagcaaagagaataatagaacatgaagtagattcaattccagttgtagaagaagtaaaaaaggataatgaaacaataaataaggttgtaggtagaatttctaaaactagtataacaaaattatttctagaaatagcagataattaaggaggagtacatggagaatttagtcatatatgtaatatcagactcagtgggggaaacagctcaacaagttactaaagctgctatatctcaatttcaactagaggatgactatgaaataagaagatttccttatgttgtagaagttaattttttagaagaaatattaaaaagtgctaaagaggaaaatgcaatagttatatatacattagtagaacaagaacttttagagtttactgagcaatattgtgaaaaggaaaacttaagttgtgtagacttgatgactccaatattaaaacaaataactaataaaataggtgttacaccaaaaagagaaccaggcattataagaaaattagatgaaagttattttaaaagggttgaagctatagaatttgctgttaagtatgacgatggaaaagaccaaagaggaattttacaagctgatgtagttttattagggatatcaagaacatctaagacaccacttagtatgtatcttgcaaataaaaatataaaggttgcaaatgtacctttagttccagagataccaatacctaaagaagtgtttgagataaatcaaaagaaaataataggacttactaatactccagagaagttaaatcaaataagacaagaaagattaaagtctttagggttatcaagtaatgcaaattatgctaagtttgatagaatacttcaagagttagattattccgataaaataatgaaaaaagtaggttgtccagttatagatgtttcaaacaaggctatagaagaaacagcaggtattataatggatataatgaaagaaaacggacttaagatatttaaggacagtgataaataatattttagtgcacatcgaaagtaaattgattttcggtgtgtattataaatcttatttactacattaaattttattaaaagtgtatagtaaggtttttatgaaaagttaatatttagggaagcttttaattaagcatttttaagttaatatctaaaaatattattttgatattaattatatattttagacacaacaaagctaattacatttgaatataaatataaaatacaatttcatatttatatctagaaaattatatttaggaggagttttccatgagtaagtttgtttatagttttggtgagggttcaaaggaaatgaagagtcttttaggtggtaaaggtgctaacttagccgagatgactaagataggcttaccagtacctccgggatttactatcagcactgaagcttgtaatgattattataaaaataatgaaaatataagagaagatataatagttcaaatagaagaaaagttagttcaattagaaaaatctttaaataaaaaattaggatgtaatgaaaatcctttattattatctgtacgttctggagcagttttttcaatgccaggaatgatggatacaatactaaacttaggattaaatgatacatctgttaaggctttagctaaaaatactcaaaatgagagatttgcttatgatagttatagaagatttatacagatgttttcagacgttgctatggaagttccaaagtacaagtttgaaaatgctttagatagaataaaagaagaaaaaaattataaatttgatacagatcttactagtgaagatttaaaagtcttagttgaagagtataaaaagatatataaaaaagaattaagacaaaacttcccagaagatccaaaagagcaattaatgttagctataaaagcagtatttaagtcttgggataatccaagagctaatgtatatcgtaaattaaatgatatacctcataatttaggaactgcagttaatatacaatctatggtatttggtaatatgggagaaactagtggtacaggagttgcatttactagaaacccatctactggggaaaataaattattcggagaatatttaataaatgcacaaggggaagatgttgttgcaggtattagaactcctcaagatatagaaactttaaaagtagttatgccagctatatatgatgaatttgttaagataactcatatacttgaaaatcactacaaagatatgcaagatatagaatttacaattgaaaatgaaaaattatatatacttcaaacaagaaacggaaagagaactgcaaaagcagctataaacattgcagttgaattagttgaagaaggaataatagatgaaaaagaagctataatgagaattgaacctaatcaattagatcaattacttcatccaaactttgaagaaaaatctttaaaaaatgctaagcttatagcaaaagggttaccagcttctcctggtgctagttgtggtaaagtatattttaatgcaaatgatgttgttaaagcagcagaaaaaggcgaagaagttatacttgtaagattagaaacttcaccagaagatatagaaggtatggttgtagcacaaggtatacttacagctagaggtggaatgacatctcatgcagcagttgtagctagaggtatgggtaaatgttgtgtagctggatgtggagaaataaaagttgatgaacgctacaaagagataactgtagatggtttagttataaaagaaggagattatatatctttagatggatcaacaggatgtgtatacttagggaaagtagaaaaaactgatgttgcacttactggaaactttgaaactcttatgaactgggttgataagtataaaactttacaagttagaactaatgctgatactccaagagatgcaagtgttgctataaaatttggagcagaaggtataggactttgtagaactgagcatatgttctttgatgaagatagaataccagcagttagagaaatgatattatcaagaacattagaacaaagattagtagctcttgaaaaattattaccaatgcaaagagaagactttacagaaatctttaaagttatggatggaagaagtgttaacataagattattagatcctcctctacatgagttcttaccacatgatgatgaagcaatagaagctttagcaaaaactatgggacttgaagtaaaagaaataagaaaaagaatagttgacttacaagagttaaacccaatgcttggacatagaggttgtagacttgctataacttatcctgaaatagctatgatgcaagcaaaagctataatacaaggtgcaatagaagctaagcaaagtggtatagaagttaatcctgaaataatgatacctttagttggtgaagttaaggaattaaaaactataaaagaaaatgttatagctgtaatagaagaagaattagaaaaatcaggagttaaagtaaattatacagtaggaactatgatagaagttccaagagcttgtttaacagcagatgaaatagctagtgaagctgactttttcagttttggtacaaacgacttaactcaaatgacatttggatactcaagagatgatgctaataaattcttaggtgagtatgtaaatagtgaaattttagaaaaagatccattccaagttttagatcaaaatggagttggtaagttagttcaaatggcagctaagttaggtagaagcgttaaaccaaatcttaaattaggtatatgtggagaacatggaggagagccatcttctatagagttctgttataaaacaggattaaattatgtatcttgttcaccatacagagtgcctattgctaggcttgcagcagctcaagcagtgataaaaaataaataaaatttatataaaacaagaggaattggactatccaattccttttttatttgtttataattacttttagaaacttatatcacaaatataacatttaccatattatatattattaaaatttatatatagtatattggggggatagttatgattaagtgtccaagatgtggaaaagaagtttcgaataggccaggaactgtttgtccaagatgtggtcttgatgtaggaagggtaactgaaaaaataagatgtccagaacctagttgtaaagctttagtttctaaaaagttagaatattgtccaaagtgtggatgtaaattaaaaggatataacttaactgagatattaaaaatagctaagatgagatttaatgggactttttctgatgaagattaaaagtagtcttaaaaactctttttaagttgcttaattttaaaatatatgattgtgtacaaatagtaacaaatttatcaataaagaataaaatgtaatataagattaaatagaaaataattttaagtatgtaaaaccaagtagggggtttttagtatgacagaaaatatagttacagcaaggttaaaaggaagtggcgtagatattataaagaaaaaaataatacttgcgtcaccagataaagatgcaattataaaaattacagatagaaaagatgagataataattgaaagtgctgaagtagttaaacatggagattatgctatagtaaaaggatatttaaataaaagcataacttataatacagctagtaaagaacaatttaaaaaattaataggaaatgaagaagataaatatgttaattatagatcattgtcatcaaagttagaaatagttgtagctgatggagttgtaagacatacaacaacatggattccatttgagatattagtttttatagaaggagctagtgaagacgataaagtaattattgaaaataaatctataaaatctttatgtgataatgacgaagaagttaaagataaatctataacaggaatattagtacaggatataattaatatagatgtaactgtaataaagcagggggataattatggccaagaattttgaagttacagtaaaaagaaaacaggatcaaaatgattatattgaagatgtatcaccagtaagtataggaaatgacttagttatagatgaagaaacaaaagatggtataattaataaaatacgtagtgtatctagtgagttaagtgaaatagagaatattgaagagaaaatagaagaaaatgaaattaaccagaaagataaagttgaggagaaagaagaagatataaaagaaactgaaatcatagaagaagaaaaagaagaatatatagaagaaagaaatgaagaaagtatagaaaaaattgaaactaaaaaagaagaaatagaaaatagtgaggttagagaggaagaaaatacagaagtatcaactgaaaaagatatagaatatgttgagattgcagaagagaaaattaaagaagatacagaaaaaattgaaattaaagaagaatatatagaacatgttgaagaatcaaaggaagaaagtatagaagaaattagaaaagaagagcctaaaaataatgaagaacagttagaaagttttgatagaaatgaatttcgtggaaaatgtagggtatatagaagtaaaaaaataaatattgataaacctaaagaagatataatagttaaagtcggaaatatagacagaagcatgtatatagaaagtgtagaaatgttaaaaggtggagctaatattgtaactatggttgtagaaaatataacttattatacttctaagccattatcaggtaaaaaagatgaaaaagaatataaaagaaatcaatctatatgcaaatcctatgaaaaagaatgtatatgttttgatggagatgttagaaatacaacagttataacaccttatttaatttatatggatgtagatggtgcaacagaaattgatgattatgaaatagagagtgcatcattaaattgcataaacactaaatatgtactagataatggagatattattgataataatagctcattactatttagttatatagagagtttggtacaagagtatgaaataactataaatatagcagtaaagtaaaatgatataaaaaagagtatctaataaatggaagatactcttttttattttatatatttattgcatagtaaattaatttttaaattatattacaaaaatgtaatataggtgtaaggttattaaatacctttcatttttattttaagataaactgtacttagaataaaaatgggaggtatttttatgataaactttaatgcatttgaattaaaaatgattgcgcttgtacttatgttaatggatcatttatatatggcttttccaaatgcattttcagcgtggtaccatcctttatcaagggtagtagcacctatatttggatttttattagtagaaggtttattttatactagaaataagttaagatataatattcgattatttggatgggcaatatttatgcaaattggaaatgttataattaatatagttttgaaatcaaaagaagtatctgtttataataatatatttttaacgttagcattagggcttactattataaatttaatagagtttagtaaaaaaagagaaggtagtaaaaagataatgattttattacctgcaatatctttaataccattgtgtttgtttacagaagatggaatagttttaataccatttatattaataacgtatttatttagaggaaatatgaaaaagcaaatgatattatatacaattttatctgctttacttttctttacaagttatactcaatattcaactataaatgaaactatagaaatgttgatgtttaactcagatttcttatttatattagtagtaccatttatacttttatataatggcaaaaggggtataaacaataaatttagtaaatatttattttatatattttatccactacatttatggctaatagctatattacaatttaggtttaaatattaatagtttcttgatatttcaagaaacttattttattatatttttaatatataaagtaaataagtttgtgaggataaaatatggatagagatttattaatagaggaaactaaaaaatttgttaaaagtaaattatttggagaaggtagtgggcatgattggtatcatatagaaagagtatataatatggccaaatttataggggaaaaagaaaaagcagatagctttatagttgagatgacagctttacttcatgatatagatgattggaaattttctgatgataatgaagttgtggaagtatttttaaattctattaaagtagataaaaaagatatagacagtataattaatataataaaaactatgtcatataaaggaggagtagttgattctactcaagatactatagaaggaaaagtagttcaagatgctgatagactagatgcaattggagcaatagggattgctagagctttttcttatggtggaaataaaaatagaattatttatgacccagatattaaacctattaagtttaatgatttagatgaagtaaaaaatgctaaaaatcatacaattaatcatttttatgaaaaattattaaaattaagagattttatgaatacagaaacagctagattaatagcaaataaaagacataaatttatggaagaatatttaaatgaattttattatgaatggaattttaaaggggagtaacaatttgttactccttatttttaaaaaatatgattattaattagtataactgattaatttgtctagtgctggcttatatttataagatgcagaaaggttaaaatatttaatagcattttctaagttattagataactcataaaaaattcctaaattaaaagctgctaagtaactacctgtaccttcaactatttcataatccaattgcaatgcatttaagtaacaaatatctatgttattaaaataagatatatatttatttgaatcataagcaactaattctgtaaaaaacaaaccacaaacaaagtaaaaatcacaacaatcactcataaaatcaaaagtattttcaataaccattaaccctttttcaagttcattaactttaattaaattatataaataaagaattaatccatctttaacgaaatcataatcataagaagaaagattagagtagaacttatcaaaataaaaagaagcttctttatacattttattagagtaatatgtttttgcagcttgatataataaatatatatcattttcagactcctttaattcattaagtataagatctatatttcttttaaatttatctgtatataaataaccatcatgttctacttcaatatcaattttttttctaggcaaagtagaatctaattgttcatgaatactacctgtaaaataaacaccttttggagcaagccttgaaataaaagaagtagattttcttatttcattttcttgttcaaataagttaactatttttatttgacctataaatttattattactatttaaaatcttataaatactatcaaagtcaatatttgaaataaattcatctgcatctaatattagattccaatctgaattagatctttttaaaccaaaatttctagcattggaaaaattgttatcccatgaataatcatatacagtagctccaaattctaaagctatgtctttagttttatcagtagagcctgtatctactattattatttcatttactaaatcttttactgagtttaaacatcttcttaacttggattcctcattttttgtaatcatgaccaaatttaaatttttcaatatactatcctccattacctgtaaataatacagtaattatacggataaaaaacaaaagtattaagctttgcattcatttaaactttgaagaattctaaattttaatttaaccttgaataaatccccatctatatctaactcaagcttaccaccttgcatatcaactaaattactagcaatagaaagccctaatccacttccactagtatttcttgaaacatcaccacggacgaatcgttctaataattcatcaggtgatatatttaatttatggttagaaatatttttcatagtaattaaaacgtaaccacaatctgtatatacatctacatatactcgagtatttggtaaagaatacttaactatattagaaataagattatcaaatactctaaacattcttttaccatctatattagtaaagatatgcttatttggagtgtttattacaaaatctaatttagaagattctattttatcatcaagttctacaatactttgaataagaagttcttttatatctgttttttcaaaatgaagttctatatcaccactactaatcttagaagcttcgaaaatatcatctactaaatttttaagtctttgtgattttttatctaaaatacttaaataatcattagtagtttgtttatctaattcattattttttaatatatctatatagctaataatagaagtaagtggagtttttaagtcatgacttacattagttataagttctgttttcattttttcatttttaagttgactttctaaagctttatctaaaccttcaccaatattgttgacactagttgcaatagaagctaattcatcgtttcctataatatctaatttatactttaaatccccattttctattttttttatattgcgttctagatattcaatgtaatcaattttttcttctatttttttataaatatatgaatagcatataatacttacaattgatagataaatagctctagttaatgcatatattggccaatagtctaacattattattgtaaaaaaaacgaaaaaaaactgaattaatacagcgattacaaatgctattgatatttttttttgctaaagtgtttttgtcttttttagaaataaactttttcactaggtatatagaaataaaccttgacttaatattatttctacttgagtaaatactaataaaagaaagataaaatatccacagaattatggtatttgctataattaaatctgtatcataaaattcataagttcgcttccaaacgcaatatctagtaaaaaaaacaaatattatacaagttaaaattatttcaatagatacaaaatttactaatctaattgaagaatttataaattttatattagacttgcggttaggcaaataaattataaaacaaattaatgctattatagaagtcgtaaaagctatatgtttttggattattaaaagttcagttctggaatactcaaaaactggaccaaataagtagtacttagccatatgatatgtagtagaaaaacctaaaaagttaaacattatattaaaacatacttcaaataatactgataaagatataaaaagtataaataaagaaagaaattttaagaatggattattaataagcaattttttcaattttatagccaattccccacaccacctttaaatacttaggatcctttgaatttatttctattttttctctaatccttcttatatgtacagcaacagttttttcgcaattataagcaacatcatcccaaacgttttcgtaaatatccttagaagaaaaaactacacctttattttctaataaaaattctaaaattttaaattcaataggagtaaccttaacaacatctccatctagtgtgacagtttttgtatccttatttaaacaaagtccgccactaataagtaagctattattgcaattagaacaatctatatagtctttattattatttaaattaataaatcttctaagttgagacttaacacgagctataagttctaatggattaaaaggcttagtaacataatcatcagcacccatattaagacctaaaattttatccatatcttgatttttagcagataaaagtattataggaatattattattttccctaattttaagagtggttttaagaccatccatattaggcatcataacatccataataactaaatctatattattatctattaaactttcaatagcttatactccatcataagcttttaaaacattaaacccctctggttttagataaaactcaatagcatcaactatttccttatcatcatcaactattaatatattttcacccatttaaaatcactcctttaaaaatattataacatacgattttattaaataatcttgtaaactgggagctaaattattaagactttattacgaaaaagtataattattacaatttaataacgaagtttgtacaatgaagttaaattcctttttttgtaaaaagtttaagatacaatgctcttataaaagaaatttgcttagaaaaagaaaggggaagaaaaatgcgaaaaaaattaaatttaggatttaggtatatgaaggcctacaaagcaagatctttagcaattatactaagcataatcttatcagtagctatgatagtaggaatattaactttaacaaaaacagaaaacatgaatgaattacaaactatgaagtacaacacaggaatatatcacacaacatttaaaaatttaaattataaacaattaaaaataataaaagaatctagtgatttagaaaatgtaggagcttttaattttcatggaataactacagataaagaaaaacaatctgtaataatgataaattgtaatgaggattatatactatcgaattcaaagcttgaaaaaggaagatttgcaaagtctaaaaatgaaatagtagctgaagaatgggtattaaaaaatcttggattagaacctaaaataaaccaaatcataaaactaaatattgaagatataaataaaaatgtaaaagacgaagaatttaaattagtaggaattataaaagatagaccgacagaaaagcaaataggaaaaatgcaaatgtatttaccactacaaaaaaatagtgaaaacttagaggttggagtagcttttaatgaaaaagtagatataccagcttatactttagaattagctaaaaaagctaatataaataaagacaatatatctagttcagatgatttaataacaatatcaaacaatgcaaataatgttagcttagacacaattttaagtactttagttataagcttaatatgtggaatagtgatatatagtatttttaatatatctatgtacaaaagatttaaagaatatggaatattaagagcaataggagctaaaaactttaaagtatttaaacttatattaaatgaattaatgacgttatcatttataggaatacctataggtattttagctggagttatagcctcatttatagcaaataaaaatgctagcaaactaaaaactaatatagctttaaatggagaaataattaaagtacatatggtttatccaatatttgaaatattactagctatattatttatgattttaatattatttttaatttcaatttttacatataaaaagataaataaattatcaataatagatgctataaaaggaaatagaaaatctgacaatataaaaagaaacatggtaaatgttaaaactttaagaaaatacatgaaaacttacaaagcgatatcatttaaaaatatattaagaaataaaaagagatttataatgataattttttctatgggtatatgtggagttttatttataaattctaattaccgtttacatttatctcaatcagatgactttctagtagatagagattggaataataattctgatatgaggattgatatttatggagatgaaaatcaaataaatggtttaaatagtaaagatataaaaaaacttgaaaaaatagatggagtaaaagaagtagtaaaatctcaaataatgaacggaagaatggttatgaatgaaaaagatataaccaataaagactattttgaaagtataaataaatctattaggggaaaaggtttgtttaaaggttatttagtaaaagacaataaaaataatgaattaatacttaagcaaaatcttagaggatatgataaaaaagctttaaataaattaaatgattatttaattgaaggaaaaatagatattgaaaaaatgaaaagtgaagatttggcagtagtttatgttccaagagtagttgaagaaaaatataaagagggtacatcatacaatttagttgataatggaactccagtagcaaatataaaagtaggagatactgttaaagttaaatttagagaagatggaaaaagatctatagaattttatactttagaagataaagatgctaaatatatagaaaaagaatttaaagtaggagcaatagttagctacccatttatggcagaaaacacatatacaggagatagctgtatagatgtaatagttagtgataataaatttaagcaagttacgggtggagaaaattatcaagctataaatataaatttagaagaaggtgcaaatgacaaaaaaatttatgatgaagttttaaaaactactataaaagtaaatggagcaatggctagaaatctaattgaagaaaaaagaaactcagacgcaatgtatgaaaaatcaagaatttataattctgcgatggttttagtgttatttgtaatagctattgtaaatatagtaaataacataagtcaaagtatagtagacagaacaaatgaatttggaatgttaagagcagtagggcttaataataaagactttagaaaaatgataacatttgaaggtcttatatacacactaatatcaagtttaataatcatagtagtatctttaatacttaataaaatgacttatgattcatttgaagtttcaaaatatggaatagaatttagtataagatatatagactttatattaattataataataaatactttagttggaataatgacaacatatttcccagctaaaaagttagaaaaagtaagtgtagttgaaatgatgaatataaatgagtaaaaaaataaaaatttggaggattaaaaatgtcaattttagaaactataaatttatctaaaacttatggaagtaaagaaaataaagtaaacgctttaaatgatataaatataaatattgaaaagggggagtttgttgcaataataggacctagtggaagtggtaaaagtacgttactacatttactaggaggacttgaaagattaagtgaaggaagtataaaagtaaatggaaaagatataagcaaattaaaagataaagaactagccgagtatcgtagaaaagaagtaggatttgtatttcaacaatataatttaatccctgtattaaatgtagaagaaaatatagaacttcctcttatgttaggaaatgataatatagatgaaatatatataaatgaattaatagaattgctaggacttaaagaaagaaaaagtcaccttccaagtcaattatcaggaggacaacaacaaagagtagcaataggaagagcattatctacaaagccaagtataatacttgctgatgaaccaacaggaaatttagatagtaaaactacagaagaagtaatggacttacttaaaaaatctattaaaagatataatcaaacattaatagttataactcacgacttaaatatcgcaaaaaaagcagatagaacaataaatatagttgatggaaagatagaattataaataaaaaggggagtaataaatagttactccccttatattatataaatttgtataaatatttatgttcgttttatgtaaaatttaaaaatgtacatatttcctagcacaatttaaataattgtaacaagaaatttactcatttttagtttaaattaatcttcgtacatataagctctagtcatttgaatatcgttgttaacacctttgcttattaaaatttgatgtaaatcgataactccattgttaaagcaagcagcgcaagaagttagatataaatcccacattcttacaaactcttcaccaaacataccttttacagtatctctttgtttatcaaagtttctataccattctattaaagtttttgtatagtgtcttcttaaactttcaacatctaatgtatagaaatcatatttagggaataaatctataatctcacgtaaagatggacaaacaccgcctgggaatatatattttttaatccaagcatcaccaggagattcagttaaaccacttatgtaatgtagtaaaaatagaccttttggttttaatacactatttacattttttagatataaatcataatgttcacgaccaacatgttcaagcataccaacacttacaattttatcaaaagacattcctgagtgttcaaggtctctgtaatccataagtttaacttctaagtaatcttcaagaccttcttgttcaattctttcttggaattttttatattgttcttcacttaaagtgataccagttccttttactttatatttttttgcagcttctataagtaaataaccccatccacaacctatatctaataaagtttcaccttctgataattgaagtttctttaagatataatggattttattcatttgagcttcatataatgtatcgttttcatttttaaaataagcacaagaataactaagtgttttatctaaccaaagactgtaaaagtcattaccaagattatagtggtagcaaacttcagatttttgtttcttttcgttacctgctttatgaaatattttaccaagttttgagaaattagtatggaaatgatctttttgacaactaaatagagtatctagagccaataataaatctcctgaaatctcaatatcttttctcatataagcttcacctagatataaagaagtactagttaataaatcttttttacttataggattgttaaagcatactttaaagataggttcaccttgaccaactaaaaattcttctccatcccaaagtttaacttgaaacggatttgaatcaagctttgtaagaaattctttaataaatattttatctatagtattcatattaaatgtcacctctttactctaaatacccataaatttctacatgaaacataaaagttaaaaacttaactaaaaaatatctttaaaagttaaattatccaatattatattttcataaaaattatttccaatagatgtttttatgaatttacttttattttaaaaatttcctattgactatatggtaaatatatatattatcttattaatataataaaaaagacatatggtaagggaggatgtatggaaaattcattagcaaaaagttttaatttctcatcacttataaagtttactataccttctattgttatgattgtatttatatctttatatactatagttgatggagtgttcgtatcaagatttgtaaatacagatgcactatcagcggtaaatatagtgtatccatttataaatgtagtaatagctgtaggagttatgttagctacgggaagtagtgcagttatagctaaaaaattaggagaaaataaagaaagagaagccaaagaaaatttcacattaataatattacttggattatcactaggaattataataagtttaataggatttattttctcagaaaaaataatatccatattgggatctactaaagatttaaatgattactgtatggattacttttcagcattacttttttttataccggcatatataattaatttattatttcaatatttatcaataacatcaggaaaaccaaatgtaggattaatattaacaatcattggtgggcttacaaatatgatattagattatatatttatagtacctatgaatatgggtatatcaggagctgcatatgcaactggcatgggaaatttattacctgtaattcttggaactatatattttacacaaagaaaatcaacattatattttgtaaagcctaagttagattttaaggttataataaattcgtgcactaatggttcatcagagatggttactaacttagctacaggggtaactacaatgttatttaatatagtaatgatgaaacttttaggatcaaatggagtagctgctataactatagtattgtatggagagtttttaataaactcagcttatatagggttttcttctggagttgcaccaataataagttataattatggcaatgaaaacaaaaaagaacttaaaaagataattaaatacagtactaggtttatagctataagttcattggtattatttacaatatcaatgatatttgcacctagtatagtaggtacattttcacctagaggaactagggtatttgatataggatataaaggatttaagttattttctataggatttttagtaaccggagtaaatatttttgcatcttctatgtttacagcattttcaaacgggagagtatcagcaactatatcgtttttaagaacatttgtatttttaatagcaggaataattatacttcctaagtttctaggagttaatggggtatggttagcagtgccattggcggagatgttatcaatgataatatctctagtgtatataaataaatataagagtgtatatggatatggaaaagatattgatactcaaaacaaagataagaagcaatcatataaagatataaaggagctttagtatgaaaaaaaagatagaaaaacctaagataagtaaatgcttagaagaggtttacgatgtaattaatgaaatttatgatgaagaatatttagaagataaaataatagaaaacattactatatcggatatatacgaggtaagagttagatttaattcttgtatatttaaaaatgtagtatttgaaaactgcgatttaagaaaaattgatattactgatgttatatttgaaaactgtaatatgtctaatataaattttagtgacagtggaatatatagagcagagtttataaattgcaaactaacaggaacaatatttgaagattctatatttaaagatgtagtttttaaagatagtataggaagatattcaaacttttcattttcaaagtttaaaggagtaagatttaaaaattcagattttcaaagtggagtttttcaagaagtacataatcataatctagaagtagaaaatacagatttaagtaaatctatatttaatggaatttcattaaaaggtgtagactttacaacttgtaatatagatgggtgtgaatttagagtaaaagatttatctggaggtattttctcagttgtccaaagtttagaattagctaaacttatgggaataataataaaataaatacttaaaaggtcatttataaattaaatatttttataaatggccttttgtttatcgttaaatttgtgctaatgcataaaatcaaaataagtactaacaatatataaataataattcaaggaaggatgaatattatgagtcaagagcatataatactttattggatttatgtaattgttatgcttacaggagcattagtaatagctataatgagtagaaattctaaaggagttcctaaaattaattactttatatcactttttataccaatgtggtcagctattttatatatacctatagctactttaataggaactaataatataaatgccaaaactatattttatgctaaatatttagattgtatagttacaatacctcttttgctgatattactttgtcttacaggcatgtataatatgaaaaaaaataatactattttatttggagtagcttttagtagcattataatgatactgtttatatttataggaagcttacagataggaattaatagatatatctgttttttcatagaagcgttaatctcttttattgttttatgggtaatatgggggcctattgaaaatatcgctagtactcaaggatataaagtttataggttatataaaaatatggcattatattttacaattttttttggaagctattttatatcatggattatgagttcatcagtatatgatttagtaagcaaaaagttttacatatatatatttataacaatttccgtattattcaaactaggttttgggttagtgaatataataggtcttagaaaattagaagaaaatgaataaaattaatatattgctagatataaataaaactatatttaaaattatgatttaatatgttattttaatttgtcataaaataaaaattttataaaaaatatttattttattatagattttataaaaaagctgtagtactatgtatacataagcaacaagattagacaaaaaataaataaaagacaataggaattgacataaattttaaaaatataaacgtaagaatcatttataattattgattccttataacctttagataaaatactatccccccataaaatagtattttaaacctaatacccacccaatttgaaaagactgtatcggaagcagtcttttttttatatattttgatactataataaattaggtaataattagatatatttattaaggagaatattatgaaaatattaatagatgcagatggatgtccagtagtagatataacaataaaagtagcgagaaagtttaatatagaaacaataataatgtgtgatacatcacatatatttaacaaaccaggaattgaaaccataatactttcaaagggagcagactcagtagactttgcgcttgtaaataaagttaataaaggagatatcgtagtaacacaagattatggactagcagcaatggtattatctaaagaaggttatcctataaatcaaaatgggaaaatatacactaatgaaaatatagatgagttgttattttcgaggcatttatcaaaaaaagcaagaagttcaggtaagagaatgaaaggccctaaaaaaagacaaagagaagacgatataaaatttgaggaaagtttaaataatctaatatataaataccaataaatttataataggatttaataagaacttcattttattctttaacaaattaaaaagaggagtagaactactcctctttttcaaattccatatcccaagcaaaataaccattatctttctttgtgtattttaatatcgcatcaaatttagagccatttttacttgttaatcctttgactttagcaaatccatttttaagaatgctttttaccatagttttagtaggctttttctttaaagctaaaagaaatctatcactattccaaataccaaatttacaatttttataattagtacaaatatatcccttagaacattcaacaacatcattttgacaaactggacacttacctaaactttcttgctttgatccgtcattagagaaagtccctttagaatatctcttagttttaggattataactataaacttctgtactaatatttttatttgaatctcttttaatagtttcaactccattaacaataaaattcattatattagtcagatattcacttctagtaaattcgcctctttgaatatcacttaaacttttttcaagtttaccagtataatcaacatcaagtaaatcttttaatggaaatatctcgactaagtttttacctaaatcagttatataatatgatttaccttttttattaacatatccaacctctgcaattttctttaagacatcagcacgagttgcagaagtccctatagaatatccagataaaacagtagtatcttcatcagaaacatttttgccacaatttttcatagctttaagtaaagtatcttctgtatatgatttaggtggagtagtttgtttagttagtatatccatattaataacatcgacaacctcatctttattaaccaaaggaagtaaatcatttttttcttctttattatatacttctaaatatcccttaactttaagcacttttcctttagttaaaaacttattatcatcaacaaatgtatggatttcagtattttcatattcagcaggtggcataaagtttgctataaatctatcttttatggcattataaacaatttcttcatcaggagttaacttattaggtattatataagttggaattatagcactatggctatctacttttgaagaatcaaaaactctttttgttttagcaaattttattttattctcataaggaagtccaaccttaagtttttctaaagtttgagatgccttaccagctaaactttcttccagatatatagaatcagttcttgggtatgttatatatccacctttacctttaccttcgtataaagattgacaaacttttaaaactttatcagaagtaaagttagaatgtttagacgttatatatccttgaagagaagttaaactaaatagcttaggtgcatattccttagattttgtaacctttttatctttaacaacaccagtacttgaagatatgctatctattattttattagcgtcatctatactatcaaattttgattcttttccttttatatatttacctttatatttaccatttgtacatttgaaatttccttctatttcataatatgtttttggaacaaagtttgctatctccatatctctatcataaactaactttacagtaggaagtattacccttcctatgtttaaaagttttccattaccatattttaatgtagtcatagatgtaaagttaattcctattagccaatctgttataagtctagtatatcctgcagcttgtaaatttctcatttgttcatcagtttttaagttatttaaacctctttttatatcttctggagtccattcattgactaaaattctttttattggttttttatttttagctgttagaaaaattaaaaaagctatcagttcaccttcacggtcgttatctgtagcgtttattatttcatcaacatcatttctatgaataagtgattttactatattaaattgcttgctcttagaaccatcaactttaaatctaaatttatcaggtataaatggaaagttttcgcttttccaagaacctgcataagctttatcataatctttaacatcatataaagaaactaaatgcccaacagcataagttactatataattatttccttcaaaatatccatcatgtttagttttagcacctaaaaaagatgctatcgtttttgcaacagagggtttttctgctaatataagtttcatacttaacctccttaataaaacctaataaatatattagcatataaaaataagatacatcaacaaaaccacataaattcttaagtatataaataaaactacatttacttggatgaagatgtaataaatggcaaactatttataattatagacaattacttacaattttgtaataatgtttatagtataaaataatttatattacaaacatattggatccgatttatagggagaggagttaagcagtacatatgaattttaaaagaaaaagtatggtagctggattaatttcagcagcaatcataataccaacctcaactggagtgtcatttgcaaatggagttaatgatgcaaacacacaaacaaaaactattgattacagaactataactggaaattcagtaaattttagaaaaggaccaggaactaactattcatctttagataaattaaataaaggatataaagtagaatacttagagactgtagggtcatggattaagataaaatataatgggttagaaggatttgtacatggagattatgtgtctggttcttcaaataataatacttcagaaggtgacaatacaataaagactacaaaagaagtaactggaagtagtgtaaactttagaaaaggaccagggactaataactcagttataaaagctttaagtaaaggaacaaaagtaggatttatatcagaaagtaatggatgggctaaagtaaattataatggaacaatagggtatatatcatctaaatatttaggatctgtaaattcagagaataataatgtagaaactgataatacggtaaaagctgataaagaagtaactggaagtagtgtaaactttagaaaaggaccaggaactaattactcaattataaaaactttaagtaaaggaacaaaagtaggatttatatcagaaagtaatggatgggctaagataaattataatggaagtataggatatatatcatctaagtatttaggggctataaactcaaataataataatactaatgaagaagctgataacacagtaaaatacaataaatctgtaacaggaagcagagtaaatcttagaaaagggccaggaacgaattatccagttgttacatctttaagtagaggaacaagtgtaggagttatatcagaaagtaacggatggtcaaaaataaattacaatggaagcataggatacatgtcatctagttatttaggaactataaactcaagtagtaatgaaggggaatctacaaattcatcatcacaagcggatagagttataaatttagcaaaacagcaattaggtaaatcatatgtttggggagcggaaggacctaatacttttgattgttcaggatttacacaatatgtatttaaaaatgctgtttcaataaatttacctagagtatctagagaacaaagtaaatttgggcaatatgtaaataaaaataatcttcaaaaaggtgatttaatattctttgatactgacaaagatggttcagtgaatcatgtgggtatatacataggaaataatgagtttatacatgcatcatctggaggtaaaaaagttataatatctcaattaaatggatattattcatctgtttatacaaatgcaagaagagttttatagaaaataaaaagcgaaagctttttatttttttattttatatgtataaatatcatgataatttgaaaatactaataaagtcatcataatcatattgtaaattttaaggagagtaatcatgtgtgtaataactgatttttaccaatttaaatatagtagaaataactattatatagagttttatatgaatagagatgctgttataaatatagaaaatgctttagatgaaagacttagtgaatatacagtcaatagggactctgagtgtgcatacatgaggctaaaagaactatttcaaacatctagagcaaatagtaatttaccatatgtagaaatcagaatgaataaatgctttataatttatatatctaatttacaattatactttagaaacaaagttcagtatgaagttttagatgtactttataaatatttacaaacttacatggctttagaatatgacactttaagtatatttaatatactagatgaagatacaaaaattagggttttatctacaatataatataatcaaaaaacttaagtagcttctatatttttatagaagctacttaagttttttattaatacatttgcttactttcttggaaatcataaacatccattaaagcttctccaaatctttgatagtgaattatttctctttcacctaagaagcgaagtacatttttcatatctacgtcatcagttaagtttactagttgatagtaagttgctagtgctttttgctcagctgccatatcttcatgaagattagtaacagggtttcccataacagctattgtagaagcggaaaaaggtacaccgtgagcatcagctgggaatattccaaatccattttgagcatagttagaacctaaccctgcttttcttaattcttctggagtagcatcttgagtaagttgataaaccatagtagcaatcatttcaacatgagctaattcttctgttcctatatctgttaaaagtgcttttgatttccctgtaggcatagtaaatctttgagataaatatcttagagcagctcctagctctccattaggtccaccaaattgtgtaattaaatatttagccatttgtaaatctttagacttaagatttacaggatgttgtaatgttttttgatatatccacataaaaatttcccccttaattacatttcataaaatttattttcccaaggccaaggactttctacccattgaaaggggcattgactaggagaatatccaaagttatttaaaggtccatatttcttttcataacacattctagctttagcaaactcagcacaaagtttattataagtagctatagcatttgcatcttctgtatgagtatctaaatataagttcatatctaaacaagcaaaacaaagctcttctatattagttaacatttcagctcttgtagccattatcttttacccccattttttatttttttacctctatataaattcttattatacatagtagaatcccataaatttaattcaggaaaaattgtcccatactctaatgcctttggtaagttgtacattttgctaaatatctggtcattgacgtaaggtctagctaactcacacccgcaattttttttcaccattctatcgttcaccaaaattcctccaatcctaattaatttatagatgatatagttaataattgttgtattaactgtatctaatagcataatattcatatatagataaatagttacacaaaatctaaaaaattaaaaaatgatgcaaaaggtagaaagttaaataaaataacataatgaaaggattttctgggaaataattagatatacggtatgaatatcttgaactaatattgggctttatgataaaataagttgcatgttcacaaaaaaaagaggtgatttaatgagcgaattagcaggaaaaggctgtgagattatagttccttttgatgaaagacagccacttaaagatattgaaagaagtatagtaaaaagatatagaaaaaatttatggtcaaaatttatcaaagcaataagagcttatgatttagtagaagaaggcgacaaaatcgcagttgctatatctggaggaaaagatagtttacttatggctaaaatgtttcaagaattaaaaagacatagtccagtaaactttgaagtagaatttatagctatggacccgggataccacaaagatatacgacaattattagtagataactgcgaatacttagatatacctatacatctatttgattctagaatatttgaaattgcagatgaaatagctaaagactatccttgctacatgtgtgctagaatgagaagaggagcattatattctaaagctgaagaattgggatgtaataaattagcacttggacatcactacgatgatgttattgaaactacaatgttaaacttattatgtgctggaaactttaaaacaatgcttccaaagttaaaatctactaactttgacggaatacaaataataagacctttatactatataagagaagaacacatagtaagattcatacaaaacagtggtatatggccacttaactgtgcttgtatggtagcagctaaaaagactggaaacaaaagatatgaaataaaagaccttataaaaagtttaggtgagaactttaaggatgttgaaaagtctatatttaaggcggcggaaaatgtaaatatggattcggtattaggatggcaacaagatggagttaaacattcattcctagaaaggtttgagtaggatgtacttagtacatcctttttcttttacgttgatattgaagataatgtattataaaattatactagaataaattaacaattagtaaaatgtatttttagggttttagaaaggatgaaggggatgaaaaaaatatatgtagattttgagatgaatatgtcaaattctaagtatggaagagatataaataatgcagatattattgctattggggcagttaaatacgatacaataaataaaaaaatttctaactttaagtctttaataaagcctgttagtaatattaatatatatcctcatatagaggaacttacaaaaataactaatgaagatattattaaagcgcccacctatgaagaagttatgagggattttaagaaatggttaggaaattttacagaaattgagggaatttatacatttggaaatttagatttaacttgtttttcaaatacagatagaagaagtgcacaaaagaacaatcatcctagatttgtaaataatataaaagatttgtttatagatataaaaaaacaatatttaaacgaagggattaggtgcattaattatgtatcattaaaaaacttactggagtattcaaatgtagaatttgatggagatgcacatgatcctttagctgatgcatataacttatttatactagacaatacactatcttccaatcgtaaaataagagaattattaattattaaggatataataaaaaatccatttatagaaataaataaagatttaaaatctaaatttgaagaatataaagattgtatacataataaaaaaagtaatataaaattagatgacttatctatagaaatattaaaaacatttaaattatatttagaatctataattgatattgatatacataatattgaagaaataaaagatataaataaaaaattacttatattcgataatcttatcgatataaaaaatggaaatttttatttattagagagtacatacttggatatgatggatttagtcgatgatttattttattatagattaaataaagaggaatacaagcaagaattaattaagattatagaattatttgaagaagatttagagtatgaaaatataaatataaaaagtttactagaagccagctactaagccgatttgagcagtagctggttagtttttatgcctataaaaaatattaaatatagtaaaaaaatttagaaaatttattgcattatggtaagaaaatagaatataatagaggaaagaaaaacgttttgctacttgaataagacaagaggaggctttaaaatggaagttttaaaaggaacaattctattactaatggtgctggccgcattttctatatttagttataaggcaccacatggtatgaaagcaatgggggcattagcaaatgcagcatgtgctacattcttagtcgaagcaatacaattctcacttctaggaaatacaatcgggataccatttcttagtgaattaggatcaattagtggaaaattaggtggtttagcagcagcatcactaactatgggtgctttaggagtttcgcctgtatattcaatgttactaggaataacatgttctggattaggaatattaccaggattcatagcaggatacttaatgtcatttgccgttaaattcttagaagaaaaagtaccaccaggacttgatttattagttatggtaattgtaatggcacctataacaagaatgataggggtatcattagagcctgtagtaaattctactttgttaagcataggtgatataatcgctggttcaacagactcaagcccaataataatgggattaattataggaggattctttactttattatcaacatctccattaagttctatggcacttacagcaatgctaggtttaactggactacctatgggaatagctgcattatctatatcagctacatcttttgcaaacttcgtattatttaaaaaattaaaatttggagatacaagagatactatatctgtagtaatagaaccattaactcaagcagatataatttcagcaaatccaataccaatatatgtaacaaacttcataagtggagctctttgtggagtagtagtagcagctatgggacttataaacaatgcaccaggaacagcagcaccttcagctggattacctgttatgtttgcatataacccagcacaagaagttttaatatgtatggctatatgtgctgttataagtactattgtaggatttacaggaagttatgtatttagaaatcacaaaatagttacagcagcagaaataagaggttagattaaaaaaatattaaattataaaataataggctatattaagataaagttagttatgtaaaaaatattacttactaaatttattttgatatagtctttttttattagtattaatatgtcgtatgattaaaatcattttttgggacgtgcatatataaatttatattataagtatatatgtgggagggattttagtggatagtataaagtcatattttgaaatagtatttttaatttttattattttatcagggatttttataggaatgaagttgattttaacagttattgaaattagaaaaaatacttcaagaaaaatagtaagtagatgtcaaacaaataaacctactttattaagaggagaaagtggtgatagttataatcaaggtagtagttttttaaatagtgatatgtatacgtccaagaaaaaagttaaaaaacatgataaatatgaaattgtaaaatatgataatggagatatttataaaggagaattgatagaaggaaagagaagtggatttggggtttgtatatttgctaataaagatagatatgagggattatggaaagaagattcaatgcatagtataggaaaatacttatatattgatgggtcaatttatagtggagattttaaatttggagtaattgaaggtgttggaatgtatacatttcctaataaagatatatataaaggtgagtttaaaaatggacttagaacaggtaaaggaatcatatcttacaataatggagataaatttatagggatttttaaagatggattaagaaatggaagaggaagatatatatcaattaatggagatatttatgaaggagagtatagtgaagataaactaaatggtaaaggaacttattcttattcatgtgggagtaagtatattggagagtttaaaaataatgtgtataatggtcatggatgttatacaaatgaaaatggtgacatatatgaaggtgaatttaaatatggatataaaaagggatatggagtgttaaagtttaataatggagaaatttataaaggggactttaaagacgatttatttcatggtaaaggagcttacttttatagagataaatctatatatgaaggtgactatgaaaatgggttaagatgtggagtaggtgcttttacttgtgatatttatagatatatcggtgaatggaaagaagattgtaagtatggagttggaacatattacttattagataaagcaaagtttgaagtaaatataaaagataatattataacgcaaggtacttatataaaagaaaacaaagaagatataaaagtaaaagatatagatataagtaaagatgaaaaagaaattataagaaatttatctaagattataaagtagttacaataaagatacaaaatatatgttaatatacaaaaatatttaaaataaatatatattatatttaaggaggaggttatatgtttttaacatggattataatagggataatattactaataattgagtcgagcaccataagctttgtttctctattctttgctattggatgttttgtagcaggattatcctcactaatagtttcatcaataggaactcaaataataataatgtgtattgtttcaattataggagtaatatttggaagaaaaattctacaaaaatattttgacgttaacaaagaagtaaaaccatctactataaatgctttaattggaaaaattggagttgtgacgaaagaaataaatcaagatggcataggtttagttaaaatagaaggagaagtatggagtgcaacttcagttgattcaaaacatatacctaaaaatgcaaacgttttaataaagtatatagatggagtaaaattagtagtagaaaaaatataaggggaggtaaattttaatatgtttacaacaatattttttactgttttaataattttagttatagttttagctatatctactattaaaatagtaaagcaatcagaagttataattgtagaaagattaggaaagtacaaaatgacaggagagtcaggtcttaacatagttgtaccaatattagatagagtagttagaaggattgaccttagaactcaagttatagattcaccgccacaagctgttataactaaagataatgttactatgtcaatagatactgtagtttattatcaaataacagactcatttaaagctacttatgaaatagcgaacttagttcaagctataaagtatttaactacaactactttaagagatgtaataggtactatggaattggataaaacattatcttcaagagatgatgtaaataataagttaagaattatacttgatgaagccactgataaatggggcgttagagtagaaagagttgaaataaaaaatatagaacttccagaagatataaaagaagctatggaaaaacaaatgagagctgaaagagaaaagcgtgctatgatacttcaagcagaaggtaaaaagcaggctgctataactgaatctcaaggtcttaaagaatctcaaatattaaaggcagaaggtgaaaaacaaactgctattttacatgcagaagctcaaagagaagctcaaataagaaaagcagaaggtgaagccgaagctattaaaaaagttgcagaagctgaagctagtaaagtaaaaatggtatatgatgcacttaaaaatgcaaatatagatgaagctatgttatctgttaagtatgtagaagctttaaatgaaatggctaagggtgataacaaggtatttgtaccttatgaagcacaaggtctacttggtagcataggagcaataaaagaaataatatctgataaaaaataaaaattaaacaaatttaaatatataatttttaaataaaaaatgtttcaaaaagtttttataactattttgaggcatttttttatttgaataaataacataccctttgtaattatcacaatataacaattaagtgtatataattgagtataaaattttatttaggtggtgtgtttttatgtataaaatgaagttattaccttataaggttactgaagttggtagagatattaatgtaagttcttatggagtaaaaatgattagggctgataaattttggaataagtctagtggtggtgagggtataactgtagctattatagatacaggatgtgatataaatcatgttgtacttaaggataaaattattcacactagaaatttcactaaagatgatgaatctaataaatcattagttaatgattatatcggacatggtactcatgttactgggattgttcacagtgtagcacctgcttgtaatttaatgatattaaaagccttagatagacatggagaaggtgagtacaagtggactataaatgctataaattatgcaattagccaaaaggtagatattataagtatgtcgttaggaggatatttagatgatgaaaatttgcataaagctgttaaaaaagccgtaagtaataatatattagtagtttgtgcagctggaaatgatggagataataattctataactaatgaattttcttatcctgcttcatatagtgaagttatttcagtaggtgctgtagatgaaaaagctaaaccagcttatttttcaaatagtaataatttaatagatgttatggctccaggagttggaattttgtcaacgtttaaaaataactcatatgctatcttagatggaactagtatggcggcacctcacgttagtggttctttggcacttataaaaaattattcaaataaagagtttaaaagggtgttaagtgagtcagagatatatgcccaacttataaaatttactttagatttaaattatgataaaaatatgcaaggaaatggattagtgtttttagaaagtcctaagatgcctaagaaaatgtttaaaaatggacaagtgaaaattacaaagtgattaatctaaatttaaatttttttattagtattttaatacaatggtaaatttcatattatcattgtttttttatttgttataattatatatacttatacttatgaaaatgagaggagtaatttatgaacaaagattatgtagtagtagatttagaaactacaggccttgatccatataaaggctgtgaaattatagaaataggagttacagagataaataataataaaataggaagaaattattctaggctaataaaaccaaacggaataattcctagtcttataactgatataactaatataactaatgagatggtagaaaatgaaaaaagtctagaagaggttttacccaaatttagacaatatataggtgataaaactataattgcccataatgctaagtttgacttgaaatttttaaattattatttaaataaaatgggattagagcctataaataattatatatgtacattagaattattaaaacaaaataaagaatataaaggtaagaataaaaaattagaaactgcgtgtgaatattataatatagaaaataaaaatgcacatagggcagacagtgatacactagcaactgctaaattatttcttatacttaataaataatagagagctttcatattaatttaaattagtgtgaaagcttttgtattttttgtgtttatttaggaattaaaatcatagtatatataagttacaataagcacagttaggagtgacatttatgggggttgtattagaattatttttaggtggtgatactatattatgaatatagttactaatatagatttgaaaataataaaacctttaaaatcagagggggttaactctaagttatatttagttgaagatacacaaatgggaagacaatttataatgaaaaaaattaaaaaatcatcttttaaaaatccagataaatactttgaagaatcaaaaaagatttgtaaagctaatcatcctaatataataaatataaatcatgtatcttatgatgatgagcatatatatataactatgccttattatagaaatggatctctacaccacttattagaaacaaaaaacctaactataagagaaataataaactattctttagatttcttatcagctattgaatatctacacaaattgggaatttctcactgtgatataaaacctagtaatatactcataaataatgaaaataaagctgtattagcagattttggatcagctgtatatttaaataaagatggagtaggtaaattaagaaatgtttactataaacacatagcacctgaacagtgtaaaagtacatctataactaataaagttgatatataccaaataggtacaactttatatagaatgtgcaatggtaacttagaatataatactcaattaaaaaaatataaagatataaatatggtaaaaattgcatcagctagtggaaaatttccaaaaagaaataagtacttaccacatgtacctagggctatgacaaatataatagaaaagtgtataaatgttaaacctgaagaaagatatgaaaatgtatctgaaataattgatgatattgagaatataaatgaaaatttagattggaaatacgaaggaaatgataaatattattattttataagaaaaaataatgataatactattatgcaaattatagttagtgaagatgaaggttattataatgtgaaaactgtaaaattgaataaagaaaatagaaagtacagtgtatataagggttattgttgtgaatatattgaaagaaagtcagatgcttttaatgaagtgaaaaaaataatagccttactttcataccgatcaaagtaaggcttttaaaggggtaaaatatattataaaaaggggtttattagggaatatattttatttggggagtaaaaatttaaggttatcaggggaataaccttgtaataataataacaaagttcgacaaagctgtcaacaattttcgacaaaaaatattaaaaaaatatacgaatgaaaaaacatcctttgaacaaactataaccatattatgttataggatgaaattaatgatattaatatcaattacaatgacaccttagatataaaagtaaaaaaagttgatttgaaaaataaaaaagtaaaattagataaaaattacgaagaaatggctataataacattagaagttaaaaataaggatgtagtagatgtagaattatctaatatagatgtatatccattccaaaatcataaatctacagaatgctttgtaataactcaacaaggagaagttacaggtaagattggtaatttacaaagaggagataaaaaagatattaaaataggtgtagctttagaaaatttaaaatcaccgttaagattagaatttaaaaacattgatgaatttaaacaataccaagttaccaaaaatattaatttaaaataaaaaaagaaaagcaatttgcttttctttttttatatgtattattctggttgaggtgcatcaacaggacatacgctgttgcaagttccacagtctatacatgcttctgaatctataacatatttgtcatcaccagcagatatacaactaactggacattcaggttcacaagctccacaacttatacaagcatcacttattttataagccataataaatacctcctaaaaaattattcaagtatatttataccactaaatttaaattttaaacaaaaaaatataaattttttaaattaaatttaaataattatagttaaaatatataacaatataaatcaaaggataaaatgaattttactctttgatttatttggaataaaaaggtataattactcatatatttaaaaaggagcgtaaaaaatgagttattatgatgatgaaaaaaataaaataagacgtaaaaaagttagctctaataatacaagctcaagatctcaaactaaccataaaagggtggaaaataaaactgagaataaacaaacaaataataatagaaacaattattcaagcaaaggaaaaagagctaataaaggtagagctaaaaagaaaaaaaagtctaaaaggtttgttagtataataaagaaattactaatatttttattgataatatcttttataggagctatatcagcaaatgtaattatgaatatagcattaaaagatagtcccaaacctacatatgcttatatgaaagaaaagtcagtaagcagtgaatatgtaagtataagcaaaataccagtggatctccaacatgcaatagtatctatagaagatgaaagattctttgatcataaaggagtagattacttatctttaactaggtcagttgttcataatatatttagtaaaagtacacaaggtggaagtacattagaaatgcaagtttctaagaatcttttaacgagtatggaccaaactataaaacgtaagattaaagatatatacaatgcaagacaaatggacaagaatatgaataaacgagaaatattagaactttacttaaataatatgtatttgggaaaaggcatatatggagctcaaaaaggagcgcaagtttattttggaaaagatgtaagcgaattaaacttaggagaatgtgctttacttgcaggtataacaaatagacctggattatattctaaagattataatgcagctaaaaaaagaagagacataattctttataaaatgcaggaattaggatatataacaaaagatgaatatgaaaaagctaaaaaagaagaaactccaatgaatattaaataaaagaggtgtagtatgagtatttataaatttaagtttaatgaaaaagattatgaattatctaaagacaattgtagtggattaataaatgatgaagaaaagccagtatcaaatattaatttagatgatatattaaatattttaaatcaagcacaagatgtagatttcgatatagaatattatcaagaagcatgtccagaatgtttaacaggagtaaaagaaaaacaaaaattttttggattcttagaatatcacttttatatatttactaaagatggtaagttcgtaataagcgatataagtaaagactatgaaggtttatcatttaataagttaagtagagctggaaaagtagatgatagttatatagttagcgtaataatgtgtgaacactgcctagattatataattcaaatagaaaactgtatagtataataaaaaagctgcatattatgcagcttttttattatttgttatcgtccttatcttctttattctcttttttttctatgttacgttcaatataataattcttatacgtatgggtactttctacaaagccaatactttttaacattgaatcaaattcttctggagttggtatatcttccttatcacacataaaaaaataactccttttatattttatttaataaaacttataaataagtattaaaaatcatactaacttgagctttaacttctaaatctcctgaagataaatatgaagaaccagaataggatacatttttttgacttatagagtattgagatatactattttcagatatattttcaggaagtggtctcaacttaattgaaagatttttagctaaaagtgaagatttatttaaggcatcttgagtagcttttaaaagagcttcattataatgaggcgatacattagatatagtaaatgttaaattaacattactattagctccattttcaatagctaaagtataaatatcacctaagttttctaaattagatacttctattcttatagtagtcgttatttcataagctatcaattcatttgttacattatcataccttttatttatagttacatcatctgcatttattttttctcttggaataccaaagtctgataaacttaatataatgttatttacagtattagcattttctacttgagctacctgaacatctttattagatgttgtaactccaactgttaatattgccaaatcggctttaactttaactattccaactccatttacagataactgtcctttttctctcattgtattcatattcatatactgcataaattacctcctttaaaattacatttagtataaatatactaataagtaagagaaattatgattacagtatatatagaaagctagcaaagtattgtatagatgcaagagacattaaaaggtagtataataaattaatatattaaaattaggaggagcgtatgcaaccattagcagatagattaagaccacaacaaatagaagatatggtaggacaatctcatataataggcaaaggaaaaattataaataaacttatagaaaataaaaccattccaaatatgatactatatggacctcctggaactggaaaaactacgttggcaaatataattgctaatgttacaggcaaaaaatatgtaaaattaaatgctgtaaactgtggggttaaagaaataaatgaagttatagattctgctaaaagagatttattttcatacaatggtataattttaatgctagatgagattcaggcattaaatagaaaacagcaacaatccttacttgaagttattgaagatgggtcggtaacattaattgcaagtacagctgataatccatattttgtagtatataaagctattttaagtagaagcactatatttgaatttaaacaaataaataaagaagatatacttaaaggacttcaaagggcaatagaaagacttaaaagtattaatacatatgatagtattaatgttgaagataaagcactagaatatatagcacagacttgcaatggagatatgagaagtgcgttaaataaattagaattagtttttaatgtaggaatagatattttttctaacactgtaaatataactctagataatgtaatagagtgttcgagtgtaaaaatgttaaattacgataaaggtggagatgatggatattctatactttcagcatttcacaaatctttaagaggctctgatatagatgcatctatacactatctagcaagacttattaaggctggagatattcaaggaataactagaagattactttgtgtagcaagtgaagatgtaggactagcagtgccacaggctataactataactgaagcttgcgtttcatctgcactgcaattagggtttccagaagcacgaatacctctttcacaagctactatttatttagcacagtgtccaaaatcaaattcagcagttatggctatagaatcagcattagcagacttagacaatatagaaacaggagatattccgctacatttaaaagatgcacattatttaggggctaaaaatttaggtagaggtgttgattataagtatcctcataattatcctaatcactatattgaacaacaatatctaccagatgctataaaagataaaaaatactatatcccaggggaaaataaaaatgaaaagtcatttgaacagtattggaatagtgtgaaaaataataaataaaagatattaatataacatcgactaaatttatagatactaatttactttaaataatattaaaaaatgagctatctaaaatataaaaattagctcatttttaatattaaaatcttttagttctataaaatctataaagaaaatctttctctaatgatttacttagagtagctttttcttgaaaattaacgaaactaatttctagagaagatttatttataggtattactttatgtatacactttaaattaactatatagcttttatgagaaagaaaaaaattaggaggaagtctctttgctaagttatcaaattgttcgtaaaattttatgatgtcatagcctttagtatataagttaacagatctaccatttttttcaaacatcactatatcatcaaaattaatcatatgggtttgttttctaattttatataaaaacaatgtgtcttcaataaaattatttttagctagtttatgagaattaatatgatctattgcaatatttaaagaatctaaaattttttcttttgtaaaaggttttactataaagtcaataggatgaaccttaaaactttctaaactataatcagcaaatcctgtaacaaatattatatgtacatctttatctatacaacaaatttctttagcgcaatcaatgccgtttttataaggcatatcaatgtctattataagcaggtccactttttcattttttataaaatcaatagcatctataccattattaacttttttgacataatcaataaatccagattctttaattatattttctatatcatctcttatagctttatcatcatcacaaattaaaacttttatcatttattatctccctttaaaaatacttaggtattaaaatcgtaaattcagtgataaaatcatcactagtagcaaaaatatgataaccatatttatctaaaatctgttttgtaagatataatccatagccacgattattattatctttagttgaaaaaccttctgtaaagataatatctgtattgtaaattttgggaccgttattttttatagaaataacatattgaaattcatcctcatatataaacatttttatatatttattatctttatcaatactgattaaagactctattgcattatctattatatttaaaataacagaactcatttcattaggttctataaccaaattatcaataaaatcttgtatgtatacatcaaaagatatatttttcataaggcattcttcatattttaaagctgatatagcatctaagtaagaaactttaccgtatctagaagtttttgatctaaaactatttgagatattagttatataatcttttgcatcttgattaagtccggtattaagtaaagaatatacaacttgtaagtgtttcaaataatcatgtttttggcttctaagttttccaattatattatctttatgctctatcttgctattttgttttttaatttcaaaatctttattatcattatcacctattaattttaaaaacttaattcctatataaaaacaaaatcctatagaaataagaatcaagaaaatcgataataaacttataaataacaagttagattgaaacttaaaccataaataatttaatattttatatatagaaatagttaagattatagataaacataaagataaaaaagctttttttatttgagttaattctttataaaatctataattttttaataaaatgttgatacccataaagaaaaaaagaatacatataggtaacataaaagtaatatccataatacacccctaatttcaagtttatattaaaaattatatcatttataaaaaaatatgtaaaaagtggaaatttacaaataagctaataaaacttgtaagtatatatacttatttatacaaataaaggtaataagtatgaaaaaaggtaatttgatagattttttttatgaaggtataatttaaacatctaaaacagaaggaagtgaaaaaatggggaatgatttaagtattgttttaaagtacataaaaagttataaggcaaggtcagtagcgattatacttagtatagtattagctacggcacttatagtaggggtaggaactttatctagaagtgcccaacaagcagatttggacaggcttaaaagggaaacaggaacatctcatgtatattttaaagatataagcaagaaacaattagatacgataaaaaagagagatgatatatcaagtctgagtacaacttcatattatgcatctactgatgtaggcgaaaaattgcctataaatatattaaaagcaagtgaaaattatctaactaaagacacaaaacttttaaaaggtagatttcctgaaaataaaaatgaaatagtcgttgaagaatgggtactaaacagtatggggcttgagcctaatgtcaatcaagagataacatttaacttatataaaaaagataaacctgaaaagttcaaagtagtaggggtgcttaaagatagatatcaggagaagagtttaggtagatgtgaagcttttctaggccaagagaattctaatgaagataaatatacagcctatgttgaatttaaaaagggtagtaacataaataagaatataaatgaaataacaaatgaagctaaattaaataaaaaagaacaagttagaccaaatttaatgcttatagaatccatacaaaaaaatggaacaattgatacctctagtaaaattactgccatagctttaagttgttttgcaggacttgtaatatacagtatttttactatatcaatatatcaaagaataagagaatatggagtattaagagcattaggttgtacaaatttaaaaatatttaaatttgtatttggagagcttttaatgttaagttttattgctatacctataggtattgtattaggtatgggaggagctcagatttttaataaattagcaggtaatatacaatttgaaggaaatataaaggaaacaccttttgttataccgagaaatataattttactagcgatatgttgcacaattttagttatatttgtaataagtatattaactttcataaaaataaaaagaatatcaccaattgagtctataagaagaaactttggatcagataaaaaggtaaaaagaagtagattgttaacatcaagattatttaaaaatatgtatataactaagtacatatctttaaaaaatatattcagaaacaaaaagggatttataatgattatactatcaatgagtattggaggaataatggttataaacaccaattataaaatgagtggagaggaaaaaagaatcgaaaaaatagatagacagacatgttttaatggagattttatattaactgtaaatggagcaatagatgaggaaaacgggttaagtaaggaacaactaaaagaaataaaaaatataaatggtgttaaaaacgtagaagctgctaaaattttaaatacaagaatgcctatagaaaaaagtaaaattttagatatagagttttttaaaaatcaagcaaaacctggtggatactttggtgaagttttaaatggattaattatagacgataagaaaaacaatgaatatctattaaagcaaaagctaaaaggatataatacagaaatgctaaaaaaattaaataaatatttagtaagtggagagataaatatagacaaaatgaaaaaagaaaacttagcagtagtatatgtcccacattcttatcaaaagtttgaaggatatagagatgtaggagaccatacttatggaaagcctatagtagacataaaggtaggagatactgtaaaagttaaatatcctaaggggaaaatagatacagaaaaatattggaagggtattggagactatgattttattgaaaagtcttttaaagtaggtgcaatagtagattatccttttgcagatgataatatgtattctggagattgtggagtagatgtaatagtaagtgactcaaacttaaaagacatgacaggtttagataattatgacttagtttatgtaaatcaagaaaaaggatttgatcataaaaaaataaaccaagaattaggaaaaataggaagtaaagtatcaggaactacgacaactgatatgactaaagaaaaagaagataatcaaaagatgaatcaaaaaataatgctatataattacggtataatagcagttatgtttactataagtatatttaacataataaacaacgtaagttatagtttaacatcaagaactagtgaatttggaatgttaagagctgttggaatatctgaagaaaaatttaaaaacatgataatttttgaaggcttattatatggtatagtatctagtttaatagtaattattgtaggtgtattattacaattacatatttataatgcatttagatttgaaagcttgggtatgaattttaaaatattatatgtagactatatattaataacgataactaatatagcaataggattgttatctacatattttccagcaagaaaaattaagaaaagtagtatagttgaatcgataaatataatagaatagaggggatagttatggcaatacttgaaactattaatttaggtaaaatatatggaaagaaagaaacagaagttcatgcactaagagatgcaaatttgaaaataaataaaggtgaatttgtagctatagtaggtcctagtggaagtgggaaaagtacttttttacacttaataggaggactagaaagaccaagtagtggaaccataaaagtagatggtatagatatttgctgtttaagtgataaagaactggcaagatatagaagggaaaaagtagggtttgtatttcagcaatataacttaatacctgttttaaatgtagaggaaaacatagaattaccaataaagcttgataacaaaaaggtagataaaaaatatataagtgagcttatggatttattaggattaggcgatagaaaaaatcatttaccaaatcaactatcaggggggcaacaacaaagagttgcaatagcaagagcgctatcagctaagccaagtataatacttgcagatgaacctactggcaacttagacactaaaactacagaagaggttatggaactacttaaaacttctataaaaaaatataaccagacattaataatgattacacataatgaaaacatagctaaaaaagcagatagaataatatctataatagatggaaaattattaaataaataaaactttaaaaaaggggctaatctctagtttaagatagccctttttattatattcttttataaataattggatcaacaaatccaaaagttattttatcattcttatagaaaacttcacttacatataaagttgaagcttctatcttttctttaagttcaaatttagttataggtgtaaaataactagtactttcacctgtaaatatgccattacattcattatatatcataggtgtaaacttttcagatttaactaaatcattataatccataactaagtcatcattatcatttctaaaatcttctttagatatttctttaggaagctcataagaagttaaaacaactttgttatcttcatttaaagtaaataaaaataaatgaggtaatatattgttaaagtttccttgtttatagtaactttcttctatgacaaaataaccatcaaaattagccggtaagttttttatcttatcattgcatataccatttatatgctttgcataagggtgttttaactcatcatccttaagctctttttctatttgttcgtcgttattaaatgtaccgcataaattttttacaaatatatctaatacagtcataattaatccttctttcttaagtttgatatttagttactaaaaagcttaattctttaaaataaatttatcactagaaaaaatttattacaagtatgtttattgaaaaaaatccaaaagatttatatgcaaatatgtttatgaaggaaagaattaattaagctagaataattaatttattaaaaacatattatttaacgtaaaatttaagtatcggaggctataatgattataaagttaagtgaagattaccataatcaacttattaattatttaaatcaagaagaaaattttaatttaataattggtggagatataagaagatatggatatgataattgtttttttaacatatgggcagactttgatgtagttggagatataaaaggtgtattaatacagtattttgatatacttaccatttattctcatgataattatgatatagttagttttgttaattatataaataaattaccatatagtgttataaatgggaaaatagatactttaaaatatatagagccttatatttcatataataaaaaaagaatagcaaacttttgtgcattaaaaaatttaaagtttttaaatgattatgaaatagattcaagtgtaaaaaaaataagatttggaaagataaataaaatactagagctttatgaacatatagacgagtttgaaaatcctactataaagagtataaaaagtaatttgaaaagtggaagaggttattatatagaagaaaataaaaaagtagtatctatggcaaaatcaacttctgaaaatagcactcatgctatggtggtaggtgtaggaactcatccaatgtatagaaataaaggatatgcaactaaatgtgttataaagttatgtaatagtttattaaatgataaaaaaataccttgtcttttttatgataatgaagaagcaggaaaaatttataaaaaaatagggtttaaagaactaggtcagtgggtaaattattataagtaaatttatttaaaggagtgaataatattagaatttactccttttttaattcctagaaaaatactatgaatttaatgttgacaaaaatactatgatataataaaataaatttgaagataaaacctagtaagttagtcggaaatacctatttgaaaagaaggtgtaaaaaatgaagctatcaactaaaggtagatacggactaaaagcaatgtttgagctttcacttactcaaagggatggaccagtaccattaagacagatagctcaaagacaaaatatatcagaacaatatcttgaacaaatattttcgtcacttaaaaaatctggattgataaaaagtgtaagaggtgcacaaggaggatatttattagttaaagaacctaaagatataacagtaggagatatactaagggtacttgaaggacctatttcgatttcagattgtgtaatggatgaacatatatgtgaaaattctggaatatgtgttaccaaagttgtttgggaaagaattaagcaaggcatagaggatgttataaattcaataactcttcaagatatggtagatgattataataaaaataaaaatataaatgatataacagatttaattataaaatagatttaggagatgaataaaatggaaaaaagaaagatatatatggattattcggctacaactcctgttaaaaaagaggtattagaggctatgatgccttactttactgaaactttcggaaatgcatcaagtttccattctttcgggagagatgctaaaaacgtattagataaatcaagagcaacagttgcagaacttataaatgcaaaaccaaatgaaatatactttacagctggtggaactgaaagtgataactgggctatcgaaggagttgcttttgcaaataaagcaaaaggaaaccatataataacttctaaagtagaacaccatggtatacttcatgtttgtgaatacctagaaaaacatcacggatttgaagtaacttacttagatgttgatgcagatggtagagtaaatgcacaagatatagaaaaagctataacagataaaactatattaataagcataatgtttgctaataatgaagttggaacaattcaacctataaaagaaataggagaaatagctaagaagcataatgttatattccacacagatgctgttcaagctgcaggaaacatacctatagatgttaaagaattaaatatagacttaatgagtatgtcatctcataaaatctatggacctaaaggtataggtgctttatacataagaactggtgttaaattacacactttcgttcatggtggagcacaagaaagaagaagaagagctggtactgaaaatatacctggcatagttggatatgctaaggcatgtgaacttgcaaaagctaacatgggtgagcatatagaaagattaactgctttaagaactagacttatagatggtatattagagagaatacctcatacaaaagttaacggaagcttagaatatagacttccaggaaatgtgaacttctcatttgaattcatagaaggagaaggaatattattaatgttagatatgttaggtatagctgcatcaagtggatcagcttgtacttcaggttcactagatccatctcacgtacttatggctatgggattacctcatgagatagctcatggttcattaagacttagtataggagattttacaacagaagaagatatcgactttataatagataatttaccaaagataatagaaagattaagaagcatgtcgccattatataacaaattagacaagggaggtaagtaatatgcaatacagtgaaaaagttatggaccatttcatgaacccaagaaatgttggagagatagaaaatgcaagtggagtaggagaagttggaaacgtaaaatgtggagatataatgagaatatatcttgatatagacaatgatactaaagttataaatgacgttaagtttatgacttttggatgcggatcagctatagcaagttcttctatggctacagaattaataaaaggaaaaactatagatgaagctttagaaataactaataaagctgttgcagaagctttagatggtttaccaccagttaaaatgcactgttcagttttagctgagcaagctataaaagctgctttaatagattattctaaaaagaataatatacacatagctgcattagatggtgttgttatagaagatgatcacgatcatcatcatgatgttgaagaagaagagtaagataatattaaattaaaaaggagcatttgctccttttttttatgtgaatttttatatttaatgaaactatttaagtgtgtatttcgtctaatatatgataagattttttaaattgtaagaaaatcttaagatttatattaattatttcttaagatttatactttattatataaatatagaaaaaagtaggattaagagggtgtaataatgtataatcaaattcgatgattaatttaagagaggtatataaatgagcaatattttagtagtagatgatgataaggaaatagtagattctattgaaatttatttaaaaaatgaaggttttaatatatttaaagcttatgatgggatagaggctttagatatactaatcaaccatgatatacatttaattctcatggacattatgatgccaaaattagatggaataaaggcaactataaaaattagagaagaaaaaaatattcctataatattgatttcagctaaaagtgaagatagtgacaaaattattggattaaatataggggcagatgattatataactaagccatttaatccattagaacttatagctagaactaaatctcaattgagaagatatataaaattaggaacctatgaagcacaagaaaataaagatattcttcaaagtggagatttaaaattaaatattagtacaaaagaagtttttgtagaagatgaatttgtaaaacttactcctatagaatttaagatactaaatcttttattatctaataaaggtagagtgttttctatagatgaaatatatgaaaaggtgtggaaagaagatagctttaatgcagaaaatactgtaagtgtacatattaggaggattagggaaaaaatagaaattaatcctaaagaaccaagatatttaaaggtggtgtggggagttggctataaagtcgagaagttataatatattcaaaataaaaagatggaatatacaattagttttgcattttgtaatgttacttatatttttcttttttactcagttaggggctgtattaataggatgtatatatttagaaggaaaaataatattacaatttgtaggtttaattattgcgaattttatattttataaagctatgactgggatgaatttattgtaaaaagaaaagcaggtggacaaatgggaaaattaaataaaggtaataaatggataaaaattgcatttttaattatatttttgatatcaacttcaatatttttagcaacagggcaaaaaatgatagagggatatgaatttcattatataaaacaaagtaacttattagaaaaaagtaataaaatatatgcagataatttttttgaaacggataactttgataatcaaattcttcaaaatttaatagatagaatggtggtagcaacttcaaattcaggtgattatgaaaatgaatctatagaaaatgcaaagaaagatttaagtgaatttaaagatgtaaagttttttataaaaaataattcaacaggtaaaacttatacaaatactaattatgaaagtaataaagtttttagagaaaatcaaaaggattattgtaatatagaaattgatttaaataataatgaaggcacatatacaaaaataatcgataaaaaaagattatcatcaaatatatattcaaattatttttgggtaatgcaagataaaccagaacctatatcaataagtatatcaattccaaaacagataaataattatgagccatttggattaaggtcatatcaagatgattttaaacattcacgtaataatatagatattttatttaaagttttaatatcttctggtattataagtataatttctaaggcagtggactgcaactccttgatccccagttcgaatctgggtgtcgcctccaaatatttaaattcgggaatatggctcagttggtagagcaattgactgttaatcaatgggtcacaggttcgagtcctgttattcccgccatatgctagtgtggctcaacggtagagcagctgacttgtaatcagcaggttgtaggttcgattcctatcactagctccaatgaaaagtagactattagatagtctactttttttatgaaattatataaagtttaagtcacatgttaaggaaagtgaatgaatatctatattatttttaaggtgatttttatgagcttctatatctggggttgtagtaggaataataatatctttctttttaaagagcctactatgagcaactagtacaagataagcaaatccatagttattatatctattaccattaggtggcatttgtaagttatttatatgctagatatggaagagaatcatctaaaggaaacaacttaataattgagagaattaatcaaggagcagggaatataccatttagaatggctccattagtattttttggtactccaattggaggaactatatttggactcgaagtaagtactgtcggtaagatgcgatatgaagctataataccttgttttatagcgagttacataggaaattttgtagcaaaattatttaaaatgcaacatagtcactataatatagtatctcctataaatggggttgatgtattttaaaaagttatattatgtgagattttatttggacttacaagtaaactttttgatgaacttatacatagcttaaaaaattatttgcagaaaaaatacctaacacatcactaaagagttttataggaggtataataatacttggaactagaatatatcttggtctaagtttagatttactaagtgatgcatttataataaaactactattaacatcattaacattagcggtaggatttcaaggcggtaaggttactctattatttgtaataggagcaatactaggaaatttattagcaggagctactaaaacttcgattgcatctcttgtaatggaaatagagttatcgggatctgctagcatagaatacttgtttattgtttgtgtaataagttatgtatttgatgatagaagtggaatatatacatcctcagatagtagtttgttagaaataaaaaaagattagcgtttagctaatctttttttatttctaacatatatattatttttataaaaaataagtagaaaaaaattaacacttgatatatactaagtattagtactagataataatatcaggagggaaaaatgaagagaaaagcaatcataataatttcatcggtttgtatattattatttttaataatatcttacgtagttggtttcttagtatatgatggttcggttggttctgttcaaaaaataaaagatgaagatatagtagaagtattttctcatagagaaggaagaccactagaaaaacttaaaaattataagtatgaagatgtatttataagttctccagaaaatggatataaagtagaaggtaaatttataaagtctaataaaaatactgacaatacaataatactagttcatgggattgaaagtaattactatgaatatttaaaaaaggcatatgaatatttagatcatggatacaatgttatgttatataatcaaaggcacacaggtaaaactggaggaagtgattatacttttgggttaagagaaaaatatgatttagaaaatgttgctaagtttattcataaaaaatatcctaatggattattaggagctcatggacattcaatgggggctgcaactgtagtaatgcattctgaaataaatgaaaaaaataggtatgtaaatttttatatagctgattcaccatatcatgaaatgtcggatgctataagattaggtattgaagcaaaaaacataccacttttacctgtaggatatgcaagaactatggggaatatatatactaaagttaaatcaggatttaattatgaagatgtaaaaccatataaatcagtacaacatataactacgccgatgtttttaatacatggaaaagaagataaagtatgttctccaaaaagtagtcagataatatatgataatataccacatgataaaaaagaaatttggcttatagataaagttcaacatgtcaatggatatgatattctaggagatgaatactttaatagaatatataagtttatagatgataaagttgttggcaaatagatttaaaaaagaattgatgttattttatatttatttataatattatgatataatttagtgtatattttatattaaggtggagatttatatgagtaaaggatatgtatgtccaaaatgtagtaatactgaatatgaaaaagatgaaatatgtacaacaggtagtggattttctaagatatttgatgttcaaaatagaaaatttacaacagtaacttgtactagatgtaaatatactgaaatttacaaagtgccaacaaataaaattgatgatatattcgattttataataggttaatataattaaaaacaagaagactgcttggtaatcaagtagtctttttttatattaaaatagaattaagaaggttcctaattaatttaagacaatttattttaatgttttacttaaaaaataaaaaattatgagaaccaattttatataaaaactatctaatatatagaagaattgataatgagggatgggaggatgacgcttggatatagtaaaactagtcaaaaaaagtaaaaaggggaatgatattgcattttctactttaataaaaaactatgaaaaagatttatatagagtagctatagctataactaaaaataatgaagatgcattagattgcattcaagaaactatattaaaagcttatacaaatataaaaaatttaagacaagaaaagtattttaaaacttggttaataaaaattttaataaatcaatgtaattacacagttgaaaaaaatagaaaatcatcaaattgctttaatgaaaatatacacaattcatatatggataattctgctgaaatagaaattaaaagtataataaacaatctagaagaagaactaaaaatactaataattttatactattatgaagacatgggaataagcgatatatcagaaattttaaagatacctaaaggaactataaagtcaagactatcaagggctagaggtaagttaaaagaaatgatagatataaactaaatggaggacttaaaatggataagaataataagcttgatatagagataaataaattcctaagagaaaaagataatttagaagttccagtagaaataattaagggaattgatgatacattaaagagtataaatgaaaaaagacaaagtaagaaaataaagagagaattaatgatagcatcaatcattggattgatagtaataacatcagcgccatttattgtaaaagcttacattaaccaaaattataaatatattccaggaagtggaatggttacaactgatgatggattaaaatatatattggaaagacctatttatcaaaaattaaataaatcaacagatataactttaagggatataaatataaatgaagctaataatgaaataagtgtaaaggtagaaggagagttttatgagcctagtgaaatatctacaatagagataggaaatagaaaaaaagtttcaagaggatacatatcaacttcaactagtggagatggcagagctgataattgggtatatgaatgtacatttaagtattataaaaagtataaaaatgataatataaaatttaccatgaagtgggaaagtggggaaagtgtagaatttaacacaaaacttatagaggttaagtcaaaatcagatattaaaagccttggagtaactgatactaaatgtaatatgactataactgctatgatagaagaaggtaaaaataaattggatgtaaactttattaataatagagacataaaaaatgaattaacattttatggacaagaaataaatgaaagagatgtttatagtaattatgcaagaaaacaaaaagacgttataaaattaattgattcaaatggtaaatttgcagtaggggcatttatagaacatccagaaaggtataatcactttagatttgatacaactaatttaaaaaagccatataagataattatacctgaaatatcaacatttgcacttaatgagaaaattaaaagtgaggaattgcaattagatatagaatctgataacgtagaaacaactataaataaaatagtaaaattaaaaacaaatagtaatttatttaaaaatgcaaatgacaaagttaaattaataaagggtattaaagagaatgataattatactatatatatacaaaagctaaacgaacaaaaaaatccaatgaaaattgaaagtatatacataaggccttcaggtgaaagtataaaagatgtaaaagcagatttttttgagggaggtctatcagtaggagctgaagatgaaaatttatactcatatacatttaaattgccatatcccaaaagtgataaattatatataaaacttgaaggaaatagatataatataaaaggaaactggagtttcactattgaataatactagaaaatttgcaaataaaaacaatctatggtatcatagtatataaaatagtatataatgcaaaaactaagagtgagacgaaaagttctcactcttttattatagcatttacaatgctataaaataacaactgaataggagggaagcaaaatgaaaaagagtacagaatcattaatagaagaattagtacttccgataactaatgagcacaacatagagatagttgatgttgaatatgttaaagaagcaggagaatattatttaagaatatttatagataaagatggaggcgtatctctaaatgactgtgaagttataacaagagctataaatccaatattagatgaaaaagacccaataaaagaaaactatttcttagaagtatcttcaccaggtcttgatagaccacttaaaaaagaaaaagattttataagatatgcgggaagagacgtagaagttaaattatataaacctataaatggattaaaacatttcgaagctcaattagttgagttagtggacaataaaatagttaaacttatagttgataatgaagaaatggaatttgataaaaaagatatagcacttataagacttgctataaaattctaattaaaacttaatataggaggacaaaaaaatgaaccacgagtttatagaagcattagatgaattagaaaaagatagaggaattgataaagatatacttatagatactatagaacaagcacttttaactgcttataagaaaaattttggatctgctcaaaatgttagagtatactttgatagagaaaaaggagatgtaaaagtttactctcaaagagttgttgtagattcagaagatatatacgatacattcttagagatagaaatagatgaagcaagacaaataagccctaactatgaaataggtgatataatagaaagtgaaataactactacagaatttggaagaatagcagctcaaacagctaagcaagtagttgttcaaagaataagagaagctgaaagagatatagtatacaatgaatttatagacaagcaagatgaaatagtaacaggagaagttgctagagtaaacaaaaatatagttcatgtaaaccttggaagaatagaagctataatgactcaagcagagcaaataccaggtgaatactatcaagcaggacaaaaaataaaggtatatatattagaagtgaagaaaactaacaaaggacctcaaataactgtttcaagaagccatccaggtttagttaagagattatttgaaatggaagttcctgaaatatttgatggtactgttcaagttaagagcatcgctagagaagctggatcaagaactaagatggcagtttactctgtagatgaaaacatagatccaataggagcatgcgttggacctaaaggatcaagagttaaaaatattgttgatgaattaggcgatgaaaaaatagatataatcaaatacagtgaaaatccagtagaatttatatctgcagcacttagtccatcaaaagttgtatctgtagatgtaaatgaagaagaaaagagtgctttagttgtagttcctgactatcaattatcacttgcgataggtaaagaagggcaaaatgcaagacttgcagctaagcttactaattggaagatagatataaaaagcgaaagtcaagcagctaaagaagcagataataaagaagaattagatgcttaattataaggagtgatacatttgcaaaaagtaaagaaagttcctcaaagaaagtgtatagcttgtcaagatagagacaataaaaaagagttaataagaattgtcaaaaataaagaaggacaaatatttttagataaaacaggtaaagcaaatggtagaggtgcatatatttgtaactgtagcgaatgtctaaaaaaagcaattaaaagtaaagctttaagtagagcttttaaagttgaagttcctgatgaagtatatgaaagcctgatgaaggagataggtgacaatgaataaagccaatgaagccaaaatttactcattcctaggcttagcacaacgtgcaggaaagctagtatcaggtgatgattctactatgcttgatattaaaaaaaatagggtaaaattagtaatagtggcagaagatgcttcaaataatacgaaaaagctatttaaagataaaacatcttttagaaatatagcatgcgttacatattcaacaaaactacaattagggttagctataggaaaagcgcctagagcagttatgggaataaaagacgtgagctttgcagataaggtcttagaacttattgaaaatacaaaaatataatagggggtggtcttgtgtcaacaagagtataccaattagcagaaaatttaggaatgactagcgaagaacttatagctaagctaggagaactagatataaacgtaaaaaataaaaatgatgaattaagccaagatgatgcagatatggctatggaattattaggtgatgaagttgcagcaggaagtggacttccaactgtatcagttgaaggaaaattaactgttcaagaattagctaatagtttagaaaaacctgctacagaaataataatgaagcttatgaaaatgggaactatggcaacaataaatcaagagttaaactttgaaatagcttcattagtagctaaagattatggatttgagcttgtagaaaaagatatgacagagcaagaagaagctgaaatagatgaattaatagatatacaagaagataaagaagaagatttagtaaaaagacctcctgtagttacagttatgggacacgttgaccatggtaaaacatcattactagatgctataagatcaacaagtgtaactacaaatgaagctggaggaataactcaacatataggggcatcagaagttactataaatggagaaaagatagtatttttagataccccaggacatgaagctttcacatctatgagagctagaggagcgcaagttactgatatggctatattagttgttgctgcagatgatggtataatgccacaaactatagaagctataaaccatgctaaagctgcagaagttccaataatagttgcaataaataaaatagataaaccagcggctaatgttgatagagttaagcaagaattagcagaccaaggtttattagttgaagattggggtggagatgtaatatctgttccagtatcagctagacaaaaaactaatatagattcattacttgaaatgattcttttagttgcagaagtagaagaattaaaagctaatccaaacaagagagctgtaggtactgtaatagaagctcaacttgacaaaggtagaggaccagttgctactgtacttgttcaaggaggtactttaaaagtaggagatcctatagttgcagggactgcttgtggtaaagtaagagctatgataaatgataaaggtagaagagttaagactgctggaccatctactgctgttgagatattaggattgtcagaagttccacaaggtggagatcaatttgtagcagttgctactgataaaatagctagaagtgtagctgagaagagacaacatatagctagagaagaaatgttaaaatctaaccaaagagtaagtcttgacgaattctttagtcaaatgtctgatgctgaagttaaagaacttaacctagttgttaaagctgatgttcaaggttctgttcaagctgttaaacaatctttagaaaaattatctaatgaagaagttgctgtaagagttatacatggcggtgttggagctgtaactgaatctgatgttatgctagcaagagcatctaatgcaataataataggatttaatgtaagaccagttgctactgctgaagtaatggctaaaaaagaagaagttgatataagaacttacacaataatatacaaggctatagaagatgtacaagctgctatgacaggtatgttagacccagaatatatagatgaggatacaggtaaagcagaagtaagagaaacatttaaaatatctggagttggtactgtagctggatgttatgttttaagtggtaagatatttagaaatggtaaagtaagagttgtaagagatggattcataatccatgaaggtgaaatagcagcattaaagagatttaaagatgacgctaaagaagttaaccatggatatgaatgtggtataacaattactaatttcaacgatttaaaagaaggcgatataatagaagcttatataactaaagaggttgaaagaaaattaaaatagtaaaaagaggtcgatattatggcatcatataatagaacacaaagaataggcgaagaaataagaaaagttgtaagtacaatgcttataagtggtataaaagactatagaataaattctatggttagtgttactgatgttgaagtaactaatgatttaagttatgcttatgtgtatgtaagtatattaggtggaaataaagaatcaagtatggcaggacttaaaagtgcttgtggatatataagaaaagaagtaggaagaaatgtaaagcttagacatactccggaaattatatttaaattagatgattctatagaaaaaggaatgtatatggaaagtctaattaaaaaagttaatcaagagaatcaaggtaataaaaaagattctaatgaagaaactcaaggagagtaatctatgctaaataatattaacaatattataaaagctataagggaaggtaacaattttattgttacctctcattatagtccggatggagataatataggctctacattatctatgtattacacgcttaaaaaattaggtaagaatgtattatatgtactagatgatactatacctgttaatttaaaatttttagttaaagatataaaaatattaaaatcggaagaaatagatattgatataaatgattatattttaatatctcttgattgtggagatgcagatagaatatgtgttagtgagcatataaaaacatctgttaataaattaatttgtatagaccaccatgcaagcaatgataattttggagatttaaattatataaattcaaatgaatcatctacttgtgaattagtatacaacttactaaaagagttttcaaaagttgtaggtgaaaatataatagatgaaactatagcaacttgtctatacacaggtcttttaacagatactggaaatttctcttattcaaacactaatccgagcagttacttaatggcatatgatttagtttgtataggagctaaaaaagacattataattcaaaaaatattccaaagtaatccatacaattattataagttactaggcgaagctttagatactttagatattgtagagggaaaagttgctagtatgatgttaacaatggatatgctagaaagaaataaaatttcttttaatgatgcagatggagttacatcatatactagagacatagatggagttgaagttggcattttatttaaagaaaaagaacttaatgagatcaaggtaagttttagatctaaaaactatgtaaacgttagtactatagcacaacattttggaggcggaggtcatgttagagcttctggatgcactataaaagatactatagaaaacgttaaaaaaatggtgattgacgaagttttaaaacatatttaaggatgattagtatgaataaaatagtaaatatattaaaacctacaggtatgacatctcatgatgttgtaggtaaggttagaaaaattttaaatataaaaaaagttggtcacacaggtacccttgatccagatgcatcaggggtactacctatatgtataggaaaagctacaaaagtaagtgaacttatacttaataaggataaatcgtatatttgtgaactaactttaggtataaatacagatacctatgattcatcaggagaaataatagaaagatttgaagttggaaatataagtatggatgatcttgaaaaggcatttgatactcaaagaggtgaaataaaacaacttcctccgatgtactctgctcttaaggttaatggaaaaagaatgtgtgatttagttagatctggaagagctgatgaaataacacttaagtatagagatgttaatataaaacaattaaatatactttcatttaaagataataaggtaatgttttatgttaaatgctctaagggaacttatgtaagaagcatatgttatgacataggtgaaaagctaggttgtggtggacatatgtcttttttactaagaacatcatcaggaaagtttaatttagaaaatgcaataacattagaagaattagaaaacttatataaagaagataaattagataaacacctatatgacatagattatgtattatcaaactttaatagcatacatataaatccattagctgttaaatcgtatgttaatggagctatagtgtataaaaaagggtttgtaaaaggaaattttaatgaaagtgatgaatttgtaagagtatacagtgaaggtaagtttttaggagttggaaaattcctaaaagttgatggcacattatgcttaaaaagtgataaactatttatatagaatataagtagtggagaatttattatgactattataaaatcattagataaagtaataaatattgaaaatagtattataacaattggaaattttgatggtattcataaagggcatataaaattaataaaaaaagctgttaaagaagctaaacacaaaaaattcaaaagcatagtatttacttttgaaaatcatcctatgagatattttagggaaaactctataaaaagtataattacgaatgacgaaaaaataaatatattaaaatcattaggtgtagatataattcttatggttccgtttaatgaatatatgacgaaaatatctgctataaattttgttaaagaaattttaatagaaaaattaaagtgtaaaaaagttatagtaggacatgactttacttttgctagaaacaaagaaggtactgtagaaaaattaaagtcaattggaaaagtatataatatggaagttgaagttataaatcctataaagataaataatataagagttagtagtagctatataagacaacttattagtcaagggaaagttcataatataaaagactttttagggagaaattattccttagaaggtgaagtaattcatgctaagaaactaggcagaactataggttttccaactgctaatttaaatatagataataatttaattatacctaaatgtggtatatatgcagttaaagtatacttaaaagataagacttactatggagccactaacataggttataatccaactgtaaatggacaaagtttatctatagaaactaatatacttaattttaataaagacatatatggtcaaataattaaaattgagtttttagaaagaataagagatgaaagaaaatttaattctttagatgaattaaaagctcaattacataaagacgttaactttgtatacaaaaagtatgtttacaagtagacatgttttgtgttaaaataaaattcgtgaaccattactcggcatttgaacactccaatcaatgcttagtaattggggatttaataaaataatggaggtattcacaaatgaacaaaactgaaataataaaagaattcggaagatttgaaggagatactggttctccagaagtacaaatagctttattaacagctagaataaatgaattaaacggtcacttaaaagttcacaagaaagaccaccactcaagaagaggtcttttaaaaatggtaggtaagagaagaaacttattagcttacttaaaagaaaaggacttagaaggatacagagctttaatagctaagttaggattaagaaaataatttaattattttaataaagaagaaggtttataccttcttcttttgttttaaatattttaaataaatacagtttttattgaaaatagaaataatttgcaactataataatattaaattaaaatatataaaggaataatgataatttatatagaaatttttcttttaggaggggatttactatgaaaataaaattaatgtgtgatagtttatgtgatatacctatggagttagcagaaaaacataacatagaaataattccattaactataataatagaagataaagaatacaaagacggtgtagatatgaccgaggaagagttttacgaaactatgaaaaaaataaaaactgtacctaaaacatctcaagctacatacatgcaatttaaagaagctttcgataaatataaagatgaatactctatagtttgtataagtggttcatctaaatcttcaggtacatatcaaagtgcagttatggcgaaaaatgatacagatggagatatacatatatttgatacacttaacttatctttaggaagcggacagtatgttataaaagcatgtgaacttatagatgaagggttagatgctaagtctatagtagatggattagaagctttaagagaaagtgttaatctattttttgtaccagatagtttagagtacttaaaaagaagcggaagagtatctgtaacgacagctgctattggaaatatgttaagtttaaaacctgtattttcggtaaaggatggaaatatatctttacttacaaaagtaagaggtaaaaaaaatgtaatacataaattaatagatttacttaaagaacaatatgaaagttttgaagataaaaatgtaatgataggttgcggagctaataaaaatgagtttgagattcttaaaaaagaagttcaagaggcaataaaagctaaaaatatatacttaactagaggtggagcttgtatatgctcacatacaggaccagatataatagctattagttgttcaaattaaatgtattaaattttacatattaagcaaataataagttaaaataaaatatttgctaagttacgttttgtatctctaaaacatatcaatacaagccagtaatttacttttatgttgttaaattatagtatttttgataagatagtacataggatactaaacgcggttttaataaagaggaggtacaagcattaatgtttgaacataaagtttttaagatggattttgcaggaagagaactttctgttgagataggaaaaattgccgaactagctagtggaagcgctattcttcagtacggagaaactatggttatggtaaacgtatcaaaatcagctcaaccaagagatggaatagatttcttccctttaagtgttgattatgaagaaaaattatattcagtgggtaaaataccaggaggattcttaaaaagagaagggaaaccttcagaaaaagctatccttacatcaagacttatagatagacctataagaccactatttcctaaaggatttagaaatgatgtacaagtagttgcaactgttttatcagtagatcaagattgtactcctgatatagtagctatgataggatcatctgtagcgttatctatatctgatataccatttaatggaccaactggttctgtgttagtagggttagtagacggagcatttgttataaatccaacagcagaacaaagagaaaaaagttctcttcatcttgtagtatcaggtactaaagatgcgataatgatggttgaagctggagctgaagaaataccagatgaattaatgttagaagctatattatttgcacatgaagaaatcaaaaaagttgttgagttcgtggaaactatagctgctgaagttgggaaagaaaaaatagaggttactctttataaaatagatgaagaagtagaaaaagctgttcgtgagtttgctacagataaaatgaaagaagcagttaaaactgtagaaaaacttgaaagaatggaaaaaatggatgcagtaaaagaagaaacttttgctcattttgaagacatagtagaagagttcggacaagatatagaggaaacgttacattctataataaaagaagaagtaagaaagcttatagttcatgaaaatataagacctgataatagaaagccagatgaaataagaccaatatggtgtgataatggatttataccaagagctcatggttctggattatttacaagaggtcaaactcaagttatgtctatagcaacacttggagctttaggtgatgttcaaatacttgatggacttgatgaagaagaaagtaaaagatatatgcatcactacaatttcccagcatatagtgttggtgaagctagaccatcaagaggaccaggtagaagagaaataggtcatggtgcacttgctgaaagagcattacttcctgttataccttcaaaagaagagtttccttatgcaataagagtagtatcagaagttttaagttcaaatggatcaacttctcaaggaagtgtatgtggatctacattatcacttttagatgcaggtgtaccaattaaagatatggttgcaggtattgctatgggtcttataaaacatgataataaagttgcagtactttcagatatacaaggaatggaagatcatttaggggatatggactttaaagttgcaggaactgaacatggtataacagctatacaaatggatataaaaatagctggtatagatgaagaagtactaagaacagctttaaaacaagctagagtaggtagaatacacatattaaatgaaatgagaaagacaatagatgctcctaagccagaactttctaagtatgcacctaagatagtaacaatgaatataaacccagataagataagagatgtaattggacctggtggaaaaataataactaagattatagatgaaacaggtgttaaaatagatatagagcaaacaggagaagtatttataagtggaatagatgctgaaatgatagcaaaagcacaacaacttatacatgatatagttgctgaagctgaagtaggacaaacttatacaggtaaagtaacaagaataatgaactttggtgcttttgttgaaatacttccaggaaaagaaggattacttcatatatctcatatagcacatgaaagagttaataaagttgaagatgtactaaatataggagatgaagtaacagtaaaagtaactgagatagatgaaaaaggaagagttaatttatctagaaaagctcttttaccaaaaccagagaaaaaagaagttaaagaaaataaagagaatgaagataaataataatttataaaacaaaacaccctcaagtaaaatataagagggtgttttattatgcaaaaaatatataagcattttttacaatagtaaaagcactttaagttatataagcattttaaaatacaatatataatataaatgcataaaaagttagactacctaatacaatttaatgagagtaaattgtacatattgggaggaagttttttatgataatgatggtacttaataaaaagaaggtaaaaaaaattttaataatatcactagttatagtactagcaattataggaattatatttatgtctaaaaaagggacgacgcctacaattaatatgttttataaagcagaggaaccatattacaatggaacaaaatccaatagtggtcacgttgcaataagttgcaacgtagacctaggatgggaaagtgaatatatagaaaagatacttaaagtattagatgaaaaaaatgctaagataactttcgctgtaacaggtagatgggctgaagaaaaccctgaatttctacttgaaattcaaaaaaaaggacatgaaatagctaatcatggatataagcatttagattatgctacattaaactacgataagaactatgaacaaataaaaacatctaaagaaataatagaaaatataataaaaaaagaaactaaattttttcaagcaccaggaggttcatttaataaagatactgtaaaagcggctattgatttaggatacacgccttacaaatgggatatagacacaatagattggaaaaatagacaagaaccagaagttattataaatagagttaagtcaaaagatatgaaagattctagtataatacttatgcatcctacgcatgcaagtgctgaaggcattgatgatattatagggataattgaaagtaaaaatttaaaaccaggaaaacttagtgatgtatttgagctttaaaagtttatttaagttattttgatgttgaataatttattttactaaattataatttaaaggacattagctaagatacaaatataaatgattatcataaatattataatgcacaaatcaaattggaggatgagtatgtataagatacacaagttagaaaatggacttacaatagtaggagaagaaataccttatttaaaatccataacgttaggagtatgggtaaatgcaggatctagaatagaaagtgaaaaattaagtggagtatcacattttatagaacatatgctatttaaaggaactaaaaatagaacatcaaaagaaatagctagtacaatagataatttaggtgggcaaataaatgcctttactagtaaggaatgtacatgttattatgttaaattattagatgagcatataaatataggattagatatattaagtgatatgtttttaaatccattatttgataaagaagatatagaaaaagaaagacaagttatattagaagagctaaaaatgtatgaagactctccagaagatttagtatatgacttacttatggagggaatatacaaaacagatgctcttggaatgaatataataggaactaaagaatcattatataatattaataaagatactataaaagattattttaataaatattatgtagctagtaactctgtaatatcaattagtggtaactttaaatttgaagaaatggtcaaattaatagaagataaatttaaaaatttacctaaaggaaatgcagatatagaaataacaacaccagaatttaatccttgctttatagctaaaaataaagatactgaacaagttaatttggctataagcttaaaagcaataccactagaagatagagaagatgcatatgctttatctatagtaaataatatatttggaggaagtataagctctaggttatttcaaaatataagagaaagtaaaggacttgtttactctatatattcagcacctagtctttatagaaaaagtggagagcttggtatttacgcaagcatgagtaacgaaaatctaaaaaaagtatataatttagtattagaagaaattgataacttaagaaaaaatcatcttacagataaagagataaaagaaagtaaagaacagttaaaaggaagttatattctaggtttagaaagtactagtagtagaatgatgtcaattggtaaagccatgattttaactaggaaagtaaaaaatcctaatgatattatagaaagtataaataatattgataaagctagaatagacttaattatagacaaggtatttaataaagaaaatattggagtatgtattgtaggaagagatgtagagaatataactttagactaattagattagacatataattaagcttatctataataaagatatattagtttatatggggggatacttatgaatttatctgaagtagcaggtaaggagattgtaaatttagttaccggagaaagattgggagttgttggagagtgcgaccttataattgaagatactacagggaaaatattagctttattaattcctagagaaagaggattttttggatttaggaaagataaatcagtacttgaagtaccgtggagaaatgtaaaaaaaattggtaatgacatgattataatagaacatgaaggcatgtattaggaggataatatgacaatagtagttcaaaaatttggtgggacatctgtggaatctaatgaaaaaatgcaacaagtttgcaatataataaaagactataaggacaaaggattagatttagttgttgtagtttcagctatgggaagaaaaggagcaccttatgcaactgatacattaataaatttatgtaaaggtgttaatgatgattcatctaagagagagttagatttaataatgtcttgtggagagataatatcaggaactatacttactaacatgttaaaaggatatggtatagatgctgtatttttaacaggtagtcaagctggtatatatactgatggaaatttttctgactctagaatagtagatattaagccagaaagaatatataaagaattaggcgaaggtaaagttgtaattatagcaggttttcaaggaacaacagaaagtggagaagtaactactcttggaagaggtggtagtgatacttcagcagttgctataggtaaagcactagaatgtaaaaatgttgaaatatatacagatgttgatggaataatgacagcagatccaagagttgagccagaagctaaggttttagattatataaattatgaagaagtatttcaaatggcagataaaggtgctaaggtaatacatccaagagcagttgaaattgcaaaaagtggagcaattactttaaatataaaaaatactttaaatccatcgcatccaggaactaaaataagtggcatgagtcctaagtttgaagtaaacaaagaagcaaaatctataaacactatgacagcagtagctcatacaagtggagttgctcaaattaaagttaaatcaagagaagatatatttactgatataatggatgagatagaaacaaatgaaataagtttagatatgataaacttttttatagaagaaaaagcttttgtaattgatcatgataagttaaattcattaacagaaatacttaaagcacataaacttgattataaagtaaaagaaaattgtgctaaggtaactttaattggatctaaaatgactggaacaccaggagtcatggcaaaaatagtaagagcattatcaaaagctaaaataaacttattacaaacttcagattcaaatatgaccatatcttgtttggttgaagaaaaagatatgaaaaatgctattcatgcaattcatgaagaatttaaattaaattaataatatcctccttttttggttaacttatatgtaaagttaaaccttaaaggaggatgtttttatgtctaataaaaataaaaaaacaaacaataatcaaccacattttaaattagagtttggagaagaattaagtttaccggcacatttaagacctaaaaaaagtggttctgtagctcaaaatacatcaagaccaataagtaaacaccctaaaggtaaatagattaaagtaagtcttaaaaggaggctacatatgaactttttatataatgataagaatacaaatgaaaaaaacaatttaaaatcagaagaaactgaaaatgacaatgaacaaactgaaaatatacaagatattaaacaaatgggagttccaagtattccagaacaaaatattaaagatatacagtgtataactataataggtgaaatagaaggtcattttgcaggtaatccacaaaaaaaatctacaaaatatgaacatataatacctatgctatttgcaatagaagaaagcaaagatataaaaggtgttttaataattttaaatacagtaggtggggatgttgaagctgggcttgcaatggcagaacttataaatagtttatctaaaaaagttgttactcttgtgttaggaggaagtcacagtataggagttccacttgcaacagcaggagattactcatttatagcacctactgcaactatgatagttcatcctataagaactaatggtttagttattggagttaatgaaacttttgaatactttaaaaagatgcaagagcgtataactcagtttataatcagaacatcagatatagaaaaagaagacttagaaaaactaatgtattctaaagaagagttagtaagtgatgttggaagtgtattaataggcaaagaagcagtagattgtgggcttataaatgaagttggtggattaaaagaagcgatgattaaattaagagaattgataaatgaagagagtaatgaagataacaaaaatgtaatcaaataaaatttggttaaataatagaatatatgctataattagaagatataaaagtgttagtgtttaaatacattagcactttttgctatgattttggagtttattaattcttgtataaatttatttttaagaggtgagattgatggctaagaaaaaatctaaaaagaaaaaaaatatggaatcaagttttaaagctgaatacaataacctgataactatatttataggtatattcttattatatagtttaaactctagttctatgggattattaggtacagttatacaaaatatatttttaggattgttcggaaaattatcaatagctataccatttataataattattagtggtgttttaggattttttgaaaaaaatgaatatatctatagaattaaaagtactaagttatattatgtaggtgtaatttttatattcatattttatggacttataaatgcaaaaaatttacctatagatagtcctactaattcatatgtaattaaagaggtaactaaacaagctgtacaaggaaatggatgtggacttatagctacagttattacatattatgtaactaagatatttggggtaactggtgcatggttaataagtatatttgcattactaataacatgtttatttacatttaatatatctttaaaagatttaatatataagataaaagtaaaaactcaaaaaagcaaaaatagtaatcttacttttaaagaaaaagccttaaacttaaaagatgctatggttaatatggttactgaagaagttgatgaaaatactatggttacaaaaactggattaagaggtaaatctaaaaaagaagaaataagtgaaaatagtatagaagatgatgaaaatgacaaaacaataaagatagtaggttttaataaagcagatgatgactatttagaaattctagaaggcactcaaagtatgcctgagttagaagttttaaaagaattacaaaaggcaaaacctaatcagaaaacagaggtttcaagcaatcaaaatgatagcttagaaaagactcagcctatgggtataaaaacagagtcaagttatgaaaattacaaaaaacctagtgttgacttgttaaataaaatagactcaaagcctgatgataagagtaagaaaaaagtattaaaaaatgcatctttattagaaaaaactttatctgattttggagttgaagcaaaagttaatcaagtaacagtaggacctactataacaagatatgaacttcaaccgagtccaggagtgaaggtaagcaaaatagtaaatttaacagatgatatagcacttagtttagccgcaaaaagtataagaatagaagctccaataccaggtaaaagtgcaataggtattgaagttccaaatgaagaagcacaaatggttactttaagagaagttcttgaaagtgatgaatttaataaatttgaatcaccacttgctatggggcttggaaaagacatagcaggaaagccaataatagctgatattggtaaaatgcctcatttacttatagcgggatctacaggttcaggaaaaagtgtatgtgtaaatactttaataaatagtatattatataaatcaaatcctgatgaagttaagttcttacttatagaccctaaggttgttgaacttgcaaattacaatggtataccacatttattaatacctgttgtaactgatcctaaaaaagctgccaatgcacttaattgggcagttacagaaatgaacagaagatataaactatttgcagaatcaagtgtaaaagatataactagttacaatgaaaagagtgaagagaaacttccgaaaatagttataataatagacgaactagctgaccttatgatggtaagtgctaatgatgttgaagattatatttgtagattggctcaaatggcaagggctgctggtatgcacttaatagttgctacacaaagaccatcagttgatgtcataactggagttataaaagctaatataccttcaagaattgcatttgccgtttcatctcaaacagattcaagaacaatccttgatatgggtggagctgaaaaacttttaggtaaaggagatatgttattttacccattaggggcagcaaaaccagtaagacttcaaggtgcatttatatctgaatctgaatctgaaagagttatagattatgtaaaaagtcaagtaaaagatgaagttaaatatgaagaatgtattgtagatagtataagtaaaatatcaaaagaacaatcaagtgatgtggatgaatttttaagtgaagctatagaatttgttgttgaaagtggacaagcttcagcttcaatgcttcaaagaaagtttaagataggattcaatagagcggcaagacttatagattctatggaagaaagaggaattgttggaaagagtgaaggtagtaaacctagaaaagttttaataagtaaacaagatttagaaaatttagaaggtgaataaatttgaaaacaataagtgtaaaaaatgcattaaatttaccaaacactatatttatagatgttagaacagaagcagagtttaatgaagatcatatattagatgcttttcatatgccactatttagtgacaatgaacataaagatataggtactatatataaaatgcaaggaaagcatgaggctatacaaaaaggatttgattatgttaaagataaattaaagcatatgtatatggaagttttaagtttagctaatgaatatgagaatatagttatatattgtgctagaggtggaatgagaagcggaagtttagcaaatatgatagctactttaggtgtaaatgtatatcaattagaaggcggatataaagcatatagaaactttgtattagattactttaaaactgttatggatactaaagaatttatagtacttcatggtttaacaggtgttggtaaaacagatatgctaatgatgttagaagaaaaaggtatagatattatagatttagaaggaatagctaaaaatagtggttctacttttggatttataatgtttaatgaaaagcctccaacacagaaaaagtttgaaactaatatatttgaaaaattatatttttcaaaaagtaattatatatttatagaaagtgaaagtaaaagagttggtcatgttaatgttccaaatgaaatatatgaaggaataataagagatggctatcatatattattagaatgtagtattaaatctagagtagatagattatgtagagattatatatacacggaaaataaaaactttgaagccttaatacaatgtataaataaatttagaaaaagattaggtaatgctaaagttgattattatattgaattatttaatgaaggaaaatatgaacaacttgtagaacactatttagtagaatattatgatgcattatatgggcattcagttgataaatataaatataataaagttataaattgtgataatatggaacaatctcttttagaactaatagattttcataaagcagcaaaggaaggagcaaattaaatgttaaagatagcgttagagtcactaggatgttcgaaaaacttagtagatgcagaaataatgatgggaattttaaatagaaaaggatataaactagtaggagattttgaagaggctgatataatcttagtaaatacttgtggttttattgaatcagcaaagcaagaatctatagatacaatacttgatttagcacaattaaaagaaactggaaatttaaaattacttattgtaacaggatgtctagcacaaagatattctaatgaattacaagcagagataccagaaatagatgcaatagttggaacaggaagttatcaacaaatagatgaaataatagcaggacttgaaaaagaaaataatataataagcttaaatgatatagaatttgcatataatgaagatcttccaagatacgttacaactcctgattatatggcttatttaaaaattggtgaaggatgtgacaatcactgtacttactgtataatacctaaattaagaggtaaatatagaagtagaaaaatggaagacataataagagaagctaaagaattagcatctaatggagttaaagaacttgtagttatagcacaagatactactaagtatggaattgacttatatggtgaagttaaattaccacaattattagaagaacttgcaaaaatagaaggtataaaatggataagaataatgtactcatatccagaatcaataacagaagaacttgtaaaagtaataaaaaaatatgataacatatgcaactattttgatatgccgatacaacatgcaagtaataaagttttaaagttaatgaatagacatacaactaaagaagatataaagtctaaggttgatatgataagaagttatataccagatgcaacattaagaacaactataatagttggattcccaggagaaactgaagaagattttaatgaattagtacaatttgctaaagatgtagaatttgatagattaggagcatttacttattcaagagaagaagatacttcagctgataaattacctaatcatatagaggaagatataaagttaaaaagaagagacaaacttatgctagttcaacaagaaatatctcaaagattaaatgctaaaaagataaataatgaatatgaagttttaatagaagaacaaatagaagataaagtttatgtaggaagaactcaaggtgatgctgaagagatagatagtatagtttacgttaaatctgaaaatcaacttgaaccaggagattttgttaaggttaaaataaataatgctttagagtatgatttgatgggagatgtagttaatgaacttgcctaataaattaactttatttaggatatttttaatacctgtatttataatagtaatgatgataaatatacctaacaagtttttaatagcttgtatgatatttataatagcttctgtcacggatgctatggatggtcatatagctagaaaatataatttaataactgactttgggaaatttatggatccacttgcggataagttacttgttatatcagcactaactactatgatagaatttgatttagttgcagcatggatggtaattataatagtagcaagagaacttactgttagtatattaagagctatcgcagcagctgatggaaaagttatagcagctagctctggaggtaagttaaaaactatttcacaaatgatagcaatagtcgtgcttttactagctgcacaaactggaaatataatacttttagatacaggtaaaataatcatattaatagcaacattacttactctttactctgggtgggagtatatatataaaaatagaaacttatttatggaaagtaagtaagtacataaaaaggtgggtatatattgaatatactcacttttttatttttaaccaattaaacttatgggaaaatatgtataaattgatataattagagttaatactattaataatgtattatttaattgactttaattagtaaaaaagatataataaatatagaacaaatgtttgattataacttaaagataatataaatgatttatagaagggaaggtattataaatggcaggaatacaagaagaaagattaaaagcattaaattcagcgctatctcaaatagaaaaagattttggtaaaggatcagtaatgaagttaggtgaagctggtggaatggctatagatgtaattccgactggatctataggtcttgatatagcagttggaataggaggtcttccaaaaggaagaatagttgaaatatatgggccagaatcttcaggtaaaacaacagttacattacatgcagtagcagaagctcaaaaacaaggcggtatagcagcattcatagatgcagaacatgcattagacccagtatatgcaaaagcattaggagttgatgtggataatttaatagtttcacaaccagacacaggggaacaaggcttagaaatagctgaggctcttataagaagtggagctatagatataatagtagtggactctgttgcagcattagtacctaaggctgaaatagaaggagatatgggagattcacatgttggtcttcaagcaagacttatgtcacaagctttaagaaaattaacagggtctataaaaaaatctaattgtgttgctatatttataaaccaattaagagaaaaagttggagtaatgtttggtagtccagaaactacaacaggtggacgagctcttaaattctactcttcagtaagattagatgttagaaaaatagatactataaagcaaggcgacaaagtaatgggaagtagaacaagagtaaaagtagttaaaaataaagtagctcctccatttaaacaatgtgagtttgatataatgtatggagaaggtatatctaaagttggagatttattagatatagctgcggatatagatatcgttaagaaatcaggggcttggtatagctataatgatactaagttaggacaaggtagagaaaatgttaaaaaattcttatcagataatcctgatttaacagaagaaatagaagctttagtaagaaaatattataaattagatggtaatagagaaatcgaacaagaaaacgaagactcaatagaaaatattggagaataatagtctgtatacctcctattaacttgacaccaggtagaaaaaattataaaattaaatgagaatgaaatattcttatttagtttataaaaacatatgttataaatactgtagttgacggtttacattaacaaaggaggtggatgtcatagaggcaataataggcgctttattgggaatatttgtgggtattatagttggttactttgtaagaaagaacatatctgaagctaaaattggccaagctgaaaagatggctgatgatataatagataaagcaaacaaagaagcagaaacattacaaaaagaaaaactattagaagcaaaagaagagatccataaatggagaaatgaagcagagaaagaaaataaagaaagaagaattgaagtacaaagatttgaaaaaagaataatacaaaaagaagaggttttagataaaaaacttcagacgttagaaaacaaagagtatgttcttaatgataagttaaaaaagattgataaaaaagaagaacaaatcgaagctataaaagttcaacaattagaaaagttagaaagtatatcaggtataacttctgacaaagcaaaagaaattatattaactaatgcagaaagagatgtaagacgtgagatgtctataatgataaaagaaatagaatctcaagctaaagaagaagcagacaagaaatctagagaaataatagggtatgctatacaaaaatgtgcagcagaccatgttgctgaaactactgttacagtagttaatttacctaatgatgaaatgaaaggaagaatcataggtagagaaggtagaaatataagaacactagaaactctaactggaatagatttaataatagatgatactccagaggctgtgatactatcaggatttgatcctataagaagagaagtggcaagaatagcactagaaaaacttatagctgatggaagaatacatcctgctagaatcgaagaaatggttgaaaaagctagaaaagaagtagataatattattaaagaatatggagaacaagctgcatttgaaacaggggtacatggcttacatccagaattaataagacttttaggtagattaaattatagaacaagttatggacagaatgttcttaaacattctatagaagttgcacatatagcaggtataatggctgcagaaataggtgcagatgttaaattagctaaaagagcagggctattacatgatataggtaaatcagttgaccatgaaatggaaggaactcatgttgagataggtatggatttacttagaagatataaagaatctaaagatgtaattcatgctatgagcactcaccatggagattatgaaccacaaactatagaagctgttttagttacagctgcagatgctatatcagcggctagaccaggtgctagacgtgaaactctagaagcatatattaagcgtttagagaaacttgaagaaatagctaattcatatgaaggtgtagataaatcatttgcaatacaagcaggtagagaaataagaataatggttaaacctgaaaatgtaagtgatgaagatatacatttattagctagagatatgactaagagaatagaagatgagttagaatatccaggtcaaataaaggttagtataataagggaaacaagagcaatagaatatgctaaataagaaaataatgtaagcgaatgtatcaattgatatattcgctttttttaatataaattttaattatctatataataaaatttacttaaaaagataataataaatttaaaagatgaaaggagagtaaatatgcttagtagtttatcaaaaaatcaatatgtaaaaatatcaaatagcactaaaattgatgagcctgttgaatatggagttgtaataaacacaaatgaaaatagttacgatataatgagcattggatttgaaaataaaaatggaaatttcttagagtatccccctaatgttgaaaaattagttcaaacttacaatattaatgatgctgattttaatgaagtaaagaaaaatgaaataagaagaaaaatgaatatatggctacaaaataattataaaatgtaaatttaagggagacttattaaagtttccctttttatatattatatttaaaattaatagattaattgtagtatatgatggaaataatatattaaatatatcaaatatagaaaaaagttaatgaaaatgatataattatataaaataagggggatgagaaattgagccagtacataaatataaattccgaactagatgcattaaagataaaagaatttgaagaaattttttatcaaaatatgaaagaggaagcaaatgtagtgccaaaggtaactccttttaaaggaataaatacagatcttttatatataaaagatgagcgtgttttatttataaagtttatggacacaacagaagatttatttatgatcttagaagatgaacttttagaaataatggaagaggaatacgatcttttaagaaaaaagatgagtaaaataggaaataacataaattataactatgtatttgtgatgccatacgtaactatatacgataatgaagaatataatgattttgtagaaaataatataatagataaaaataaactttacaaaatgatgaattatgaaatgagcatagatgaatatttaagtgaatccaatgatgaaattttactcaacttatttttactacaagtatgtccagaatattacgttataaatgacaatttaaatttaaacaagaaattaaagaaaatatctttttcaaatgaagactatagatatacagctactatgctagaaagagaccagatagaggatatagtatctataaaatatgggaatactttatataaaggaccatctggatgtggaaaaacaactatattattatctagagcaattaagttagctagagtttatcctcatcataaatttataatatttacacatactaaacaacttagaaatgaaataaaagaaagattggatatattatataaagataacaataatattgaggtacatacatttacttcttttttatttaaattagctaaaatatataatttggtatttgactataatatacttaaaaatactcctgaaaaggtttataaaagtcttgtattacaagctaaaaatactataaaaaataggagtatgtttaaaggaatttttatagatgaaatagaaagctttgaaagtatccaattagattttatacgtgaatttttatataaatcaaaatttatatttaatgggtttgaatgtaaagggcttaatatatcaagtaatttaagtatatttaaagattcatggagtaatataaagtttgataatataattactttaaccaaaaattatagacaaagtaatcacttggttgaatttgtgaataactttgatagaaattcaaatgaatatataaaaagtattagatctaatgtaaacgatgatatttattacttatctaatcctataagagaaagtaataaagctgttgatataataaaagtttctgatatagaagagcagataagttctattctttgggaaattgaatacttaactcataaaaaagggctaaattattcagatatagctgtcgtttatccttttaataaaaaaagattaaaaaacggtaaaactatatattttcaatatatgctaaaaaaggatttagaagaaaatgatattccatatgtttatggtgatgatgaattaactaatatatctaaaaaagcaggagtaactatatctaatatatactcaattaaaaacttagagtataaagctataatattttgtgagttagaaatgttatataatcatagcataaacgatattacacaagattaccaagttaatgattttgtaggagatttgaataaagtttatttagctataaatagagcaactgattatttaagtataataacgacttttaatgaaagtgcaagtgatataataaagctactagtagagtcaaaaaaataaaagaagcacattgtgcttcttttatttacattaagctatgaagctaaagtaagttattactataataccaagtactattctataataaccaaatgctttgaaatcatgctttttaatataatccattaagaatttaatagcaaatacagaaactataaatgctgttataaaacctactgctataactgaccattcaaaaccattaaaaccagtacctgtttttaaaagttttaaagcacttgctccaaacattgttggtatagccaagaaaaatgaaaactcagcagctatatatcttgatgctcctaacaatacagcaccgattatagtcgctccagatcttgatgttccgggtataagagctaaacattggaaaatacctatgccaaatgctaacttatatgtaagttgagaaaaatcattaaccttaggttttttgtttctattttcaagtactatcataataacaccatagactataagtgttattgatactgtagtcgggttaaagaataaagcatctatttgatcatcgaataataaacctaatatacctgatggtataacagcaataataactttaatccataagtttatagtatcctttttttctttttcagtttttgaactgtctaaaggatttaattttttaaaatatagtgttaatactgcaagtattgaaccaagttgtattacaaccataaaagtacttacaaaaacttttgaaaaatcaaattttacgaattgttcaactaaaattagatgtcctgtactacttacaggtagccattccgttataccttgaactataccaagtataatggctctaaaaatttctagcaattttaatacctcctaattaaatatattttacccgtaaaataaagtatatcaatattaatgaatatattcaatatattaggatcgtatttagtaataattaagaaatttaagaaattttaaaatagggggtaaaaatgaaagaaaaaactttattaaatgaatatgaatttgaaatttttaaagatttctctaaaaaacataatccagccactaggcatgattatttaagtaaagttatattatttaaagagtttaataaaaataaggatttaacaggcataacaaaagaaaactgtgatagatttatggaatttgtgagagataactatgcaaaatcaacatcagaaaaaatttatagctatttacatagcttttataattttatgaaaaaggaagaatatatagaaagtaatccttttaaactagtaaaaaaaccacaagtaagtagaataaaaactaaagatgatgtgcttagtattcaagagataaacaaacttatagatgctctaccaagattaaatatgagagatagattaattatggtatttttaataactacagggtgtttattaaatgaacttgtaaatttaaaatggaaagatttaatgttagatgaaaaagataatggatatgtaagacttggaaagaataagaaagaaagagttgttaaacttcatccatattgtttttctatgatagaagattatagaaattatttaggattacctgaagctataatgccaactgatgattttgtatttataagtcaaaaaagtaattctataactgatagaaatgtaaggataatagtaaagaaagctctagatatagctggacttagtaattactcagctaaagattttagacattcatttgctgcgataagtttaagattaggagcaggagaagaagatattaaaaatcaattagggtggagtgataaatattatgcaattaggtataaatatgtattaaactttgtagatagtgaaagtatagattatattatgagtagtgataaaatgaacataaacaaaaaataacttgttattgttcgttaaattatatataataaatttataataaataaaggtgtaaggaaggtgctagttaatatggaaagtaaatatagtacatatgcaaatccattaatagatagatattgcagtaaagatatgagttatatattttctccacaatttaaattttcaacttggagaagattatgggttgctttagcagaatcagaaaaagaattaggacttaacataacagacgagcaaataaatgaattaaaagctaatatagataatataaattttgaagaagctaaaaaaatagaaaaagaagtaagacatgatgtaatgagtcatgttaaagcttatggcttacaatgtgatagtgcaaaaggaattatacacttaggagctactagtgcttatgtaggagataatacagatgtaattcaaatgaatgaagcattaaagcttataagaataaaattagtcaatttaataaataacttaaaagagtttgcacttaaaaataaagatataccaacattaggatttactcattttcaagctgctcaacttacaacagtaggaaaaagagcttgtctttgggcacaagatttagttatagatttagaagatttaaactttagaatagataatatgaaacttagaggtgttaaaggtacaacaggtacacaagcaagtttcttaagcctatttgaaaatgataatgaaaaagtaaaaaaattagataaattagtttgtgaaaaaatgggatataaggcatcttatgcagttagtggacaaacatacactagaaaattagattatcaagttatatcaatattatctggtatagctcaaagtatgcataaaatgactaacgatataagattattacaaagtttaaaagaattagaagaaccatttgggaaaaatcaaataggatcatctgcaatggcttataaaagaaatcctatgagaagtgaaagaatagcttcactatctaaatatgttatagcagaatctttaagtccagcacttgtacaagctactcaatggttagaaagaagtttagatgactctgcaaataaaagattagctatacctcaagcattcatggcagttgatgctatacttgaaataggtataaacgttacagatggccttgttgtttatgaaaatataataaataaacacataaatgaagaattaccttttatggcaacagaaacaatacttatggaagctgtaaaaagaggtggagatagacaagaattacatgaggtaataagagagtactctatggaagctgctaagagagttaagcaagaaggaaaagataataatttactagatttaatacttgaagactgtgatacattcaagatgagtaaagaagaaatattatctataatggatcctaaaaacttcgtaggaagagctcctattcaagtagttgaatttgttgaagaaatagttaatccagctataaatgaatataaagattcaattggaatgaaaattgatttaaatgtataaaaatagaggttataacctctattttttatacataaaataagaaatttagttaaaaaataacaaaaactttaatataaatatttaatatcattaaggtaataataaatgatatcactatatttattaagatatttttttgaaattatttataaaatctaaaaatttaataaagtttaaaatgtattggaaaaaatgtagaattatgatattatatgtaaagtggaaaaggttaaactggttaaaaaagaaagattagctaacctttgaagtaaaaagcattaacaaaatttaatcaggaggaaaacaaatggctggaaacactaacaatgctaaaaaactaacattagttcccttagtacttatgatatttacatcagtatttgggttcgcgaatatgccaagagcctttttcttaatgggatatgcagctataccttggtatatattaagtgcaattttatttttcataccatatgcattcatgatggctgaatacggagctgcattcaaaaaagaatcaggtggtatgtattcttggatggaaaaatctgtaggtcctaaatatgcattcataggaacattcatgtggtatgcatcttatattgtatggatggtaaatgttgcttcaagtttatggataccattttcaaatgcgatatttggatatgatgctactgctacttggtctttatttggattaagttcagttaaaacattagggatacttggaatattatggataatattagttacttatgtatctactaaaggtatagaaaagataactaaagtaacttctgtaggtggtactgcagttgcagcattaaacttagttttattaataggaggggttgcagttttagctatgaataaaggtgaatttgcagagcctatacacaatgtagctaaagcatttacaaattctccaaacccaggatatcaaactccagtaactatattatcattcttaacatttgcaatatttgcatttggaggattagaagttttaggtggattagttgaccaaactgaaaatgctgaaaagactttccctaaaggacttactttagcagctatagtaatatctgtaggatacgctataggtatatttgcttgtggtatgtttactaactggagtgatatattatcatcaagtgatgtaaatatggctaacgttgcttatgtattaatgcaaaacttaggatatcaattaggtgttgcatttggagcaagtgaagctacttcattagtaataggtgcttggattgctagattcgttggtttatcaatgttcttagcattatcaggagcattcttcacattaacttattctccattaaaaactcttatagaaggtgcaccaaagcaaatatggcctggtaaattaggagaaataaaaaatggtatgccaataaatgctatgatagttcaagctataatagttatagttatgatatttgcagtatcatttggtggtagtaatgcggaagagttctttaaaatattagttcttatgacgaatgttgctatgacaataccatatatgttcttatcaagtgcattccctgcatttaagaagaaacaattagaaggtaaagttgaaaaaccattcgtagtatacaagagttttggaatggcattaacttttgctgtaataataggtatattagttggattcgctaacgtatttactgtaatagaaccaacattatcatctccagcaggtataggtaagtctttaactatgataggtggaccattaggatttgctataataggatttatattatatactgtatatgaaaagaaacatgtaaagaaagacaataataataaaaaagcgagctagtattagttaagctataaattttgcacctaccaatttggtaggtgtatttatatacaaaaatatacttattttgacaaataagtatatttttatatataaatatacaattttttagtatactataatagtattaaaagctaattagagaattagacaaaagatataggaggaacaattttgttaaagaagttattaaattttataaaaattaataaggaaaataaaatacaaaaagaagaagtcgaagttataaatattaaagaaaaagaagataatataaaaagagataatcaaaatataaatcaagaaatcacttctaaatctgaaatcaaaaaagaacatataaaagaagaaatatcagaaaatcaaaatgatataaaaaaacaaatttttacaaaagaagaagaagattacataaagctagttaaaattcaaagagaaaaaagaataaaagcaatagatgtttatacaaatgaagaaactatatttgaaacgtataaagagtgtagtaaaaaactaggaatacctatagaatatataaaagaaaatttacaatatggctacactgattattttggagaatctataaagtttttgaataagaagcttaaagtagacgtatcacctaaaaagataggaactatgaatatagttgaagtgtttaattttttacataatgagttatggaatagtgatatgtcagaagacaaaagagaagaaatattatcaagtaataaaatagaaccaatacatatgtattataaatttgaatctatggattatgaatatgatgattattttaaaatttatggaaagataattagacgtggtggtaaaaaaagaattgagcttattgataaaaaaaatgaggttattgaagtatttaagtctatagaagactgtgcaaaattttttgaaaaagacaaatcagaaatagtatctagattaaaattaggaaattgtaaaattggaagatatgaaataaagtatagtttaagaagatagatataatataaagtaaaaaggcttctatattaaatagaagcctttttactttatatttataattttaattatttatttttgttcttttccatgtatatacataataacttaacacttcttttatagagttacctataaatgtataagaattatcgtctaaattagctagagatattcttacagaccattctggaccataaaatccttgaccacttaacaatacaattgaatagttgtttgctagtttaaataacatatcggctggtttataattagtttttataaagtctgcaaaatcttctccataattattagtagcccatttcattatatcaaatattacataataagaagcatcatgtatatcttttttcacatctacatctaaagcatcataaagtagtttttgtctacgtttacatatagacatattaacatttttataagagtctttatcatctattaatgcaaatgctgagaaaaatgccatttggacttgttgaggagtagataaaccagcagtatggttaagagctacaagtctactatcagctactattctatccataaatgatattttatctggatttaaactcatatcactataacgtttatttactgatgattttaaatcagcaggcaattcatttataagtttatcaaacacattgtcatgatgaagcgctaaagtacctaaacgccatccagtcacaccaaaatacttagaataagaataagcacctattgtattataaggtagacttgccattatagatttaaatccattaacaaatgtaccataaacatcatctgatattatcattaaatcatgatgagtattttttacaacatcaactaaattattactactattttcatctatagctatagatgcagggttgttaggattaactaaaaataatgcttttatagatttatcactaagtttttctaattctttttttgagtattgccaagtatgatggttattttcatcaacttcatcagcatttatatggataacatcgaaatcatatcttggcaaatgtggtatttctaagtaaggtgtaaatataggtgtcataatagctattttatcaccttttcttagtaattcattagccattaaagaatcaaatatatagcacatagcagctgttgcaccttctacagcaaatatacttaaagggccaccttttttagtatcatatttcatctcttttattaaatatttagtaactattttttctatatgagtaaggattctatcaggagatggataattatcacctattataccatcagctaattcatacacccaagagtctggatcaaaatcaaatttttctattccataatctactatatctttagctaatttagctcctggcatatttaaattgtcataaatatacttataaaaacgtgtagctataccttcttttctaggcatacctgctaaatcgttttcattccatgtttcacgagtttcactaactgcgaattgaccaaatgtaaaaaatgcttcacgaggtgttgcagctgtccaattcggattaccacgaccagcatctagtactcttctaccactttccatggctctaaactttgccaatttgattaatttatctttgaactcaaagggactaatctttccatacatatcattaatttctttaaagttatatctacgcatatacacacactcctatgttatttgtaattaatatataaaacaacaaaatattaaaagtttacgtaattaatatatatttatattataataaaaaataataaaaataaaaggatatatgaaatatatagaaaatttaataaagtttaaatatattaaaactttattaaataacataaaaataacataaaactttaaaattatatattttaaataaaatgtctaaaaaaaataaggaaatataaaaggaaaaagttgtaaataaatagaaattttaatataattattttttattttgttttagaggtgggggttattatgaaatccaattattttgaaaaatatatattgaaatcatctccgattccatatatatttggtgaattaaaaaaaagttcaaatagttgttattcgttcaagatagaaaaaataagtgatacattcgaagtattatttgacatagaaaaaaatgatattataggaaaagaattaaatgaagtgtttatattagataatagtaatgaaattttagaatcaatatttgagcaaaaaaatacacgagcacatataaaaaactttaaacaaaactatgaatttgtatctaaaaacatagaaggtaataagtatgttatatggttaatagatataaaaaaagaactagaatttgaaaattcaaataaaataaggtctgaatttttcgctaatctgtctcatgagttaagaacaccattaaatttaatatttagttcattacaagtactagatttaaaagtagaaagtagcggaataaaagaagaggagtctatatcaaaatatttaaatatggcaactcaaaatacatataggttactcaagttagtaaataatataatagattctaataagataacatcagggtatttcgattacaatcctcaaaattatgatatcattaactttgtagaaggtatttgtcaatctatcgtcgattttgcaaaatacaaaaatatagaaattatatttgatacagatattgaagaaaaaattatttcatttgatcttgataaaatggagcgtattatattaaatatattatcaaatgcaattaaatttagtaaagataatggatctataaaaatatacacaagagaaatagaagatatgatagaaatagaaatatcagatgatggaataggaatacctcctcataagttaagttcaatatttgatagatttaaacaggtagataacaatataattagaagaggagaaggcagtggaattggattatatttagttaaaagtttagttgatatgcatggtggtaatatagaagtggatagtgaaatagataagggaacaatatttaaaatacaaatcccaaataaaacagtaatagattctgaatgtattatcgtagaaaaaaatctacaaaattcttatatagaaaaaataaaagtagaattttcggatatttacgcataaatattaatctcgattataaattataatcgagatttttgtatttatttgttataattataataaataaatcggtatagataataaggggagatgaatttggagattcataagtgcaaagaaattttagatatctgtcctataccttatatatggggtaaatatacaggggacatagaatctaaaagtacagattatataattaaagggggaaatgatttattatttaaaaagttaaatattgaaaatgaacatgaaatactaaataaagacttaactagtgttttagggatgtcaaaagaagaattaaatttattttctaaagaaaaagacggtaagtttacaaagtatcagtatgtatgtaacttaaaagacacatataaaataaccttaaatatagttggtgaaagcgttttttatatgtggtttcaaatttataatctaaatagcaactataatttagctatacaaaataatttaaaagctatgatatggataaaagacataaatggtagatatataaaagttaataaaaactttgaagaaatgactggcatatgtaagtctgaaataataggaaaaaaagattctcaaatcaatgttaataatgaatttaaatacattgaggaatatgaaaagcttgtgctaaataaaatgaaaagtagtattgaaaaggttatttttgaagataatcaatgggttagcatgtttatacatcctatgattgatgaagataaaaacattataggaacttatggatttaaagtttatgactatgtaaattcaaaaactgctataggtatagaaaatagaaataaaatgttagagataatcgttgataatttgccaataccaatattttacaaagatattcaaggtgtatatttatattgtaatgaagcttttggtgagttactagaattagatagacataaaattattggtaaaaaaaattatgatttaaatatagacgaagaaaaaatagatatatatagacagtctgacaataaggttataaaatataaagtcactacagtaaatgaaacttatatggaaagaagtaaaggcgataaatttatagaagttacgaaagtgcctttatgggattataaaaaagaagttataggtattattggaattgtaatcgatttaactgagaaaaaagctacagaaagagaactagaaaaacttaggttggattttttctcaaatttgactcatgagtttagaactccattaaatttaatattttcatcagtacaattaattgatcaaagtataactaaaataaaatctggagatataagtgtattaatgagatatttgaatataatagagcaaaatggaatgagacttttaaagttagtaaataacttaattgattcaacgcgaattgattcaggatgcttagattataacccagaaaatcgagatatagtaaattttgttgaaaatatttgtgattcagttgttgagtttagtaaattacaacatatagaacttatatttgatacagatgaagaagaaaaaataatatcttttgatagtgataaaatggagcgtataatactaaatttattatctaacgccataaaatataataaagatactggaaaaatcgatgtgaaaataaaatgtaataatgattatattgacataagtgttatagatactggcataggtataccgaatgataaaataaatgatgtatttgaaaaatttaagcaagtagataatagattaacaaaaataagtgaaggtagtggaataggcctatcaatagtcaaatctttagtaacattacatgaaggaacaataattgtacgtagtaaagttggagtaggaactgaatttaaagttagaatacctaataaaacaataattcaagatgaaaatataaattctattataaatgaatctatagatatgaataaaaaaatccaaattgagttttctgatatatattaaaaatatagcccttactttagtaagggctatatttttaattctaacaacatgtacagattgtaaagtattagatttactgagataaattttataattttataaacatgtctttcaccttttgagctagttttaagtcttgaaagttttaaattaaaacctaaaggaaaaaataaatctactccttcataagtaaaagcatctaatattatatgggaaatatatcctattaggattccataagagatacaaatcaatataatattattttcacctattgaaattattagttttagaaactctaacaaaattaataaaaataaaagactgtgagtgaagcctctatgtttacatctttttgatataaattttgatagataaggccattttttacttatgtatgactttctagtatctaaatcaggaagtaatgatcctagattagcagattgaaaacaaattgcaaaaagtattaatttatataaaatactataaccatttaaatacatactattaaatttgaaaaatgttaatgctataaatagataccctccagatgaatgtgtttcttttgtcattaaaataccctttctaataattggttattaaattttattatatattaaaaaaaataaatatggaatcgaacaaagttaaaatatttttataaaaaataaaaaataaagaattttacatattgtatacaatttaaaaaagttagatttagtagtataatatatatgactaaaaaaggaggtctttagatggataaagaaagaacttgtaatttattaaggcatactaaaaacttaaaatttaaacttatactagaaagtgcaataataggagctttagttggattaactatagtacttcatagaatactgttaaagaaactatcggctatttttattgcgttttatagttatagtaaaggtaatatactaagtacaggtttagtgtttggagttttaataataagtggttatttagttgctttaatgcttaaaaaagaacctatgataggtggaagtggtataccacaagttgaaggtatattgatgcaaaagctaaaaggaaactggtttggaattttgatcaataaattcgtaggtggacttatagctttaggagcaggtttatctcttggtagagagggcccatctgtgcaaatgggagctagtattggagaaggttttgccaagatttttaaaagagttagcgtagaagaaaagtatttaataactagtggagcaagtgctggtttagctgcagcgtttaatgcacctatatctggagtgatgtttgcattagaagaagttcataaaaacttttcgccattagttttactatctgtaatgtcatctgcattaatgtcagactttgttactaaaaatattttaggaattggaaagtctcttagtttcgttggggttaagccaatggatttaaaatattattggcttttaataatattaggaatagcagtaggaataagtggtgttatatttaatagtggtattttaaaaactcaatcaatgtttaaaaaatctaaattaagcacagaaataaaagtcataatcccatttttaataactggagttataggattgacagcacctatattattagggggaggacatgaacttataatgtctttagggaatgattcaataacattaaagatgctattattatttttatttgttaaatttatatttacatttgtttgttttgggtctggagttccaggaggtatattttttccattattagttttaggttcattaataggtaatatatttggaatagtggtaacaaatgtttttgatattccaagtatgtatatattaaactttataatacttgcgatggcagggcattttgcatctattgtaaaagcacctataacaggaattatattaatttgtgaaatgacagggagttttgatcatcttcttgctttagctatagtgtgtgtagtttcgtatataacatcagatttacttaaatctgaacctatatatgaaagtcttcttcatagatggatagaaaaagattctcataaatttacaccaagtcaagttagaaagagccttatggaagttgtagttcaattaggatgtgaaatagatcataaacaaataaaagatataacttggccagaaaactgtttaatagtttctattacaagaggtggaaaagaaataataccaagaggaaacacaacattaataggtggagattatttaactataatggcaaatgaagaaaatgcagcttgtgcattagattatgtaacgagcttaacatctaatataaaattattatagaattttatctctaaaaatcacatatatattaaaaatgtataaggtacaaatttagtatatgatgggtgattagatgagaagaaaaaaacttataataaatgctataataatgactttttctacaattatttttggatttgtctctatgtattttagggtgtatttatccaaaaaaatagggactgaaggaatgggattgtatcaacttataatgtctgtatatattatggcaattacattttcaagtgcaggaattagaatagcaattaccagacttgtagcagaacaagtaggaaggggaaataaaaattctataaggtcaatagtaaaaaaaggatgtatatacagtttgttttttagtttaattacatctttggtacttttttatgggtctgaatatataggtatagtattactaaaagatgaaagatctattacatctttaaaaatactatcctatagtctaccatttatagggatatcctcttgttttagtggttatttttatggagctagggaagtagtaaagtcagtttcaacagaaataatagaacaattaataatgatgtctattgtagttgcatcgataaatatatttttagatactaatatagaaaaaatatgtgctttaatttgtgttggtatggctttagggcaaataatatcttgtatatacgcatatatcttgtgtacatttaaaacaagaactttaaatagaacagtaacctatggtaattatgatgaatgtagaattattgatataactaaaattgcacttcctatagcatcaagttcatatatacaaagtggacttagaactatagaggatatattaataccaaatgcccttagaatgtcaggtaattctgtggcaacatctttatctatatttggcatgataaaaggaatggctttacctataattaattttccagcagtatttttaagctcttttgcaactttaataatacctgaaatatcagaagcatattcccttaatcgaaataaaatggttaattttattatttcaaacgtatttagaataacttttataatatctatatttgcatcaggagtattcatagcgttttctgatgaaattggatggattatatataataacaatgagataggtacaataataaaaattttagcacctgtaattcctataatgtatttagaacgtattatggatggaatattaaattctttaaataaacaggtaacacttttaaaaattaatttagttgatatgataattaggatacttataatatactttataatacctacaaggggaattgaaggctttataatagttatatttactagtaatatttnnnnnnnnnngtaatattttaaactttgtacttaatatgattaatgttttaaaatcaactaaattagaatttaagttgtttagctgggttttaaaacctattatatgtgtaagtttagctgtgattttatctacatatttaagtggtaaccttgtaaataaaataattatttctatgtttatatattttataatgttaattttaactaagtgtataagaattaaagattttaattgggtaatagatagctttagattgataagagatataaatgtaaatagtataaaactatatagtgatcgatacttataatttaaataaaaatatgaaagtttaatttagcataaaaaattaagctttcatattttatatatatgtattgatacaagagagtttatttgataagattaaaattagaaagacaaatcaacatcatatcaatgacattttaaatacatcataaataaagttaaactattaaaagcatgggggtctttattatgagtagaaaatacatagcagaaccatttaaaatcaaaatggtagaaccaatcaagatgacaacaaaagaagaaagagaagtaaagatagcaaatgcaaattataacttattttcattaaaagcagatgatgtgtacatagacttattaactgatagtggaactggtgccatgagttcaaaacaatgggcagcagttatgttaggagatgagtcatattcaggggctagtagctactttaaattagtagatgcagctaaaaatatttttggatataaatacatacaaccagtgcatcaaggtagagcagcggaaaaggttttaattcctttatttgctgaaactgggaaatatgcaatttcaaatatgcactttgatacaactagagcacatgttgaacttacaggagcaaaagccgtagactgtgtagtagaagaagcgctagatactgtaaaatatgctccatttaaaggaaatatggatgtagctagaatggaagctcttataaaggaatttggaccagaaaatgttggagtaataataatgactgttactaacaacactgctggtgggcaacctgtatctatgaaaaatatgagagaaacatatgaagttgctaaaaagtataatatacctgtacttatagatgctgctagatatgcagaaaatgcttactttataaaaactcgtgaagttggttatgaagataaaactataaaagaaatagttagagaaatgtttagttacggagatatgatgactatgagttctaaaaaagatgccatagtaaatatgggaggacttataggaattaaagatgatgaagaattatatgataatataaaagctcgtacaatatcttttgaaggatttgtatcttatggaggtttagcagggcgtgacctagaagctttagctgttggcttatatgaaggaatagattacgattatttaagatatcgtataggacaaatggaatacattgcaaatagattagatgaagcaggaatagcttatcaatctccagttggaggccatgcaatatttatagatgctaaaaaattattaccacatataccatattaccaattcccagcacaagcgttagctattgagctatacaaagaagcgggaataagatcttgtgatataggttcatatatgctagacaatgatccagttacaggtaagcaacgtcaatcagaacttgaacttacgagacttgcagtcccaagaagggtatatacacaagctcacttagatgttatagtagatgctttaatctctataaaagaaagagctagtgaaataaatggatatgaaataacttggcaacctaaagttttaagacactttacatcaaagcttaaacctataaaataaaaaattctaagcaagcataatttatactatgcttgcttttattaattttagggtaaaaatctatataagtaataaaaataatatataatgaacttataaaacttaattggagatgataacgtgaaaacttatatagatatattggaaactcaaaaaaggtatttaaattcagttggaactataagtgtagattatagaatagaatctttaaaagatttaaaattaacaataaaaaagtatgaaaaagatataatagatgcactttataaagacttaggaaaatctgaatttgaaagttacacaacagaagttggatttatatatagatctataaatcatgctttaaaaaatataaaaaaatggaataaagtcaaaagagttagaaatgatatagctcagataccaggcaaatcttatatatataattgtccttatggtagtgttttaataataggaccttataattatccatttcaattaactatagaaccattaataggagctatagcaggaggaaacacagctgtcattaaaccttcagaatttactccaagtgtagagatgatattagttaagattataaaagagtgttttcaagctaaatatgtagatattgtaattggggattataatgtaaatagtaagttattagatttaagttttgattatatattttttacaggtagtgtaaatgttggtaagattgtaatggaaaaagcgagtaaacacctaactccaataaccttagaattaggtgggaaatctccaactatagtagataaaactgcaaaattagatgtaagtgcaaaacgtatagtttgggggaaatttacaaatgcagggcaaacttgtgtagctccagattatttattagttcatgaagaaatttacgataaatttatagagaaattaaaggatactataattgatttttatggagaaaatataaaagaaaataaagaatttggacgtatagtaaatgatcgccatatgaatagattaaaaaatataatagataaagatcatgaaaaaatagtatttggtggagatatagaccttgaaaaaagatatatttcaccaactataatagcggatgttaactataatgatgctattatggaagatgagatttttggaccattaatgccaataataaaatatagtgatttagatgatattaagttttatttaaatctttataaaactccgctagctttatatgtatttagtgaagataaagattttagtgaatacattatgagaaactttacttttggtggaggttgtataaatgatactataactcatgttgcatctacaaatttaccttttggtggagttaaaacttctggaatgggaagatatcacggatatgatagttttaaaacttttacttatgaaaaaggaatagtaaaaagaaatagcaaaatagatataaaattaatatttccaccatacaaagataaattaaaattaataaaaaaagttatgaaatagatttatgaaaaaatttactgtatttgtttttcaaataagagaaaactaaaaatgattaataagttaaattaaaaattttagttggaggtgcttattttgaaaaataattcatttttgagtggagtaaaaggattttttaaagaaatgttttatatggaaagtgaaaatactaatacagatagagaaaagatagttgaaattgataagtacggaaataaaactacttactataaagctggagctggacctgataagccaaatgatataaatgatatgtttaaataaatttttattaatgaaaaaaccttagtttatactaaggttttttatttttatattataaattatatgaaaaaacaaaaaaaatacataatttgtatagattgatcgtataggataacataaaacatatcacattcaattgttttcattagtaaaatagattaagggctttttatataagaggggtgaaatttcacatgaaaagcaatttatttaacaaagacaacattaatgtaaaaagcgagataaacacacttaaaaaggtattacttcataggcctggagaagaagttgagaatttgacaccagaaactttagagcgtctattatttgacgacattccatatctagaagttatgcaaaaagaacatgatgaatttgcagatatattaagatataatggagtagaagtagtttacttacatgaattaatgaaagatgttttaaatgataacaatttaaaagatatttttataaatcaatttataaaagaagcagacataaaagatgaaaagataaaaagtttagtttatatgtatttaaaagatatagatgataatgaagttttaataagaaaaactatggcaggtataagaaaaaatgaaataaaaggtttaagtcttagaaatcatatagaatatgattatccatttttaacagatccaatgccaaacctatattttaccagagatccattttcgagtatttcaaatgggataagtatgaataaaatgtattcaaaaacaagaaatcgagaaactatatactcagaatatatattcaaataccataaagattttaaaaatataaaaaagtggtacgatagaagttttgaattttcaatagaaggcggggatattttaaacttaaataatgaagtggttgcaataggaatatctcaaagaactacgcctgaggctattgaaaaaatagctaaagaattattttattcaagctcagattgtgaagtaaatacaattttagcctttgatataccaaaatgtagagcatttatgcacttagatacagtatttactcaagttgattatgataaatttacagtacatcctcaaatacaaggaccacttaatatatatgaaataaaaaagaatgacaatatgactttaaatattaaaaaaattagtatggaacttgataaagtacttgaaaattatttaaatttagaaaaagtaactcttataccttgtgggggaggagatgaaataatttctaaaagagaacagtggaatgatggatcaaatactttatgcattaaaccaggtgaggttgtagtttattcaagaaattatataactaataagttattgcaagaacatgggattaaagttcacaaaatatcatcatcagagttatcaaggggacgaggaggtccaagatgtatgtcgatgccattaatcagagaagaatagacataaatttagggggtattaaaatgactaatctaaatggaagatcacttttaactttattggattatacagaagaggaaataagatatttattagatttggctaaactttataaaactgctaaaaaaatgggaaaatcacataaagaattagaagggaaaaatatagcaatattatttgaaaaagattcaactagaactagatgtgcttttgaagtagctgctatggatttgggaataggggtaacttatataggtcctagtggatctcaaatggggaaaaaagaatcaataaaagatacagccagagtacttggaaaactttatgatggtatagaatacagagggttttctcaagcaatagtaaatgaacttagtgaattttcaaaggttcctgtttggaatggattaacagatgaatttcatcctactcaagtattagctgatttattaactatagaagaaaaaataggtaagctaaggggagtaaattttgtatatatgggagatgcaagaaataatgtggctaactcattgatggtaggttgtgcaaaaatgggattaaactttactgcttgtgctccgaaagatttattcccttcaaaagaattagtagataaatgtagggaaataggaaaagaaagtggatctattataactttaacagatgatatatatttaggaagtaaaaatgctgatgtaatatatactgatgtttgggtgtctatgggagagccagataaagtatggaaagagagaattaataagcttaaaagatatcaagttaatgtagaagtcatggaaaatgctaaagaaaatgctatatttatgcactgcctaccagcatttcatgatttaaatacaaaagttggaaaagaaatatatgaaaaatttggcatatcagaaatggaagtaacaaatgaagtatttgaatctgaaaattctgttgtatttgatgaggcagaaaatagaatgcatactataaaagctttgatattagctacacttggagtttaaattatgaaaactttagttatagcacttggaggaaatgctttaggaaaagatcctaaagaacaactagaattagtgaaaaatacttctaaaataattgtggatttagttgaagaaggatataaagtaattataagtcatggaaatggacctcaagtagcgttataaatttggctatggatttttcttcgaataatggaggaaatacacctaattttccttttgctgaatgtggagctatgagtcaaggttatattgggtatcatcttcaacaatctataaaggaagagttaaataaaagaagtattaaaatggatattgtaagtttaataacacaagttattgttgataaaaaggatgaagctttttttaatccaacaaagccagtaggtatgttttatagtaaagaagaagctaaaaaaataagcgatgaaaaaggatataaatttatagaggatagtaatagaggctatagaagagtagtaccttctcctaaaccacaggaaattttagaagttgatgtaataaaaaaactatcaaaagaatgtatagttatagctgtaggtggaggaggtatacctgtaataaaagaagaaaattcttatataggagtagatgctgtaattgataaagataaatcgagttgtaaactagcaacagatttaggggcggatacgcttttaatattaacagctgttgagaaggtatatataaactacaacaaagaaaatcaaaaggctatagatactatggatatagatttagcaaaagaatatataaaagaaggatactttgcaaaaggatctatgcttccaaaaattgaagcttgtatagaatttgtagaaaataataaaaatgctaaagctataataacttccttagaaaaggcaaaagaagcattgagcggatgtacaggaacaagaataatcaatagataaatagataaaaagcgagtaaattattaatttactcgcttttattgttgtttttaacaaaattaacgattttttaactgtaaaagtttgatttttaactaaagtttaattggtttttaatagttaacattctcttaacaatatattaacatctagttaacagatgattgtttttcttaacatttacttaactaaaattgacaaaatatttggtaaaattaaaataacgaaagaggtaaattaaatttttatatttacatattaaggaggaaataattaagtgcaaatagcaataagtttaatgggaggactggggcttttcttatatggtatgaaccttatggcagatgggcttcaaaaatcggcaggagaaaaattaaaaagaatagttgagcttttaactagcaatgtattaatgggggttctagttggagctttggttacagcaattatacaaagtagtagtgcaactacagttatggtagtaggatttgttaacgcaggaattatgacattaccccaagctataggagttataatgggtgcaaatataggtacaactataacagcacaattagtatcacttgatttagttggaatagcacctttagcattaggtataggtattgttatatacttattctctaaaaatcaaaagactaagacaatggcagaaatattaattggatttggtatattatttactggtatggactttatgaaggaagcagtaaagccattagctgagtacaaagggtttactgatgcattggtagcttttggtaataaaccaatattaggtatattattaggatttggtataactgcaatagttcaaagttcaagtgcatctatgggtatgttattagcacttgcatctcaagggttaatacctttagctgcagcgcttcctatattatatggagaaaacataggaacttgtgttacttcattaatatctagtataggtgctagtataaatgctagaagagcagcgctaatgcatttggtatttaatgtaataggaacgattgtatttatgttaatattaactaagccaataactatgatggttcagtatttaaatccagaagatgttagtagacaaatagcaaatgctcatacattatttaacgtaataaatgttatattattattaccgttttcaaaatatatagttaaacttactatgaaacttatgccagaaaaagaatgtgaaaaagaaaaagataaaactgtgttttatatagatgaaagaatgatggaaactccatcgatagctttatcaaacactgtaaaagaaactttaagaatgggtgaaaaagctaaattaagtttaaataatgcaatggaaggatttttagaaaagtcaaaatctaaggtagatgcttcttttgaagaagaaaagcttataaataaattgcaaaagagtatattaaattatttattaaaattatctaaaacttcactaaattatgattcaagagaaagtgtggatttattatttaacactgtaaatgatatagaaagagttggagatcatgctgagaacatagctgaacttgcaatatctactatagaaaataaattaaatgtatctaaagatggagagaaagaattaaaagatttatatgaaaaagttatagaaacttataatacagcactagagtgtatggaaaaatctgatatagatttagcttgtagagttataaaactagaagaacaagttgatataatggaaaaaacttgtagattaaaccacatgagaagattaaatgaaaattcttgtaatatagatgctggggtgattttcttagatttactaagtaacttagaaagagttgcagatcactcagcaaatatagctcaacaagttataaaagaaagtaataaaaatttagcataaagtaaataataaaaccttgccaagatgcaaggttttaatttatttaaattaaaaaataaaattatattataaaaattctaaaaattaaattaaagtattgtattattaagtaaaaaaatgtaaaatatatatatgatatagtgtataataaattaaaaaagtgtagaataattgaagagataacatatgtatatatatgtatttttcttcataaaatttaataaaagttaaatagtatatcagtttcaaatgtaaatgaattatttaattaaaaaagaagataatatattattaaaatattagtttaaagaaaataaatttaaaaggagaaaaagattatggcaatgggagcaccaacaccacataataacggaaaattaggagatatagcagaaacagtattattaccaggagatcctctaagagctaagtttatagcagagacatttttagaagatgtagttcaatacaatactgtaaggggaatgaatggttatacaggttactataaaggaagaagaatatctgtacaaggaacaggtatgggatgtccatctataggaatatatacatatgagttaatacatttttatggggttaaaaatcttataagaataggttcagcaggagctttacatgaagatttaaaaatgcatgatatagttataggtatgggatcatgtacagactctaattacgcatcacaatataacttaccaggtacttatgcaccgatagcaagttatgagttacttagcaaagctgtagatgtagctaagagtcaaggtgttgagcctaaagtaggaaatatattatgtagtgatgtattctacggagatgatggattagaaggtttagcaaaatggactaaaatgggagttttagctgtagaaatggaatcagctgcactttatatgaatgctgctagagctggagttaatgcactttgcatattaacaatatcagattgtccatttaaaggggaagcaacaactgctatggaaagacaaacagcatttacaagaatgatgaatatagctttagaattagcttaatatatatttaaaagttatataaaataagataaaaagctcgaatttgaaatatattttacaaatacgagctttttttattgtagcaaatcttttattttctagaattgtatataaaattatgctaatattataatgataaatatgaaaaatttaggttttaatattaaaagggaatagtgtgtaaatcactagcagcccccgctactgtaaatatggacgagtctttataaaaccactaaagattattctttgggaaggaaaagattaggatgaagtatgagccaggagacctgcctaaattattaactttcggagggagagaaagaatgaaaatttcaaaaaaaattaaagtaggattgcttagcttagttgtaggacttagtatagttggttgtactaagaatgatactaagaaagaagaagctaaaaacacaaaggttgaaagtaacacagagaaaagtgatgggtattatccagttacaataacttctcataatagcaaaaaagaagaaataaaagttacttttaaagaaaaacctaaaaaagtattagctgtataccaagactctattgagactatgcttgcattaggactagaagataatatggttgcagcagcaggacttgaccacaaggttaaagatgagtataaagaaagctttaaaaaggttaaatacttagatgaatttacgccttctaaagaaactgttacaatgttacaaccagatttaatattaggttggtactcattattttcagataaaaatataggtgatgtaagttattggcaagataaaggtgtaaatacatatatggcattaaatagtggtgcagttgagaaaaaaactatacaaaatgagtgtgacgatatattaaatataggtaaaatatttaatgttgaagataaagctaaaaagatagttgataatataaataataaagtaaataaaattgtagaatcagaaaaaggtaaaaaacagcaaacaacgttaataatagagttaattgatggtaaaattagtggatatggaaaaactactttaggtggagatatggttactaagttaggtgctaagcttttaaatgaagatggaaactcattaagtaaagaagatttagtaaaattaaacccagatagcatatttgttgtttacatgaatagagaagatgataacaaagcaagtgaaacaaaagatttagtaatgaaagataaagcattacaaagtttaaatgctataaaaaatgatagagtttatccgattgaacttggacaaatgtattgtagtggggtaagaactatagatggaattgaaacatttgcaaatggactttatccagatcaaaaatagaaagaaggatatttacatatgcattcaattaaaagcttagaaaattatgatatgaaagaaaagaaaggctttgttaaatcaaagcctttatatattttagttataatgttattaatatttttagctataatgtctatattaatagctgtaactataggatcaagtgatatatctataaaacaagtatatgatgtaattatatttagattgtttaatataggagataaaagtctagaaaatggagctattcatgatgtagtttggcttatacgattacctagaataattttagcggtatgtgttggaataggtctttctgtaactggagttgttatgcaggctatagttaaaaatccattggcagatccatatattttaggagtttcatcaggtgcttctttgggggctactatagctataatgctaggattaactacatttttaaatggaaatgctataggggtatttgcatttataggagcatttgtggtttctatgttggttttgataatttctaatgctggaggtaggccaaactctactaaattattgttagcaggtatggctttaagttcggtttgtagtgcattttcaagttttattgtttatataaaaaatgatgctgaaggaatgaaaagtattacattttggcttatgggaagtttaggtggagctaagtgggaagagatagtttttatacttccacttataataattggattattatttttcatgagtcaatatagaattttaaatttaatgttattaggagatgaagtttctataactcttggaactgatttacacagatatagacagatttatttagttataacatctttgatggttggattagtagtttattcagcgggaatgataggctttgttggacttattatacctcatattgttaggattttctttggaactgaccataaaaaacttatcccgatatcagctcttttaggtgctttatttttagtatgggcagatgtactttctagaattataatagaaaatgcagaacttccaataggtattttaatatctatggtaggtgctccatttttcgtatatctaatgataagaaaaagttatggttttggaggttgtaattaatgaatttggaaactaaagaccttaaagtcttattaaataaaaatgaaattttaaaaggtattgatatagaattaggaaataaagaatttataggagttataggaccaaatggaagtggcaagtctactttgctaaagtgtttatacagaaatttaagtccaagtagtggaagtatatatatagataagatagaaattggaaaaatatctactagagaaagtgctaaaaaaataggagttttagcacaacataatcatcatagttttgattttacagtacttgatatggtcttaatgggtagaagtccatataaaaaacttatggatagagatacaaaagaagattatgatattgtttatgaagctattgataaggtaaatataagacatttatcaaatagaagttttaatagtttatctggaggagaacaacaaagggtaattcttgcaagagctttagctcagaaaactaagtgcttaattttagatgaacctacaaaccatttggatataaaatatcaattgcagttaatggaaatcgtaaaaaatttaggtattgaagttatagcagctatacatgatttaaatatagcagctatgtactgtgacaaaatttacgttttaaaaaatggagaaatagtagcttatggaactccaaaagatgttttaacaaaagaacttataaaagaagtttatgatgtagatgcaaaagttataaaagataaggaagataattctataaatattatatataaaggttgtatatagcaaaaaaagaggtgattaaatttaatcacctctttttgtcttaaaagtgaaaaaattatgatatttctataaaaaaggcaaaatatgtttattttcaaaagtttagcaatgatatactcaaaaatatataatataaaaatgaaaccattgataaaacttgaaaaatgagttagttatactaaacttaagaaaaattaatataaacaaaagttaataaatactaaacttaagaaaaattaatataaacaaaaatataaagttagatataaaactattgaaaatactgaaaccaaaaaaaaataaaaaaataaaaaaatataaaaaaattgcttgcaaaaaactgaaaacttaatataataaatattgtaagtttaataaaactaaattttataaatagaaataataatctttacttttagatttgattttaaaatatagaaaggaggattaaaatggaagctattggagaaaagttagaagataatttttttagtgactctacattaagtcataaacaaactccattacttacttctttgaaagattattctaataaagatatagcttgttttgatgttcctggtcatgttagacatcaaggagtagaagttttaaatgagtactttggtaaggatattatgaaaatggatataaattcatcacctcttatggataatgtttcaaatccaagtggaattataaaaaaagctcaagatttattagcaaatgcttataacgcagacgatgcttttttcataacaaatgggactacatcggctatacatgctatgattttaagcactataaatccaggagataagatacttcttccaagaaatattcacaaatcggttattaatgctttaatacttactggtggaaaacctgtatttatacaaccaggatttgatgatgaacttggaataagtttaaatgtagcttatgaagatataaaaaatgaacttaaaaatcataaagatataaaagctttatttttactaaatccaacttactatggagcatgtagtgatttagaagctataattgagttgtgtcatgaggaaaatgttttagttttagttgatgaagcacacggagcacattttccatttcataaagacttaccacctccaagtataagcttaggagctgatatgtcagctataagtattcataaaactggaggagctctaactcaggcttctgcattacttttaaataatgaacgtatagaatcaagtaaggtattgcaaagtataaatatgattcaatctacatcggcatcatacttgttaatggcaagtattgatggagcaagatccaacttagttttaaatggagatgctcaattatcaaaagcacttaatttatcaagatatgcaaaagcaagaataaataaaataaaaggaattaaagttgttactactgagaatttaggaaatgatggagttaagtttatagatgaaactaagctttgcataaatgtagcaaaacttaatttaacaggtcatgaagtatatgatttgctttatcaagagttttcagttcaagtagaacttggagatttatataatatactagcacttatatctattgggactacaaaagaggatgttgataaacttattgattctttagaagcgatatctaatatttataaaaaagaagaaaaaatgaaagttataaaaactaagcaaataaatccaatacagaaattaaatccaagagatgctttttatacagataaagaaatgattttaattgatgaatgtgtaggtagggtttcaggtgaatctataatggcttatccaccaggaataccaatagtaacgcctggagaagaaattacaaaagaaataattgattacataaaattactaaagaaaaataatgcatatttatgtgatatgaaagataaaaacttggattatgtattggttataaaaaattaaattcaaaaaactgaataaggagagtgcaactatgaaatttgaaactttaggaagacatatattagtagagtactacaactgtaatgaggatatattaagagatccaaagcttatagaaaaattcatgaacgattcggcgctaaatgcaaaagctacaatagttgattcggtatttcatcactttaatccatggggggtttcaggagctgttataatagctgaatctcatttaactatacacacatggccagaatacggatatgcatcagctgattttttcacttgtggagatatagatccttggaaaagttttgaactattagaagaattgttacaagcagaaagaagtgaatcaacagagataccaagaggtttaacttctaaaatacaaaaatttgcaaaaaaagatttaggtaacattactcataagccacaagaagctatataaataaaaatcacctaaattaaataaaaataaacaaataaaaaattaaattcaaattaaattataacatataaataaaatatggtcaaaaaggccagtaaaatagacaaatataaaaataaatataaataaaataaaaaattaaattcaaaaatttggaggacttaagttatggaactttggtacacagaagaatggacagataatgtacgtttttcaataaaagtagataaacacttatttagtgaacaatcaaaatttcaaagagtagatgtatttgacagtaaggaatttggaaagtttttaacattagatgggttaatgatggtaaattataaagatgaatttatatatcatgatatgatagttcatgttcctatggctactaatatgaatataaaaaaagtattagttataggtggcggtgatggtggtactgtaagagaacttactagatatcctcaaatagaaaaaatagatatggttgaaatagataaaatggtagtagatgcatctaaagagtatatagatatatgtgcttgcaagttagatgatcctagagttaatttatattttgaagatggagtagcttttgtaaaaaattcaaaagataaatcttatgatttaataatagttgattcaacagatcctataggccctggagaaggattattctcagttgacttttataaagactgctatagagtactaagtgatgaaggaatacttgtaaatcaaaatgaaagtccatactttgactttaatgctaaagaaatgaaaagagcaaatgaaaaaattaaaaatttattccctatagttaaggtttaccaagctcatataccaacttatccatcaggacattggttgtttgggtttgcatctaagaagtatgatccgataaatgatcaaaataaagaagattgggaaaaactaggtttaaaaactaaatattataacagtaacattcatagtggagcatttatgttacctcaatatgtagtggatatgttaaatgaaaaataagttttataatacaccaacatttatgtctatggaagatgattacaatgaaagtaaacttatagtatttggagcaggttttgatggaactacttcaaatagaccaggaactagatttgcatcatcttctatgagacctgaattttacggacttgagacctatagcccaattcttgatttagatatggatgattataaaatttgtgatattggagatttagaacttagcataggaaatacggataaggttttagatgaaatatatataggaacgaaagctattgtagacgatgggaaagttccctttatgataggtggagaacatttagtaactttaccatcatttaaagcaatttatgaaaaatataatgatatatatgtacttcattttgatgcgcatacagatttaagagaagagtataataataataaaaattctcatgctacagttataaagcgtatttgggacattgtaggagatggaaagatatttcagtttggaataagatctggaactaaaaaagagtttgattttgcgttaagagaaaagcatacatatatggaaactcacacaataaatacttttttagatatagttaaatctttagaggataagaatgtatatttaactattgatttagatgtattagatccatcaatatttccaggtactggaaccccagagccaggaggtataagttatagagagtttgaagaggtatttaagatacttaaaaattcaaatataaacttagtaggattagatattgtagaacttagtccagattatgataatacaaatgtatccacagttgttgcatgtaagattttaagagaattagcacttatagtaagcgataaaataaatagataaacttaggaggaatttaaaaaatggcaagacacttatttacatcggaatcagttacagaagggcatccagataaaatatgtgaccaaatctcagatgcaatattagatgcacttttagaaaaagatccactagcaagagttgcttgtgagactacagttacaacaggattagtactagtagcgggagaaataagtactaatacttacgttgacatacccaaattagttagagaaacagttaaaggtatagggtatactagagcaaagtttgggtttgatggagatacttgcgcagttataacttctatcgatgaacaatcaggagatatagctatgggtgttgatgaggctttagaaaatagaagtggggaattaagtgaagatgagatagagaaaataggtgcaggagaccaaggaataatgtttgggtttgcatgtaatgaaactgaagaattaatgccacttccaatatctttagctcataagttagcaagaagattaactgaagttagaaaaaatggagagttaagttatttaagaccagatggaaaaactcaagttacagttgaatatgataaagataaagctattagagttcatactgtattaatatctactcaacatggagaagatgtagacaatgatacaataagaagagatttaatagaaaaagttataaaagaagttataccaagtgatttattagatgaggaaactaaaatatacataaatccaacaggaagatttgttataggtggacctcaaggggatacaggacttactggaagaaagataataatagacacttatggtggatactctagacacggtggtggagctttctcaggaaaagatcctacaaaagttgatagatcagcagcttatgctgcaagatatgttgctaaaaatatagttgcagcaggacttgcagataaatgtgaaatagaacttgcttatgctataggtgttgctagacctttatctatatttatagatacttttggaacaggaaaagttagtgatgaagttttagttgatttagttaataaaaactttgatttaagaccaggggcaataataagggatttagatttaagaaaacctatgtataaaaatgttgcagcatacggacattttggaagatgtgatttagatttaccttgggagagaactgataaagctaactttttaaaagaacaagctggaatataattatgaaattcaaataaaaaaggatgtcattaaatttgacatccttttttatttgaattttgagatttgctgaataatattatgaaatgattacatatatataaataggatagaaataaattgtaaaataaaaaaatttaagtataccaaaattttaaagaataaattatactatataaatatacattacataaaaaattagactaatcggatatatactaggaggtaaagacattgaagttaaaaaaaatggggatgcggactataaaaacaggtatagcaataatgatatgtctgttattaggaaagttccttgttcaaaaattattttactgtgcaatagcttgtgtaatttcagttcaagacacagtaaagggttctatgaaagtaggattaaatagagtaaaaggaacaattgtaggtgggataatcggatttttatttgctttaattcaaccaggagagcctattttatgtggtataggtataatgcttacaatttatacttgtaatatgttaaaaataagttcagtagtagtatcttgtgtaacatttttagcaatacatttaggtgttggtacatataatccggcatattactcagttcatagggttatagatacttcagtgggagtaattataggtgttgtgacaaactacttaatagctagacctaattatttagcaaaaacaatagctgaatttaaaaatatagaaaaatctgcaatacaacttatagaatctaaaatcgtaaatgaggaagatttagacataaacttatttaagaaaaatatacaacaacttgataaaatatattcaaaattaacagatgaactagattatggtggaaagcatgatgcagatatagaaaatttagaaaaatcaataaatatatgtagagaaatttattttcatatgcaatcaatagaattactagaaagtaaactatatttaaataaagataactataatgcgttaagagagttatacaatacagaagaaataagttttgatgttgaagaaaataaaagtcctgtgtttaattatcacctaagcaaaataatagaagaaattaaaactttaaaagaatttaataaatctattgaataaaactcctaagcttttaaaagcttaggaatttttatgttataataataaattgttaataattataatgatcataaataaaatgtaaggaagtgaatttgtgaaaatcaataaaaaagttatagtaatcttattactaattatatttattccagcaggaatattaacatttatgataaaagaaaatcataaaaaagaacaaatcgagaagaaagaaaaaaaacaagaagctttaaaaaatgaaaagtctatgaatattgctttatttggcttagatagaagaagtaaagaagaaaaatcaagagcagactctataatggttgcaaatataaactttgaaacaaaaacaataaacctcgtatccatacttagagataccttagtagatataaaaggtcatggaagagataagttaaatcattcatatgcttatggaggacctgaactttcaatggaaactataaatttaaattttgacttagatataaataaatatgtaagtgtagacttttttagtttagcaaaggtaattgatataataggtggagtagatatagatttaaaagattatgaagcaaatcaaataaatcaaaacttaaatgaaataaataacatagaaaaattaccagcgggaactgattatatacaaggaagtggcttaaaaactttaaacggtagacaagctgtggcttattgtagaataagaaaagtaggtaatggagattacgaaagaactcaaagacaaagaaatgtattaaaagctatacttgtaaaatatgaaaagttagattcaggtaaaaggtttgaagtaagtatggagatgatgtctcaagtaactactaatatacctataaatgatataaaagagctacaaagtaaaatcttaaatgacaaagattttactataaatcaacatatgataccatttgaaggaagttttgaaactaaaattatagatgaaaaatgggtaatagatgcaaatatgcaagaaaatatcaaacaaattcatgaatatctaaaataaaaagacgagtgtcagtggagcactcgtcttttccaaaggagaaataagtatagtatatttagtgatataattaaaaatttatttgaaattatattaacattatagacaattattatatttatatacaaaaaattttctataaataataaatgtattttaatatttaaatttaagtatatctatatgattctaattatcttttaatgaattaagcacattacacattgtacttatttcatccttgcttaaatcatcaaagttttctaatctatttacgatatcaagtataaccatatctttatattcatctttactaaatctagcaccaataaatacatcttttatactatcttctaagatagaataattatttttctttttatggtgatgatgccttatattttctttctttataaaatatgtagataaagtagaagtcaaagagcctataaagccaataccaaatatcataagaatagatgcaacaattctgccagaaaaagtctttgggcaaatatatccatatccaactgtagtgacagtaactatactccaccaaagggaatcacctatattccatttttcaaaataactcatagcaatagaacttaaaaatattataatcaaagctataaataaagtataactaaaattatttgttctcataaatctataaaaattactattacttctttttactatagctactatcctcaacaccataactaactttaataaaattatatatttactatctaaatgaaaaactcctaaattagatagtaatataaaaaatgtatgaaaaggtataatagagattaaatctattatattattcttaataaatatttttttatcagtacttataaaaaagcgaattacaaaatctataacgaatattgcccaaattgtataggctatatttgttaaaattatttccgaattataacctaattttagtgttaattgaactattaaaatagtagcaattgccagtgaaagaaacgccataattatattataaataatgcgtttttttctcgtcataactatcaaaattcatatctccattctatctacttaattttaaataatatatactacatattttaaattaaaatatgtagactgtcaaaagaaggaattatatgtttttcaaataatatacatttatataaaagtatttaaaattaaggaatataaagattatatagaggtgatagatgtgggaattgatagtaaatacaatataaaaataggtaactttaaaaaaggtaaaaataacttaataacagatatagatggagttaaagtaggtcatgttacactggataaaggagatataaaaactggagtaacggctatacttcctcatagtgaaaatatatttaaagaaaaagtaatggcatcttcttatgtaataaatggttttggaaaaagtatgggacttatacagatagaggaattaggaaatatagaaactcctattatactaactaatactttaagtatagggacagcttgtaatggacttattaagcatatgctaagtgaaaatgaagatataggtgatacaactgggactgtaaatcctatagtactagaatgtaatgatggatttttaaataatataagaagattttctttaaaagaagaacatgtattagatgctataaaaaatgcaaaagaaatatttgatgagggatcagtaggggctggaacaggaatgagttgttatcagcttaaaggaggaatagggtcatcttcaagaattataaaattagatgaaaaagaatatacagtaggtagtttagtattatcaaattttggacttaaaaaagatttaatgataaatggagaaaaattaataaaagagacatttgacaatgaaattttagaacttgaaaaaggatctataataattataatagcaacagatataccactaagtgaaaggcaattaaagagattatcaaaaagagctagtatatcacttggaagaacaggatctcatttaggaaatggaagtggtgatatagttgttacatttacaacacgaaataaaataaatcattatgaaaaaagagatatagtagacattaacataataaatgaaaataaaatagatttagtatttagagctttaatagaatctgttgaagaatctattattagttcaatgataaactcaaaagaaactataggaagaaaaaataatacaagaaaaagtatactggaatatttaaataaaactgtttaaaaatacttaggttggttatatatataatatcataaaaatttctgccatagacaaatttaaaataatttcaagcgcataaaacaaggttttgatatataatcatttgccttgttttattttttgaaaaattaaatataaataaatttatttaaatattttactacctaaaaagttattaagattattttttaattctaatacattaatacaatctacaatttcttttactatacttgtatctattaattcatttactgaatatatatcttttttatttgaaaataaaattaaatatataatgtttttacttacatttataagctttattttaattaatataaatacttctatactttatttattaaaagatatatctgtacttttaataattactttaatgagcttatacatatataaggaaaatttaaataagctaaaatatcaaaatacttatgataaactaagaatctcagaagacaaattaaaaagagctaatcaagatttagaaatatatataaattcagttgaagagcttgctatattaaaagaacgtaatagaatatcaagagaaatacatgatagtgttggtcattctttatctactacaataattcaacttgaagctataaagcgtttattaaaaaataatccgcctttatatgaattagttgatgaacttcgtgattttgttaaagatagctttagtgaagtaagaactgctatatcaaagttaaagcctactgaatatgaaaattatcaaaatctatttaaaatagatgaattagtaaaaaactttgctaaactaactaatacagatgtgaagttaactatatctaaaaatacgtggaacttatcaagtgttcagtctataactttatatagagttatccaagaagctttatctaatgctataagacatggtaaatgtagtaaaattgatatttttataacttttaattctaatgaattaatacttaatattaaagataatggattaggatgtaaaagtattgtaaaaggtaatggtttaaatagtatttctgaaagaatttacgagttaaagggaaaggttgaattttttaatgtagaagatggatttcttataagagcaactttccctaaaaatgttgggggtaattttattgagtaaaataaaaattttaatagttgatgatgaaaaattaattagaagtggattaaaaattatattatcttcttatgatgatttagaagttataggggattgttctaatggatatgatgctttagagttttgcaaaactaataaagttgatttagtattaatggatattagaatgaaagtttgtgatggagttttaggaactagacttataaaagaatatgataattctatatgtgtattagttcttactacttttaatgatgatgagtatataaaaaatgctatgaaatttggagcttctggttatttattaaaagatagttcagatgaagttttgtatgaagggataaaatctagtttttatggtaatgtagtacttgataaaagtgttataagtaagattatttctagtgaaagcagtatatgtgtagataaagttataaaagaatttaatttaacacaaaaagagatagatattatatctttaatagctaatggacttaccaataaagaaataagtgagaatttatatttatcagagggtacgataaaaaataatataactaatattcttagtaaacttaatcttcgtgatagaactcaaatagctatatttgcttttaaaaataaaatagtatcttaaaaaaggattatagcttaaatttaagctataatccttttttatacttaactaccataagttattaagtttaatttcttaacggagtttgcctctgtttataacctttttctttttcttccaatatatctcttccttttctaaaataaaaagttattgagaaaaatatagtgagtaattctgctattggtatagctaaccatattccatttacgcctatgaattttggaagtattgttattgtagctactacgaatataagtgatcttagtactgatattattgcagatacttgaccatttcctattgctgtaaaataaccagacataaatacattaagtcctataattaaaaatccataagagaataatttaatacctgaaacagcaattttatatacttctaaatcctttgtaaataatcctattatattttttcctaaaaacattgaaattaaaaatataactacagaactccatccaatagttacaaaactatgtcttaaactttcttttattttttccttatttttagctccaaagttataactaatcataggagatattccaactgctactccaaagtatactgctataaagaaatagtacatataaattataatagacattgctgctattccattttctccactaaatgttaatatacttttattaaataaaaatgtagttatacctgttgatagttctgtaaacatttctgaacttccattatagcaagaattaaataaagctttaaaatctacttttggttttgtaaattttaaaagtgatttacttcctttaaaataaaataatcctactagtgctgataaagttattgctatatatgttcctagtccagctcctactattcccattttaaatactactataaataaaaaatcaaaaactacatttaaaaataatcctaaactagacattaaaagtgctactttagggcttccatctacacgagtgtaatactcaaagtataacttaaacatcataggaattgtcataagtatagttattagtccataagattttgcatatggtaataattttttagttgctcctaaaaacattaatataggttctaaaaatattacaccaaaaacagtaagtactatacctataataagtaatgtaactgttataaatgaaaatagttgattagctccaagtttatctttttctccaagctttataccaactagtgccccagaacctgtagctaacattactgctataccaaatacaacacaagttattggtataacaatatttattgatgctaaagcatctgagtttacatatcttgatacaaaaaatccatctatagttgtataaaatgataaaaatatcattgtaataattgatggcaatacatatcttaaaaactgcctataattttgtttttttgcaaatacatcttccatttttacacctctattatttttaaataattgatattgcttgacattaataattgtgaaggatatagtaactatattgtcaagaaaaatttaaaataaaaatggcaggtgttatatatgaaatttacagtaggtgagttagcaaagcttcatggtatgagcaaacaaacattaatatattatgataatatagatttatttaaacctaatattgttgatgaaaataatggttatagatattatacttcagaacaattagaagttttagatagcattttaattttaagagaaatcggtatacctataaaagaaataaaagaatttttagttaaaagagatgataataaagcactacatcttttaaaacaacaaaaaataaaattagatgaacaggttaaaaatattcaaagaactattaaaagactagaaaataaaatagatacaatagaaagtttagataattataaaaatgatgtttattttgaagaaatggaattagaatatttagttttacaaaaagttgaagctccttttgaccttttacaaactgatatagcctttaaaaagttgttaacaactgtaactaacaataaatacccttactattatcagttgggcactataattgctcttgaaaatttattgcttaaaaaatataccactgctgattctgtattttttccactttataaaaaattaaaaggtgaaaatattattgaaaagtctaaaggactttatgctgtagctttgcataaaggtgaatattcaagtataggtaaaacttatgaaattttaataaacaatattaataaaaataattataaaatgattggaccttcttttgaatatggtattttagatagtttgacatcttatacttcaaaagattatataactaaaattgcgattcctatcaaagcaaaattttaattaaaataactttttaaaaattttcaaacttgactatcgtctttaagttttattatttatttaacttattacattactttaaaagtgacttaggtcactttttttaatgacttaatgtaatagatattgattttttacttttatataatgttattagaattaataaataaatattttaaggagattgttatgagtattatagaaattaaaaatataactaaaaggtttaatgataaaattgcactagataatattagctttgatgtcaatgaaggtgagatatttggacttataggacctaatggtgctggtaaatctactttaattaatataatgactaaccttatgctcccaaacaatggctctattgttataggtggtattgatttaattaaaaatcctgtaaaagtaaaatctatgataggtctagttcctcaagagctagctataattgagcatttaacgccttatgataatttagaatactttggtgctttgtatggtcttaaaggtaaattgttaaaagaaagagtaaatgaagcactagaaatagcaagacttactgaagttaaaaagaaaaaagtaaaaaaactttctggtggtatgaaaagaagattaaatatagttatagctatgcttcatcatcctaaaatactaatacttgatgaacctactgttggggttgatgctcaatcaagaaattatatattttcaatacttaaaaatttatcaaaagaacaaaatactactataatttatacttctcattatatggaagaagttgaaaatctttgttctaaaatatttataatagatgaaggtcgcgaagttgcttttggtgataaagcttatttaaaatcgctagtatttagtaatagtaaattgattttggatgttaataatatatctgctaacttaatttatgatttaaaaaatgtaagtggtgttttaagtgtagttgaaaatgaaaatagtttaatcttatctgtagataataaatttgtattatcaaaggctttaggtgttgtagagaaaaataatgcacttataattaaaatatcctatgaagattatacccttgaagatgtatttttaaatcttacaggcaagtctttaagataaagggaggatgtttatgagattattagctaatataaaaatgctttttaaatcgttaaaaagtaattttttaattacattttctacatttttacttttaccacttgtactttcattatttcttggtaatattttaaatgctaattttgaaagttctatatctgtagaccctatacctataaaaattactgacaatgataaatctaatgcatctatggctttaaaagattttattattaatgataataaaaatttattttatataaatgatgatgatgccgatttaaatttaattattcctaaaaactatgaaaaaagtttaaataataaaaaatcaataaatataaatataaaaaaattagaaaatagagagtctgtagataaccttttaaaagatattgtagatgattaccatgaaaatttatatttaagcaatttagatttagataataaaagtgctaatatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacacaaaacaacggcattaataagagaatgtattcttttcctataaaaagaactactcaacttatatacgattttttaatatccgttatatatgctttagtatttgtgattatatatatattaattaataggtttttaaatatagcctttgatgaaaatttaatatatttatttataattagcttagtttcttgtactcttgtagcttgtatttctatatttatagcttcatttttttctaaaacattaggatcaataataattagtataatcatgattattcaaattatattaggaggtatattctttcctatttcaaatggtttatctagttttattaaattttctccactaaatttaataagtgagctttttatgaaattttcaattaataatacattaggctctgtaagttttactatttttataatgttgattttatccttagtattatttttagctacatttataaaagaaaaatatagttggagggaactttaaatgaacgtacttagattaactttttctaacttaaaaagatacattaaaaatacgtctttgcttataggactgattgttattccttttactttggtaatgtttgtaaatttatttaatagtagtgataatacttctatgtattcgccaaatgtttcaattgtttgtaatacaaatggtaaatatgaaactgagcttattaaaaaacttaaaatagataataaagatgtttttagttatgataaaaaagataaagctataaacttattaaaaaataatgatacatctgttgtatttgttcttaataataacttttcaagtgatatagataagtatgtgaagcctgctgtaaaagcctataaaaccaaagatggaggaggcagtatttggcatgagtcagtaattgaaaactttataaatgataaacttaaagaaaaaattgatcctaatataaattctaaacttgtaactgctaatatagttgataaagataagtttgaagatatacaatctctaattacaattttacttgtttgctattggctatatgcaaactctggagttttatgtaaagatctgctagatcttcgttctaataatgtattaactcgaatgatatctactaaaaataaaaatatagaaataatatttagtatcttttttgctttatttttagttttaataattttaaagtttatactagatataaatataagttttaatatgtttattatggttattgctaatagttttacagctactggatttattgtagctttgactagaatatttaaaaatgaagctagtgtatcaattgtatctataatatattctatatttataatgtttttatctataataccgatgtttgataattttagtaagaatttatcatttttaaataacttagctaaattatctcctctttattggacaatagaaagcttatctacttcaaatataacttttaatttaatagcaatacttcttataggacttgtatttgttactgctggaagctttaaattaagagagtttgttaaaaattaataaaaaaactccataatattatggagtttttttaatttatcttatatattgactaatctaaatatctatactctttcaactaacatggtccatattcctatctctttaaatcctagtttgtggtatacttttcctgcctttggattatcataaaataaacataaaaacttatttctttctagtaaatcattgcataattttgataaacatttactcatatatcctttttctctatatccttttctagttgctacacctactatcattgcagatttgctattttctgctactacttgtgacatagttattatttctttatcatcattttctatataataaactattttactattgtcttgtatcctatctcttatagtatcaacgctatcttttacattaaattcttctattgttattaataaatcatatatcctatttgcatcttcttctttcccaagctttatactatcatcccattgtaaaagttttttattatctcttaattcacaaaagtaagtaggcttttcttcataatcatctattacatctttgaatttctctattatagtatcttttcctgatataattttatttcctttatatgattttatgatttctttaaattctgatacatcttcatctaagttttctacatatggaatgaagttatttgtaaatcttaataaaacaccttttaagttattttcatcatcaaattttccccaaacatcttgaaagtctttatcaaatccatattgttcaatatcacctattataaataaatttatactaggttcttttgctacataatttaaaactatatctttatgctcattgtctaactttaaaagcatattatcctctcctaactttaaatatatagcttatatatattctttaactataaataatatcctttaaaatatattaataattaaaaaatagctatgcaaaaagcataactatttccatttttcaagtacatctaacatgaatttttttatatctatattatatacatcttttaaatgctctccattaaatacatctttagaatttccatgacaaattatttctccatggtttaataaacaaacatcatcactaaaatagtgaactaaatttaaatcatgaattactccaataactatcttatttttttctttagtccactttgataaatgttgcagtaattctatttgatattttaaatcaaggtgatttgtaggttcatctaataatattacatctgggtcttgggcaaatgttctagctaaaaatactctttgtaattgccctccacttaattcattaatatgcttgtcttttatatctaaaagccctactttatcaatcgaatctaaaataatatctttgtcttttttacttaaagaattaaaaattccttttgaatgagcatatcttccaagtgcaacagtttcatatatagtgtatggaaaataaatttgagttatttggctcattagccctactttttttgcaagttcttttcttgaaaaatcacgaacttccatattgtctattgttatacttcctttgtaatctaagatattggctatagattttaaaagcgtacttttaccacatccattaggtcctactatacaaagattttttcctttttcaactttaaaatcaacattttttatgataaaagtatcatcatacccacaataaagattttttacttctagcattttatcacttctttcctttgctaaagtacacatatgcaaagaatggtgcacctattatagctgttattgctccaactggaagttctgctggggaaataatagttcttgctattaaatctgttataaccattaatgaacctccaaatacaaaagacattggtataacgtatttatgttttgaaccaaatatttttcttactacatgtggtgctattaaatctacaaatcctatagtcccacttaaagctattgcacttcctgttaaaactgcagtaaatataaataaattttttttaactttacttgtatcaacacctactgcttttgcttgttcttctccaaatgttaatatatccatttccttggtatattttaaaactcctatgatgcctattattaaaaatggaattaaggcttttacatatgaccatcccttcatagaaaaactacccatttgccaaagacttatactttttatgtcttcgctaaaaattgccgtaagtgttgtaagtaatgcatttacaaatagtgaaaataccatacctgctagtataatagtattatttgccatagttttatctatcttagaagaaaaaattactactgcatatactgttaataatccacataaaaaacctattacaggaagagttaattgcccgagaaatggtattgatataccaagaattataacaagccctgcacctagtgaagctcccgaagatactcctagtgtataaggtgatgctaattcattttttagaattgattgaactacacaaccgctaactcctaaacagcctcctaccataaatgctagtaatactcttggtagtctaagtaaccatattattgatatgtcttttgggtctattccttcttttaaaggtatgttaaatatcttattaagtattatactaatagtgtctaatacatgaatattggaactccctatggaagttccaatactaaatattagaaatactaacggtattgatagtatcactaattgtttatttttgttttgcatatgcatctggatttataaactccgccatttgttttaatgcttttactatattttgagatggtctagaagatgaatttgtatctactaagtatacttttccattttttactgctgctatgttttgccatccttcacggccttttatttctttaactgcatctggaacataatttacattagttaatattacatctggatttttttctattacagattctgcacttggtgatacccatccattttgatctacaaatatattttctccaccaactaagtttatcatttcatttaagaatgttgcatctccaaagctatataagtttggtgaaggtcctatttcaaagtatacttttttcttagtttttatagtttttccgattttagctatttcgttaatttcatttttcatgttatcaactattttttgacctttttctttagttcctgttatgtcagctataaacattatatcatcatatataccatttatgcttgtactgcttggtatatatgcaacacttatacctgcttcactaataactttaaatggatcttgtcctttttcagttttattatgtcctgatgctattatcatatctgggtttaatgatattattgcttcaggatctggatttgaaaaatctattaatttaatgtttttaggtaaacctgctacatcagcagaatatttatctacagcaaccaatttatcagctaatcctaattcaactaatatttctgtatttgatggagctgttgatattattctatcaactttagctggaactttaaaatcatttccttctctatcttttattacaacatctttttgaccacatccaacaacagccatcattactacaaaaatacctgttattaatgctaaaattctttttttcattttatttctccttacttataatttctaaatttttaccacttggataaattaattcattttagtatatagttctacatttcatattcatttccttttatatatgtataatttgatgattaactttttatgtaaaatacaaaaaagacatactaagagagtatgcctttaaattttaatttaaatactttagttattatataactctcagaagaaattatatttaagtgtttttatatactaacttagcttttttaatttataagtggttaattagactttatttattatatgcccttatatatgaaatttaatctaattttttaaatttaatttccatttttatctattttttctacttcttataaaatctattattatatataaaactattaatacagttattattaaaactacatccattataataggtcttattccaagtctgtatcccatatatctaaatggattgtatccaccaaatccaaaaaatcctccgccataactatgtggtatataggttcttcttgaacctctataatcgtcatcataatactttttattattactagactctgattcatcattgctatttgtattaggttttgtgcttggctttgtactaaacttacctgaatctggttttatactacttgattttggtttttgtacatcactatctgagctttcacttttaggtgttggctttgtgctaaatttacctgaatctggctttagactacttgattttggttttatagcatctgattttggttttgttgtaaaaccacttgaactagactttgtcgtactactttttgatttaaaagttcctgaactaggtctataactacttttacttgaacttgagcttatccttggcctcgaactatgcgaacttcctttagcaacttgatattctagtgtattttttcctttttcataagtattagcataggctttatcaattgaaaaactaaatgcacaagttattgtaaatataaataaagttaaaaaaagggtaatatttctttttaaattcttcattacacatttaaccccatttctataaacttattatatagtctatctaaattgctatcatcatctccctctattacagagtcataactttcttcacctttaaatttatagtattgtaataattgctgattatcattgtctttaatatctactaaatatacatatctacttaaagatccatcttcatgtttttctattaagtatcctttaacatcaaatttaaattcttcatcttcattgtataaagttacagtatcagttgattttgtaaaacagaatttctctttatcacattcataagtatattctagttctctacagtttatgcatctattaaaagggcactcacttacacagtttatacatttgcatttagcacatttatcaagtttatttatagattctcttttatctttagttaaataagcttggatttgcgtatcaatatctgattttttcttaaatattttagaaaataaacctttatcatcttgttcatcttctttttctaatttgtttaaaaaagacatgtattcagaaaggtcatctacttttctaataaaaactcttttgtttaattctttatcacttaaaatttgttttaaatcgtttacagaaaatactaaatcagtatatagcttatcgtattttttcttttcttgtagtatcttttcattcatgtcgtttccctccccaaaaaggtagatagcctttgaccatctaccttaagtagtaattatttattcatttctctttttattctctcaagttcatcttcaaccttagagtcaactacaggtgagttattaatataatcatcaagcatagaatcttcattttttggcttcatatcttcaagtgctttaccatagctttctttttgttgaactttcttttcaagttcatctaagtttataccatggtcatcactaagacctgataatgtttcatttatttcattgtttatctcagcaacatcaagtcttgtagctaattcttgttttttagatttcattttagatatttcaagttctaattcttctattttaaacttgatttcttgtatctttttatcttgtgtttgaattctttctactgtttgagttaatttttcttgtatttctagtttttgtttaacaaaagtttgagccttttcattatcttcttttaataaagcagctttagtagcttgctcatatttatctattctttcttctaaagttttcttttcatttcttatattatctactgatgctataaagtttgcacattgttttttagcatcttgaagtaatttttcttttttattaattgataactctaacatttctattgggtcttcatgcttttcaatagctttgttagctttggcttctacaacatttttaagtcttttaaaaaatcccattattttttcatctccattcattttattaattaactttttattaaaatttttaccttaagttaattattaatatatataatatcataaattataatgttttccacaataatttaaatttgttatcatttgttatttttatcttctattatttttaataactcttgtatttctttatctttttcttttaatttttcttcatattcagttttaacatcttctatgcttttacttaatacatttattaaagatgccatttcatctgagcttcctgctatcctatttaaaagcattaaattttgtgctaaaacttctggtatttgtttatgtgaatatctaagttgatggtctatttctccataaccttcttcaaatattgttctaacttgaatttcagctattatcttttgtgtagttggataagattctattaaataatgaacagatctataacctgatattctcgaacaaacttctattcctaattcttcaaattttttagtgttatctccttcacgcacatttgaaacaatttcaagaactttccacatgctagttataaaactatggatttcctcccaatcttctttaaatatatgtatgactcttataccaactaaatctgttatttcacttttataattatctactgtaaaatgaaaatctttaccgtatttttttcttctattttctacttttcttattatcttttctattaaatgctctgggtctttaactctagtttttacagagtgaactttaggatggcttctaagtattgtagctattaattctgcttgagtttcataactttttctatatattatatagtcttcatatattttttctatttcattccaatttatattattttcttttaattcttgttcagttatttgataattttctaaaaattcatcttttcttaacattgtagcatcctcacttttgatattaattcatatactattatatatcaaagtataagtttttaactatattattatttttaataatttaaaccccatcccaaacatatgtttgatttttttgtcaaaaagtgttattatataattatcttatacttaattttacatatatttaatataaggaggtagtactcatatgtattctaaattatattataagcaggttgagattttaaactttataaaatcatcaactgcaaaaaaagggtacccaccttctattcgagaaattgctaaaggcgttaatttaagttcttcttctactgttttttgccatttgcaaaagcttgaaaaacttggctacataaaaagaaagtccaaacaacctaggtctatagttattttagataataaataaattaagctatttactagatttaaattaatgtaaaatttaatactctttttaaattaaatctcatattttttagtttatatactaaaattatgaggtttaattttatttatttgtaaaaaataactattataccctaaaatttgcaaataaatagataacactttataatatttaatagggttatttaagaaaggaagtgaaatttgtttgactcttgcaaataatggcattgagattttgaagaatgtgtttataattcaaagaataattgatcctaaaaataaaagaattataaactttgacaatactattagacccacagaaagtcataaatgctatgattattggaaaaatcaaactccatgttctaattgtatctctatgagagctttaaatgaaaacgcttcatttactaaattagagactttagacgataaaacatatatgataatagctgcaccatttaaattaaatgaaaataattatgttattgaacttataaaggatgtgactaatgatactatgctttctctttacaaagataaaacaattgacgagctcaaacgggaaatagatagacttaatactattgtggttacagatgagttaactaaaatttttaatagaagatatctagatgaacatctcccagttactttaaaaaatttatccaaatcaaatttttcaattagtttagtaatgttagatattgataagtttaaatctattaacgatacttatgggcatttatgtggtgattatgttcttaaagaagttgcccatttattagataactatattaaaacttttaatggctggacttgcagatatggcggagatgagtttatagccgttatcgaaaacgtttctgttagagaaacttataaaataattaagaatttaaaaaatcttattaaaaatacagattttatatatgaaaacaataaaattaatgttacttgtagttttggtataactcattttaataaaaataatataaattttgatgaagcattgaaattagttgatgataaattatatagatctaaaaaaaataaagatactatttcttaatggatatttttttaatatccattaagaaatttaagataattaaaattaaaattttaatttaattcttttacactatctccaattatttttattcccttttctatatcttctaaagaaagtcttgaaattcctaatcttaatgtgtcctttcctttatcatctgtgtaaaatatatctcctggcataaatattacgcctttttcgtagcatatatttaataattttcttgaatctatattttttaatttaataaaaatatgaagtccaccttcacctaatacataatcattaggtatatactttttaacacaatcatatgcaaagttaaatttatctccataaaactttttaatcttttttacatatttgtcaaaagctccgttacttaaataatcatataatattgcttggtctaaaaaagatacatgtatgcttttacatcttttaacactttcaagtcttgttataacttttttatcgcataatatccaccctattctaattcctgggaataatatctttgaaaagcttcctatatatattaccccattatttaaattatctaatgatgctattgggaatatatgtgaacttgaatataataattcttcattaaatccatcttcaattatagctatattgtgttttttcattaagttataaaatttatatctatcctctgggctcataactgttcctgttggattatgataagacggagttatatatgcaaattttatttttatatttttttcattttttaaactatctagcttctcttctagcattttaaaatctagaccatctttatttatatctatacctactatatttaatcctaatgatttaaatatttttattgctgtattgtgagttggattttcgcatattatataatctcctttttctgtaaaagaagataataataaatcaagaccttctgtaaatccattagttattaatatatctttattggtagtgtctaccccttttgtattcatatagcttaataaataatctataagtggtttatatccttttgcataaccataatttagtattttatgcccttctaatgctatcctatttaaaaatgatttttttagttcatctatatcaaataaatcaccatttggagatatacttttaaaagatattaaatcagatctccaaggtatttcactttttacaatatccatttcatttgctattttactatattcattttcaaagctttcaaaatctatattccaagaattatttgaagtagtattttcgtgatttacaaaagttcctttacctgaaactgaatatattattccatcagcttttaattcttcatatgctgatattatagagtttctacttacatttaaaaattgactaagctcccttgtagaaggtaacttactgttatttggtattaaccctttgtttatcataatatctatgtaattttttatttgtatgtaaattggttccttatcatttaattttaagtctgaaaataacaatttatcacctcactgttacttactataatatcaattattgtatatgttttgcaattaaaagctttttgatagtctttacaataaaaaaacaaggataatttaaatcttatccttgttttatatcgctttgtataataatttcagttcctactccaacttcacttttaatttctaatttacagttatatatatttattatttgtgatgctatagataagcctattccaaagctattattgtattttctcgatttatccactctataaaacttatcagttatctttggaatttcatctttttctattcctattccattgtcttttattgatatattaactctatcattttctttgtatactcttatttttatatgtttttcatctttatcacagtattttatagcattatcaataaatattataagaagttgcttaaaatgtttttgactcatataaatatataatggttcattactttcaaagtcaaaaactacatcttttcttataatttcaaagtcatatatgacttcgtttataactttagatatatttattttaattatttcttcatctaagttatttttattgtctaactttcctagttcaagtaaatcatttacaagtttagttagtctgtctacttcttctaggctaatttttaatgacttatctaaagtttctgggtcgttttttccccatctatctagcatctttaaatgaccttttaaaatagtaagtggtgttctaagttcatgagatgcatcttgtacaaattgtttttgtacttcaaatgagttttctactgagtccatcatatcattaaaaattatatttaccttatcaaaatcatcctttggattttgtatagctaccctatttgaaattcctttttcttgaatttttttcatagtactgcttaaattatttagttttttaataaattgttttgatatatacattccagctattaaactaattattaatccaactattatcataataattattataggtattgtgctttctaaaaaatcaccaaataaatcactttctttttctatatacatatagtaattattattttttatatttataggtgaaattaaatttatcttgtcatcatccatatcaaatattacatctgattttactgatgaaggtttcttatatttaaaatctttaggtattttatccattgtatttaataagatttcgttatttgagttataaataatagcatttatgtccatagaatctactattttttcatgaatatcatttgaatcattattatttaacaatagttcaagttctctagctctagactctatttcttctttttcatattttacagtccacattctaaatactataaattgtgacacataggtaattaaaaatattaatactatagatataaaggatataaaagacattttccaaaaggttgagattttttttattttcttcatactaccttataacatatcctacaccacgaacagtttggatataatcactatttttaagcttgtttcttaaatgtcttatataaacatctactacattagtttctgcatcataatcatatccccatacatgttctagtaaatagtctctacttaatactttattttgattttttattaattgtactaaaagttcatattcagtagtagttaaattaattacttcatcacaatattttactattctagcttctatatctattactatatctttaaattctaatatattatcactttttttatttaaattaactcttcttaaaatacattcaatccttgctaataattcttctattgcaaatggcttagcaatataatcatcagctcctatttgaagtcctgatactttatccataacgctatctctagccgttaacattattacaggtgtgttttttgattttcttagacgtctgcaaacctctaatccatttaatgttggtagcattaaatctagtataatcatatcataatcattttctaaggctttgtttaaaccttcttttccatcattgcagttatccaccttatagccctcatatgatagttccatattaataaatgatgctatgttttcttcgtcttctattattaatattttatacaaaaactcaccttcttatctttttatttttttgaatctttattagaatcggctttattgttttggttttctaaattaaaatcatcatcatgattatctatatctactatattacccatttttgagtctacttcaacttcttttattgtattatctttagtttttattttaaattcatatactaatgaattattatcttcatctatctcttctttagtttttaaaacttctccaggaactttttctaaagctatttttctagcatcttcttctgagtattttatatttgcttttatgtccttgtcgttatgtttttcataattactatcgcggtcttcatgatctttatcatcatggtcattatcatagtgatccttatactcattgtggttttcaatatctattatagctccggtctttgagtctaactcaatttcttgtagcatattgtttttatcctttatcttaaattcatatgttaatgacatgctatcttcatctatatcttttttaactccaacgacttctccaggtattttatttaaagctatttcttttaacttatcttgtgaatatttagtgtttgattttacataagcaaaagcagttcctgctcctataccagctagtactatagatcctgttaatgtaagtatcgcgaattttttaattttacctttcttttcttttaacactttcattcctttttcaactccttcatttttataagtttctaatttattttttatatcttctcttttcattttgtttcctccaagttatttgtattttttcttatgagcttattatatatatgaattatgaaatctactttaaataaagattaatataagttaaaagtattattaaaattttttaataattatctagcttagtgatatagttacatatcttttaaaatcgaaataatataatttaattaaataatatatatggagggtttagtaatggttaaaaataaaaagaaagcggtagtagataaagactattgtgttgcctgtggcacttgtgttaaggtctgccctttaaatcttataaatatcgaacaaggtgtatttgcaaaaataaatttaagtaaatgtgttggatgtggtaaatgtgctaaagtttgccctgcatctgtaatagaaattaaaatgatggagattgatgaataattatgaaaaagaataagagaaaatttaaagattatatgtggatattaagtttaacttatttatttttaggaatttttaatatattatttgcttggttggggttattatgctttttaataccactaattatttctatagctggtggtggtaaagcttattgtaatacttactgtggtaggggtcagttacttaatcttatgggaagtaagttgaatttatctagaaataaaaatattcctatatttttgagaagtaagtggtttaggtatggatttttaacattttttatgagtatgttttttattatgttgtttaatacttacttagtttttagtggtgctagtgagttaaaggaagttatacagatactttggtcttttaaattaccttggaactgggttaatacttctatggttagtccatgggttgctcagtttgcatttggattttatagtatgatggttacttctactattcttggcgtggttactatgattttgtataagcctaggtcttggtgtgtttattgtcctatgggtacaatgactcaattgatatcaaaggctaagtataaatcataatttcaacgtttttgatttgccaagtccagtctattaaggctatattttatagcctttttagttatataaaataaaaaagcatccagattaatggatgctttatatctatatattaattattgttcatttatactttctaattgattacctaataatccagcccctgctgctaatataaacggtactatcattaagcttcctaatattattgtcatatataatcactcccaatgttttttttatttatttgataagtttattatatatgcttaatcttaaaaaagccttgcaggaaccttaaacatttcttacatttttgatagtttattaaaggagctatcaggatttaataaaattctaaataaatatagtactacaggtacagatgtatttatacagtttatgaattatgaagataaaagataataaaaaaggcataaaagtaatacttttatgcctttttattttattttatttatagtttatatttaagtaaatttacttagacctacttaaccgataaagttcatttaaagctgctcttattttttcgtcttttacataattatattgatgtatacttctatcttcatcgaatttatctagaatatctttgattgaattcatagtattaagattctccttttttattaacaagttataatctaaaatagaatctatactttctttagatttagaatagcatataaaaatacataaactgtataaaccatctcttattttatcattttgtataaatccaattaatttagatgcttgagaggaaagttcattctcatcgataatagaaaatgtatttaaactaggatttaaaaattttatgtgcatattaacaacccatcgttcaaatgttttaagtattatatatgaagaactagcaacattaaggttatgggaatcacaatttgcctttttagtcaaattatatatcaagtaacttagataagcagttattactatattaaaaactgaaactattgaatcaaataaatctgaagagttagagagagcatttaaattcagactatatttagtcttaaaaaaatttataaaataattaattagtaaaaaaataaatatagatatgcataaccccaataatataatagaaaaaaatgtaatcctatttttaaatctttcatataaagttttattattcatagcaatcccccataatatacaaattttatcatattatattataaacattatttttaataaatgtaaattcaatagtatctatattaaataaggagaatagctaagactgacataaaactggcctgttcatttttactatttttataaaggcataaaacatattgttttatgtctttaataaagtattacttactttcaagacttttaataatatataaattaggttagtcagctatatgttgttcttaaaagattattaacaggaaattatatatttaccaaatctaatctattaacactatatttttatatctttttttagttatataaaataaaaaaagcatccagattaatggatgctttatatctatatattaaattattgttcgtttatgctttctaattgatttcctactaatccagctcctgctgctaatataaatggtactatcattaaacttcctaatattattgtcatatataatcactcccaatgttttatttatttgttgagtctattatatatgtttaatcttaaaaaagccttgcgctaaacttaaataactcttacattttttatattttgaatattttttaataaaaaatactaagttaaaatctagactttaatctattcatagtttatagtatctcccaatatatagccattaccttcactttcaattatacaaccttcattatctatagttccgtaagtaaaataattattagacccagcaaattgtattcctttttttccatctatatttatagttacccatttatagttactatcttttacgacttctttataaaattgaattaaattttctttgtttatttctactccacccgccataacttctgcatacatacctattcgctcacttttaaatccattcataacaggtttctccgtaacaattccaaatggactgcttttttcattttccttctctgtttccgattcaacttctttttgattttgatttacttctgcgtctttagtctctggatcttcttctttataaagtttactattttcattttctgtttttaacttttcctgttctaaattatatttttcaacgctagctgtatttggttcatcacttcttaataaatcttcaatacctatctttaaccatataaaactaaaaacacatgtccagaatgataaaggtatcataattattataactacaattttatctagtttagataatgattgaaatttattaattagtttttctttaagtttcataaaatacctccatatttaaattcgtaattaagtatacactatttaactgtaattttttggcatttttataattttattatattttaaatttaatttttatgaaattaaactaaaaatataatgctaagatgattattaagcataaaaaataaggagtaccagttggctttggtactcctttttctagttaataggtctagaaactactgaattttacaactacagttcgttggttgaacattcgcattatacccaattatctttgattttaatagaaaaaaatatagaatctaatatttattaattatttttatttcaattaatttccaattattgttacaatataattataaataacttataattacattatatttaggaggttttattttgaactcaaaaaaaggattaaatattatatcaaatgttaacgatttaataaatataggttcggacctaataaaagatgaagatattgattcattactttctacctttggagatttcatcccccctgctagactttttataaaaggttacactactatttctgataaacttttctttacaaaaatagataaatttatgaaattcgctgagttaaataaaggaaatatgtcctcaaaagaagaaaaagatttcgaaaagtttaaagaaaaaatgaaaaaagataaagattatagcacaaaggtaagtcagtatgtactctttaaaatagataaatttgatgatgatgttaaattaaatgtcttttcaaaagcttgtttagatttttttaaaggaaatataaattttgaattacttaccgatataagtgaatatatagatatgatttcacgtaaagatatactattattgaagtatctatttaaatctcgtaaaactaacggctccgttttcacacctgaaacttgctatgccaaagaattgattcctcctgaaatcaattctgttataaaaaaattaaatatgctatcaatacttgaagaatgcgatgacattatatacgaaacagtttcttctgatccatctgattatacacctcaactctctaatttgactaaaagttatgttgtatctaagtcagggagcttattagcaaaatatttaagttaaaataaaaataggaagatgtatttttacaccttcctatttttaaagttttatactaattctaaataccttgaactgacatatccaagccctttattaccactaaaaccttctatacttacccatccatttaagcaatattgtaagttaactacatcaccatttttaatttgtcctataacatcatgttcaacgcctctatcatatcttacatttagtacatctgctgtaactcttgcttttcttccaaaataatctccatttttaaaaccttcaccagaagaagatccacttgattctttccaagcaactccattaaatttgcatatacctttagctatagcagttgcaaattcttcttgtttattaagtaataattttatatcctcagaattatctataaaaccaagctctatcaatgcagcagacatatttgtttctcttataacatgatagtttccttccttcacacctctatttactgtatataatttagtttttaccatttcatcttgaagagcatcagctagttttctgtatttaaatttgtagcaataagtttcaagtcctttagcagttttattaaaactattacagtgaagtgatacaaaacaatcagcaccccacttattagcatcagaacttctatattctaatgacttaaatatatctgttgtacgggacatcctaacatctatgccacactttttaagtttagactctacttttttaccaatctctaaaactatatttttttctaatacattgttaactcctactgctccactatctgtaccaccatgtcctaaatctatgtaaacttttttcataattaaacaccaaccttttctaatattttatctacttttgtatctatactctcaactttatctgtaaagtctttaactaataatctgttagtttcacttacttcttgattagtttttagaagttgtccattaacttccctattgtaactaatctcttgaaataacctttctttatcctgtttatcatcttctttttctcttattctctcttcctttgcatcctggtcctttttatttatgtaccaacctaaagctaatacacaagctattggaaaacctaagctttctattaatgcatttatatccatatgttcctccttattttgcataaaaaaggacctactgctgtagatccttaatgaagatttattctattttctttctataaccgttaaatgcactcgattattaacacatcttgggttggagcatctatgtactctacttccatctggtcgtggagctagaaacattccgcttccacacttttcgcattttttagttaatcttttatttgtaaacatatcagtttacctcctgttataaatatttgaacttttaattttaagttcatatttataatatatgcttgtcccacaaccctatctacttttatcaattttttattcttttattttcttaatgtagcttgatctctttctaatatttgttgctctatcttattcttaagatattccccttcttctactgtcattctttttctcttaacaaagaactgtatatcagctatttgctctgatggatcatagtaatctaatcctttgtttattatcaattctttgtcttttgctattgggcttgttaatatcatattgttttcctcctaaaatttaattttttatataaaaataacacctacattatcggtgtttcttcctctactggtggattatgttgttcttctattaatagatataattcatcccacatatcgtaattaattttacctatacttacatagaagtccataatactttccatctcttctttattgtaattttgaggtccaactaatatattatgtcttaataacctaaataaatcataatctacttcttgcttggctttttcagcggtaaatacagatgtatcaaccctaaaagtagttctgtctgaactataagtagtaccaagctgcattctattttgaactacagtatatttataaaagtcatcttcaatccttttaactcttttacttaaattcatgacaaaattaggaagataagatgttattttccaacttgcgtaaggagctatagaacctcttgaaaatgaaatcatagtttcattctcatatgattctaagaataatggattaacctcaaatattttctcttccgctaaagggtatatcacagtaattggattaatttgtaaccatcgcttaaaactttctactgtagtactttctgtatgtgttatatatatatggtcgctgtttacatgtgtaatagaatcaacattgttattaataaaatcatgccattttacataattgaatttgtcacataacagtatatttttaggttttatattaccgattcttgataaataagtagtagttaaaagttctacattggtatatttataccatgattcacttccattaaaaaccctcttttcggttctttgatgatgataatatttaccatcactatgtaattctatcgtatcacaaactgtatcaagtcctcttagttcttttataggcttccaagtgccgtcgctatctttaaataaaagaggttttttatcttctttataacactgatatgggataggactctcgcccttatttatacaaatatttgttggtgtgtcacaatcaccatcacctctatatacttctattctcataccttttggattttcgtttataatatctaaatcagcgtcagttaaattataattaccaaaagcaatcccgttattataagaaacaagacctatagccctcgaatatgaaggtgagtttgcctttaaatataaactattacgattatactttgtttcagttttaaatgaaaatacacctaatttaggaataacagaaaaatcaatattttctacggaaaaccctctagaactagtagatgttatttccccattaaataaatttccatcactctttatagatgaaacttctattttatctacactagtaccgacacttgctataccttcaaaatattcgtttggaggattttgagtgtggtcaccttcaataaccattacatctgataattttactggattttcgcttacttgcccatttaagctccaagctgatatatctttcctagattcctcattcggatctattaaacatatatgaacgccgttttttgcaacctttctaggatttgtaccggtaccatttgatgtgtttgttgcaaaaacaaaggatgctccactatccaacccttcaacgttaataaaagccgtatatgttttattcatatctaaaattgtattaagttcccatctaaccaaatcaccagtaaaatttataacactatttttatttttacacaagttaactaaactcttaccataaattttcatatcctttacagtactaactttagtttctttacatactagataacctttatcggtttcataagacatttcttggacttctttaagtcctcctaagtctaaaacctcttgttttaaagatttaccatttatatacaaatctcttttaagtcttgtatttaaattaacttctccatccctagcctgcaacatttcaagttcttcttgttgttgtgctgttaaactattatattcttgtttaaggaactttatagcttcatcaacagtaattttcatatcatttttagctgaattaacttccaatttcatagtatctatagattcatcgacttttgtagtcatatcatttttagcattatctacttcagttattttactagtagcatttgtagcagcagtattagcattattggtagcatctgtggcattaccaattgcagaattagcattgtctataacttcttctaaattagttttaatagtattagccaactctaatgcttcattagcatcttctatagctttgttagcatcagaaattaactgtattaaaataggatactcattagtaccttcaatgcttcctgcatcttcaatactatcaagtaccctatatgctaatttaggtgattctttaacactttcaccttttacaatttttaattcaaagaagttagtaccttctacaagtgaattagatttaaagtcaatctctactattccatttacagcatctattatagtagctacatcatttatttttcctcctgtcatagtttcgattttaactaatatattacatccagttatatctattgctttaccctgcattgttaacttagctctaacacgagcagtatttaaatcaccttctttaaaataaatcgaagttgaattatgtacaaacaattttgaaaaatctattgttatatcatatgttcctaaattcattaaatcacttcctttaagattttaagagattaatttcctctttaagttgtttaacttcttttactagactaaaaattatttgctcgtactcaaatgtttctttagagttaggagtttcaatgttatttaaattagattttagacataaaaaaggactaggaattttagctaatcctagtttcccattttgagtattaacaacgtctatattatctaatagacttgtaggagcaacttttgcaaacatagtgctaaataaggcagttggttgcacatatgtaccttgccatatagtattatacatattgtgtacccttgcccattcatatccatgttaaacttgatttcattcgcaggaaaatcgaatctgcaagcctctctttgctcgttcttactgctattgcgaataaacttaataatatcttcgcattgtactgtcattgctccatcgtcgtgtttgtaagtagcatcataagtagccgaatcataccaaattataccacaattgtaaatgttgtgattgtgcatatccaatctcccgtatctaatatgtgtaccaggttcaagcatatacccatcttgtaaatgtctaaaaaacacaacctctaaagctgatttaaaccctgtcatactttcatcatcgggattatatactttatcattgtaaccaatggccgtataccaacatggatatgctccagctatctgcattccataggcatgatgtcccgtatcactagcaactttgtaagtagaaccaaagtaacctaaataacgtccgtcatcatgtcgaaagcatctatatgctccattatataatgatagtaactttatacccgctgaattgtcagtttggtatatttcctcatgtcccatgtgcgtatatcccttaccctcatgccacactcttatacccttacgagttatagttacactgtcagaaataccattaaaccctatcattattgcttcggcatcctgtcttaaataagaagtaaggttatctactgtaacagtattttgaatttgattagcttgtatgtctattttagacaaagcattacttatcttttgttctaagtcattgtaatcttctttactagcactaaatgatagcttatcattaagctctaaaatttgagttttaagtttagttaatgttttctcatgactttccaatttaggtcgccaagtatttatatttatacctctctcgtacaacaagtgcctagcgtcaaagacttttacatcttctctatctgcttgtatctgttttctaccgatttgaagttctatagtaccactaaaatcagacctatactttatataacataagtgctcctctttaccttcaaagatatttataacactaaaatcatttaggttaatatcttgtaattttatctttgtaccatcttcttttatgatatagatagcatctaagatattagaattactgtagtttatgtgtttccagctaaaagcgaaatctttatctttctgaataaaaaatttatctgtgataactcctacttctccactaccaggagaaatacttttgttaaatacgcttatacctaagtaactttccattattatcgcatcctcccattagcatcaaaagtataatagccatcctctatccataaagtttcgctttttgccatttccccatgttccttcatgtagtaccagtaattatcattatgcttaatccatttatttcttagcatttcatgtgtgttattatcaaagtaataccaagttttaggaccaccattccagctaacttcatagaatccttttacaagttcacctacgtaataaacaccgtcattgccatccgcagcgtaataccattttgaaagctttccttcaccctgtgaaatctcaatccatccaactttcatttcattattactaaagtaataatctacatttcttgtatcgtacgagtaaatagtcctaaagtcatttacaggcttaccgccccagtcaaagaagtagtccttgccataagctttgccccaactattatacaaactgaaatcttgattaaagctagaagcgtatttagtaccatcagacgtaattactatagttccttgagttcctaaagttagatttttagttattccagcaagttgcaaccttgttaagacttgtattctttgacttgctaaattagcagtagttgtaaatatagtcatgtttggttttaatttatctatatactcataccccgtgcttgtatctaaaccgtgatgacctaactttaatacatcaactttgcctatctggcttgcaattcgttcttcatcggcaaattcaacatctccactaagcactattttatttgacatatgagtatattttaaaaccaaactcatatcattcatcttaggagtaggctcttttatattgtaaacatctaatctatcatatttacttaattgaatgccccctatagggaatgtaacatccatacccttacgatataatgcctctttaactctttgccaatatttcatagtttcccaatgtatttcttcctggtctagtatactagggtcaggattaactccataaaatacacctatatcaaacgcgtctattattgcgggcataccacctatatgatctgagtgtgcgtgagtagcaaatacataatctaatctagttattcttaggttttttaaatactcaacaaaagaaccaccttgctcctctaaccctgcatctatcaatatagttttccccgtaacagtttcaattaattggcaatcactttgtctatttggatatccataaataaaatgcactttagatatttggtttttatagtcaatcatatctgtaaagttcccttcatttattgctaaatatgaattatcagtactactccatccctctaatccattctttaagtctgtatttggtatcaagtttccagcatcagatataacttgttctattccttcacttttaaaatatagttcagaaaaatctccttttattttcccaaaactatctatcttaaaagtctcatcattattaccatctaatacagtaaacttaccttttacattcaaataagttgcatccagttgacctatccatcctctatcaagtcttaattcttctattaaagcatcttttatagctgcactttcaaagaattctgtaccatcagatactttagttgtagtagcttctacttgttctgaaaactctgtagcactaccaaaagtatttactgctctaactctataataccaagtttcgttgggaccagcttcatgtaagaaagcacttgctttaccactgtaaatcatatggaatattgttggctcaaaatcctttattctagaagcataaacttcatagttataatacattttactttcatatgtccaacttaactgtacagttttccacaatccctttacagtcacaaccggtacttcaggcaatgtatctggtgttatttcttctatgcttggtagttttatttcttctccgcctggatctataacatttccgcctggaccttctgtaccattactgtttccagagttacctccactgaatataccttttagctgttctcctacagtaacttttcgcttatttttatttctaatactcttgcaatcttcaactattctaaatttagctctagaattatctattgtattttgaagtattataatatctccaagtttaaagtttaaatgttcatatccatcttctgtttttaattcttctatatcaagttcatagctaacaataggtctattatttttttgcaaagcttcccatgttttcttaaggagtaattctggatctttaattcttccatcttcaaatatccctattattcttccatacttagctatagcttttttatcttctacaaattcttgacctgcaggtttatcagtaggatttccatttgatacactccaagaaacatccttaaaatcatacttatatttaactaaatctttttgatattctgaaccacaaccatacataacagtatagaatttatctttttgaactctttttattttacttacatttaagtctgtagagcatcttatacctgtatcagagccaagcgcattaactacattcactaattttctagctatacctgttctagtttcattcaactctatagaataatcaatctctactccaaagtttgaaataatatcttgaatacaccaaagagggtttttatataaatatggtcctataggtattaatgctctttctacacactctccaagttcataagatgttccttttaacatttctgtcattgcatcatgtacagatacagattctttgtagtattgagttatagccttttgtgtttgtatactataaaaatcatgtaagcatgtaacctttatacttgttgagtaatatgtttcagcttcgacttgatctacaataaataaatcaaatttatcttctacaaacacacctattttatttccattttttatatcaactactgaatcattcattttaaaagttaaaactctttctccagctgtagttgattttatttcatcgtcataaaactcataagcatttataattctttttagcttttcattttcatctaataataataagtaatccttcatatcaccacctacctatacatgttgttataggatattttaaaagttacattacctgcagttaacttataatcattccatccattttcaactttaggaaaatcagagtctaatgaaagtataggcatcttatctacaccgtttactttaattgatttttttttgcaatctatagctattttatctcctgcattaaaacttgtatttagctcaataaatccactatctaaagtattagaaaattctagttttattttactgcaggctctttcaacactaaactctaaactaggataagtactttctgtacctatatatgtaaatccacttgtttttatttctttttcattttcaattctacaggggttaactaaaaggaattctaagctaaatctttttattttaggtttatcatctaagtttgtaagtccatttggaacaactaaataatagctaccgggtatccaactaaattccattttgcatggtttcaagttgctagaatgtatccaactagaaatttcttctttgttttcataagttaaaaatccgctatctctatatttaaaatcaaatattatagagcgcggatttttctttgtacttcttataataactccattagagcctggtatatctgctgtatcatgttctatacttcctgttatatcatgactacatccggtaaccatcaagaaatcaggcataggaatgtcattaagccatatatttccgtaattatacatgttgataacctccaaacatcttagaattcctttgttttatttctagtaattttctatctataatttctgctaatttatataagtcttgctcattatttaaagctcctgtatttatgtttatattgtaagttgaattatctacagaactattatttaaacttctttcttgaggtaatgcgttagttgaaaaagcttcaattgaattattagcaaaattttctactgctctagttgattttggttctcctctatcaacacctatttgatacccttctgttgtccattctccaaactgcataaatagtttagaaggagagtttattcctaatagttttttacctgcatttattgcaccttttacagcgtttgtaatagaatcaactacccaagatgcacctgcttttatcccgttagccaatccttttattaagtctttacctacattcaacattgtagttccaaatgacttagctgcatttactgctccttgtaataaagatttcatagcacttacaactaatccagctcctgttgaaattattctaggtatattttgtattgcaaactttactaaattacagattgtatcccaggctatcttaacaatattgcccatttgttgccagaatgtgtcccaatctccatttatagctgatgaaactgctagtataattgactgtattatttgaagaacgttactgattatagtctttatcatatcccacgcagccttcgctacttgttttaaactttctccatgcttatcccaaaattgctttatattatctaggattatttttataaaatcagataaagcttctaaatatgatgtaactatagtttttatagtttcataaatagtctttactgcttgcattattgtttgtccatgctgattccaaaattgttttatactatcaagtatcaattttacaacttcacctatagctgtcataattgtcataattatgtttttcaaagtttcatatgcagtttgaagtactaactttatagtatctccatgagttataaagaactgttgtattgattccaaagccatctgtatagttgtttttatagcttcccaaatacctatacaggcctctctaaatccttcatttgttttccataaatacataaaagcagcaacaactgttccgataactgctgcaaatgttaagaatgtcgcggatgcggttcctatcaaagcaacaactcctgatataagtggccatactgctcctaatactaatttccatccattaaaaaggcctaatcctaaccctaaaggtaataatagtaaagtcatagctggcattaagaaaccaatagctcctgcaactttcgctataatagggtgtgtttcattgaatttagttatccaatctgctacaacaccagttactttgaatgctatttctaaaaactttcctgctgcttgaatcacaggttcaaatgcctttgcaactttaccctgtgtagtttctgctaatttctttaaagctccatctgcttctaatgctgacttaaacatagttttatacgcaaaaaaagcacccataccaactaaagggaatgccatagtcatactcatcagtcctaatgttatccctctcataagtaatccatacttaaccatatcaccttgagctgcctttatggccatcttttgagctgaccaaccttttatagttttatccatagatgatccaaattttctataagcacctgacaagctacttataggagcttgacctgctgccatagtttcatttaacaactgaaactgccctattgtacttggtggtaataaatcttccggtttgattccatatttagctaagccttgcattctttgcgttagtatctgagtttgatttcccattaactttgtcatacgagcattaagttttatagaattcgcttgttgccgaagttgcatatctgttaaacctaattgactcctcatatatatttgcttaaatgttgtatcatctaatcctaaagcaaatgtatttatagcatcacgagcattcatagcttccatagaatacttaccatatagtcttgatgctgttctagcttctctatgtaatttcgctaactctgcatatgcttgtttagtgctctcaggaacatctccacctaaaatcattgataagcgttgcatttctctattaaatttagtagattgtccataagtactatcaaaactattaccaactccaccaacagatgctttagatcctatagcttcacgttgtaaccgtctcaattcttccgttgtttctttaagtgagtcagtagcttttttagctcctgtacttacatcatctttaagcgtacttcctaatccagaagcatcatcttcggctctatccatacctctactgaaatcatcagtttcagcactaattttgactctaaattctttatctgccatcaattcacctccttcttaaaggttgaattttttcttaagatcttctgacattttatccatttcttttttacttctctttttcttaaatatgttaagtaacttgccttttttagcgcttgcatacccataagctacagatacttttaaatcttctagcttttgtttatattgcttaacatatatatctagttcatagaaatcagagttataaaaaacttctagatctatctgattatctattacatagtactcaatacacttatcccaatctaaaaaaccctctttagttagagggtatgatatctttattatcatcaaattcttttatcatagcttttaataagtctccatataactcatatatagccttatctcctatttcatccgctaagtttaaaacttcatcttcacttataaacttatttgagaaacttatcgcacatcttataagtgtgtacatatctgattctgtaggagtttcatctgttaatataggttttttagttatatcgcagtacatttttttctgtcttgctcctaacttcattatgtactctttatctccgtattttctaactattgttttcataaaatacctcctaaatttgtattaaaaaagatggatgataaaatccacctttactattctactgaaactagtgatgattcaactaactctgcatgtccattgacaactaagcttatttcaagtcctgctaatccatcctcaaaatcaccactaaatgtttctattttcattgtagcttcaattaaatcttccgtttttcctgttgatccagctgtataacctggctttttaactgctaactttatatctaaatcatctgcatttttccatgcagtccacaacattgtaaaaaccgattccggagacttatctgataagttagcaactgctgacatatcaatagagaaatcttgtccagtcaattctcttgaagtcatacattgtccttgtcctgcttgaactctatcaacaaattcttcaaattcatttgagccttcaaatgatgctccactttggccagctataggtttgccatctttcattataagtacatcagcacttcttgtattagccatttaaattcctcctttgtagtgtaaaatcaaacgtaatagaaccttcatatagtattgtgttttcatctatataatgttcttctattccatttgaaccatcttcgctcaatttgcaatctataatttcataatcccccgctacttcatatatcatttcatacaaactattgcatatatccatatacttgctatttatttcttttctacctttgtttccaccatcataaaaataggataattcccaagttataaagtaaattatatctccagtccttatccttctatcttttaagcttatattacctagttttatgtaaggcattttagcttcttcatctataacatctaatactgtaaaatctttgtctgtaagcttctgatatatcgctctttgtaaactatttatcataactagaaagtatcctttctacatcatttgaaaactttggtgtaacttcttcaaaagctggtattaaataaggtttctttcctttacctgcaggataattaacctttttaacaaatacccagttgccatctttgcccttgaatcttaaaaacttagctttcttaggttttattacataagcttttgatccaaactctctagctctagcatacttaacatttgttcctattaaagaatctttacttttatgcttagtatttatactagttttaagccttgaagtcttaacagcaactttacttttagccttgctctcaataatgtatgcatgtttttttctagactttgtagtgttatctacgacatgcttatgataacctatgatatatccaggtaaatctttaagatttattgtatctaccttaatttgcattttctaacacatccaatgttatatatgtcttatttctaattcttttaggtttgcttacaggtttataataaataccatcaatatatatacagaagttttttaaatttatttcatccatagttataatactgatagactcataattaactacaccaaaaatctgtatctgtttttctattcttatactggacttattgcaatatataggtttattaaaacttttattttctatatatccaccttgaccatcactttttttatttatttcataaacttctgctaaagtatcaaatctcatattaatcgcatcctaactttagagtttgattgagtattattatcctttatccacctatctaaatcctttatatatggatctagtaaattgttattatatgagaaattaactccatcactattttctgactttatgccttcactacctatcctgttgtatctagctataactaattctattactatatattccaactcttgaggcagttcttttttacctatataatttaaaaccctttgagtaggtctttttattaaggaatataaaagctcatccttatcagatgagcttaatcctaatgatattttaacttcatttaaaatatccatttttacttatcctttttagtgccagatttctttgtttctttaacttcctcttctttatctttttctgtattttgagttttagctaattgctcagatactttagcggctagttcctctatattaactccatcaacttttaaattttcaacttctaaaacagatactcctacaggctcagtgtagtccatccaagctacacattctggattatttattacagcatctaagtaagcaaatcctatatggtaagttgcatccctcttagcacattcaacgcctgtagaagtcatattatatcttacttctctagtaaatacaggttgtaagtttgataatggagttaaagctataaagttatctggataagtagaaacaatttctataggcaatcctgctattttaactaattctccatcttttataacactatctgcccaagctgtaggtctcgctattatagatctttgtatatcaagttttgtattttctgacattatccagttaaaattaaacttaggatgattccaatacttagattttattttctttttcatagttataaaatcttctggagttggcaattttgctcctaagtttatttttctatctatagctttcattttcttaacaaatccatctagtatttttaagaaatcatcatcacctgttcctgaagctgcagtatctccgttaaatagcaaatcttgcatatctaaagcaaaagactcttgcatcatagaagttaatgcagtttccatattctgtcctctttgttgtaatatgtaccaaacatcatcattatgtaaccacatatctaagaatactttaacaacgttataaggtatttctcttttattcacatcaaatgcaccttctggtgtttgtcctggtgtataagaatattttctagtctttcttgtttgagcttctaaagcttctatatttccacttgtttggtccttgtattgaacatttaatttctttaatgtatttgagtttgctattatatcatatataaaagcttctgcttgatctgttactaataaagttgatgcggcattagccttttgtaattttgctatcatttccgattttgttaatgctatagtcatatattattccctcctaattaaacattccttcgaatgcacctatgtaagatttttttacttctgttcctccagttgtagtatctaatgattgtggagctcttcttgatttctttaaatcagctatttcatccactaaaggttgagtagcttcttttatagccttagctattatttcttcttgagtaggctctttaggtggttcttgaccttctgttccttcatcacctgtaggtggttgttcttctccttttaatactttaatttcatcccttataggatttaaagcttcatcaagcattttctttatatcttctggtttcatatcttcattctccttacttttcttgatttctcgtatctgttctaatgacttttgaataccaactgtattaactgtgttcaatacatactccttaaaagcatcaatctgattagacatatgagtagctttatctgttatcgtagagtctaacaaagtattctctaaagaatccattaaagcccaacgtgcttctcttatcctatctccaattaacgtttcaccaactaaagtattaaagtcagttatgtattcacttttcttaatctgttgtttctctttagcaaagaaatttttaaagacatttaaaaaacctctaaattcttcttcattagaatctacaggttctttatctgatttatatatttttactgtttgcttattagctcctttatttaccaagctaataaagtcaatatctaaatttttcattctaggcacttagttctcacctccttcatatatagcagttcctcctatactaaacccagttatattaccaagcttaatatcattccaagtcgtatcatcagtaacttttattgctgctacccaatcatcttttaaaacatcaatttctggtatatcacatttagctatatagttttctactacatatccatatccaccaacttcattatgttgtttatcaactcctgcagtagctatattagttgtattcataagcttttccataaaattatgtgctgctttcttaatatcatctacagttgcccaatctccatgactatcggtataatctgtaggatttccattttcatcaaactctttagatggtctataaactacaccttcaactattctattttcttcatcaagcttagctattttaacatctaattttttcattccttatactccttgattgtaattgacatttcatttccgtttacaaacacatcatacctcatatcacaatgtttgcaatatggataccaaacccatgtttctcttttttgctctaatctatttgaacattttggacattgaatatatttcttattttccattaaataacctctccttctaatataggcttcaatgtgcatctgcattgaattatattgcttgcttttgcatgactattatctccaggataatctagtaaatcatcgtcaactacaaaaggatcatcaagtttaactctttgaccgttagcttctaaatgatgttttctagtcctttcatcttcatgtgaatcccattctttgcctataacaactccgctttctttatacccttgtaatgtacctgcattactagaacttattatctctgttctagatactactgtagctcttttcatactaaactcaggcatattcttaattctatttgatagttctggtataccttcacctagtttaaagccttctgatagttcttttataatagctttatgagttgtatcagctacttttatagcaaacttaattttcttatcttctaagaatttaagtgcattttcatttagcaaatcaaaagatacttctatgcttgattgtcctacactgttaagtacttctgacttaactaaattcaatatactcataaaatgtttatatactatttgttcatataaaacttgttgcttttctatattctctatatacatatttaatatttcatgagttatattttctcctaagtcttctatactatctattagccttgattgttgtaaactaagcaaaagattaaactcactttcaaactctaaaaaagcttcatatgttaactcaagccattcatcagattgttttatagaatatacccaatctttattttcatcattctttcgtataaatgattttaggattgtattaactatactaagtttgtttttattcatttaaagcaccctctatagccttttgaagttcctttaaaggatttattacatcttgcatattataagacttagaaataggattattttcatcaaacataggtttagacatagtatttttattagctaagtaaacttgtaaaggaatgtccgcccattcatcagttaatggctcgaactctttgccaagaagttttcctaaactatctaataacatatttggtgtagcaactccgccctgtatataaggagttaaagctttagctatttcagtatcatctgttgtctttggtcctttaaacttaagttctacatatctaatacctagttctttcattagctttttatttaataaatctgctaaatcctctctagcaggttcgaaggtttgctcctctgttatttgcttagcagtttctgcagtagctttattatagtcttgtgtatctccagtataaataggagctaatctaaaagagcttcttactgcatccctattcttatccaagtattctaggaataaggcatcatcttgcattatctctgctaatttttcaaaatgtatttttacatttgattttttttcatctaaatcaatgccatcttcatctgtaaagggctcagcttctaatattaaatatttatgttgtgccgatgctcctttagcatcacttaataggtctatactatcttgagttaattgcccattttcaactacaacagcaagaggtatatgcctaccttcatcaaagtacttataattaagttcatcagcacttctagagcccatcattttaactaaaacacctatgtaacgaggtaatccgtatggtgtataaggacaatatatattatcaaatataattgagttagcttcatcatctatattaatcccttgtccctctttaacatattcacctgtaattctatttaacttacgaggatcaccgagctctttaaaataaacttgcttagaacctaccatttgaataaactttttaaacttcttccaccttttaatcttacgttcattcccattagaatcagttatagtttcttcaacttcaataggatcactttctttacatagccttatagtgtgagctgctatatgttgaatctctgagatttctccagtttcatcagctatacattctatagttgcatatcctaacctttctctatcatcaatgaacttcttaagaactcctgtaaaccgttcatcaaagttacaatactttaaaaacatttcatacttggaccaatcttcatcagcaatcttattcttagatgtttcggtcttgtaatcaaagttataatctaggttatatccaaatccaactatattagttttataagcttctatgcaaacttgtaatatatcactattttcagttatcctagctaaagcttctatattcatctctggttgaataataaatccttgtgtatagaaatcactaaatatatcatcaatttgcttagatctacttatactagatccatctatctttttaattctaacttgttgttttgtcattatctcctcaccaccttcctacgttcttttttagttgttgttttttcatctaaggtattatttataaatgcttgcataatctccactagtccagtagttgcatctggagcatcatcatgtgcatttttacctttcctttgaaacttgttcatatccttataatactcaggccatctttctctccagtttataggaaaatgaagtttattcattacccaaggactttgagttaatatcctagcttctttatttttattttggaaaaaccactttactatagttctaccttttagtaattcgattgctgattttatatttctagcaaaacttttaccaccgttattactttcaactacagctacatcagtattatttcttattaacacatgaggaacttctttttcagtatcttccataggagcatctgtataataaacatcaagtacatatccttcgcctttatatacacctcctacaatagtacaaagcttatcctctccatcatctgcagtatctgtatagcttaatatttgttcaaaataaggcggtaaatcttcgtaagtgctaaatctagtatataatttatgtttagcatctataggttcttgttgatagttagctaatgctatatcttctcccatagctcttactttcatttcataacttgcttttgataatactgcttcacataacattgagccatcatcttgaagagctttcataagtatctgtctgcatacttttttctcttgtttaaagtgttctaatgctcttcctgctaaatctaaagaagcccacctagtcattataattattatctttccaccttcttcaagccttgatatcattgtattagtaaaccaatcccaatgcttttcaagtaccatttcattgttagcttcatcagcatttttaataaggtcgtctataatcagcaatgaacatccaaatcctgttgcagttcctcctggtgatgttgctaagtaactattataagctccttcaagtccccaaagactcatagcaccatcgccacgttttattctagtattagggaatatatcagaataaacaattatatcttcatcagctttcttttccataattgcatttcttacactttttgagaatgtagttgataaagtttcattgtatgatcctgtcattacctttgcatttatattcttaccgaatacccattcagtaaataaagaagctgttcttgatttaccatgtctaggcggcatattaataattaatatatcatcatcactataataaaagtcttgcatctcattacataactcaactaaatactctctatcctcttggtagaagtcaggagccattgcattgcaaaaataaaagaactcacgtcttgcgagctctttcttagcttctaatttaattttttctctatccatttcgtatcaacttctttaaatcttctgtacttaatccttctaatggatttttaacttctatagtgttgttagactctacaacttgtttgtctctccatttatcaggccttcgatttttaagccaaaatatttgagctgttgtatctggagcaacttgcttagttactcttttagtttcttttccattctcataagttacttcatcatattcataacctagagctcttttaagtaaagcattttcaacttcataatcaacaacttctttacctttttttaaggtagccgaaaaggccgaatacttatttttatactctttaaatgtagagtatgctatatttaaattcttggctatctgttcatcagtgagcccatctcttgcccatccttcaatcaatgtaagcttaggctcaacgtgagtgaagtatttggactttgccacgaactcacctcctagttttatatattttctgctaatccatttaaaaattctaaatttgatattatagaatttttacgttttacaaacatattaatcatattgaaattatatgggtaacctttacatttaattaaatattttacggattgtgttttatgaagttcatttaattcttcatttgtttttctatttaactctaaaaaatttaaagctactacttctgaaattttgtttagcattatatcatttgttattggataacaatctcctaaatttaattttatagaatttactcgattaatattaaatatttccctaatagattcagttgtatcaatatattttttttctaatatctttttatacattgaaggttcctttatttttaaagttattaaatatgcatataagtattgtttaacaatatcctccatttcattatgattttttaccttaaactcttttataattggtaaaattatttttaggtaatataatattttgtctatatctctcagagaaaaattataatctaatatgaatgcttctataaattgttgaaagtactgtatattttcatatgactgaaataattgatttaattttacatctatatatttagatttattatgaattgaaagcttatattctaaatcaaaaaatcttcttagataacctaccgtatccatattttgaccatagacagtagctacagagtgagatagttgttctttatctaaagaaactacaaatattacccctggaacactaaataaatgtttaatagtttcaagcaattctatagcaaaactgggtctacatctatctaattcatctataaaaaatattaactttttattatgatgtttactaaacttactaagtttttctttaaattcttctcttagtgcccttgctttggtacatctatttaatacttcattacacatttcttctatcttttctaaaatcttatcctgtgtattatcttcttttatttttaattcatttactcctattgctccttcagttcctaatttcaatgctatatcaacccctctctttacagttaaataaatcgggttaaatatctctttaaatatttttggagctaaattaacttgaccttctccgctttcttctcttaattttatttctgtaaaaatggctagtaaagggtcttctaaataatcattatcccaagcattaaaatatattgaacaatagttttctttatatctaacatcattatttatcaatgattcccacatctttataaatgtagttttacctgttccccagtcagaatcaatagccaaaactataccttcttcatcttttgcaaatatcttcataaagttttcagcaattttttttctttcaaaatgatcatttttaaatggattattattaggaatatcaattataatgtctctcatattatcacctcaaagtatataatactacatttttatacaattttattcctttttattccatataactacacaaacgaactcttttacgagttattagaatcatatatttttaattcatattcatttgcaactaaattatatatttgttcaatataactttttatttttttattagctcttatacataaatttattaaatcgtccatatctttttctttaggttcaaaccaaactgctttgaaatctaaaccattcattcttactccgttataaaaattaggaagtcctttaaatcttatattattattatgttttaatttattagaaatttttcttatctcttttatatctgaatcattatgatatttttttaaaacttctaaaacttctctatttttacatttctttttaactgaatttataaccttttcgtaatataagtttttgcttttatttctaaaatccttctcactaaatatttttttacctttaagattaaatgcaaaagttattatttgaagcatgtaatcttctatactgttgtatgataatatagtgctttttatatgttctcctcttaagaatagcctaaatacttcttcatcttcagcttcccatcctcttaagcccaactgatcatctaatgcatcgaataaattaacattagctccagcaaaaacataatatgaatcaaaaaacttattaaatgtaattattaactgcttaatacctcttgtatttttaactactatatacttttcaataaaatcagcattcagattatttatttgattatttctatacaactctatacctccattcaagtatatatttctacttaaatcgaggttttccttcttttttcttaaatttatcaaaattaggtttcttactcatttccctatcagcattcttcaactcactaggtaactcatgaatcatcttaattacttcatcagcatctttccatactttcatataatcaccttatataaaattattttatgaagttcattttatttattacttttcaattaatcctatcctctccaaataaacattttaaaacaaaataaagacaccttattcagatgccttttcatatgtttgttttattcttttttctgataaattaaattttatctaatttaatttgtttatttacaagttcttcatttgaatattccctttctttgctcattgataaaaccgacataagtatcgctccaaatgttccacctattataagccctaatataaaaccgcccactgaatttcaccctttctatttatctattcaaatacaatgctgcttttaattctactctaaatatgtattctaatagtatctcctaaatgaaagtttcaattcaaatcttctataacttcaaatttacctttattgtaaaaataaaaaagctaggtgtaaggccctagctttttagtagttataaacgagtatacgtaaaagttatttagtttatactccgtaccgctacagagttgtttttatactcaacacgagttgctctaagagccgtaagttatattatttggtgaggattataggtttcgaacctatcttcttctaaattagatgttttgccattaaactatatcctcacgttaccagggcaaggagagttaccctggtcattatatttatcataaaaaggggtattagggagtaaagaaatctagcttgtcctaaatctcttatactaacataatatcaccttttaaccccttgtgcttctgaacttattcggaagtttttctgtcatttttctgcgtttttaaaaatttactataccttccattgctgtatttttaaaattataaaaaggatacattgtagacatagatttataaatcatgttatctcttattgaatagtaagtatctttacctacattcattttatctccataaactttccaatcttttatttttaataaatatcttattttaaacatttcatcttcttctctgttaaaattagattttgctctttcaatcctttttaaatctctttcttttttacgtttttccttctctaaaaattctatttgcttttgtttttgtattatctccctttctatagctgaacttatattagtacttgtttgtactctttctgaatactctatagatccacaacctaaataatcttgttctataaactctatttcttcatccagatatgtaatttctttttttaaattttcataatgataaaacattccttctactttcgaaaataaatcatcaatttcaaactctttttctataatatccatatatccacctacttactatatatctttttactcaataacctctttaatttcattcaaacattttttacaaataaaaatattctttatattttttaaatcttccttagaatcgcataaagtacatgaattattgttttttttaattttaatagttctgttttcacatattatttcaactggatcatgttcttttatatttaacatctttctaaattcctttggtattacaactcgccctaatgaatctatgtttcttataataccttgattgtttttatcattcatattatcactcctaaaatattggtaaatctaaatttctttaccttttatgtttaatataattattaagcgtatatatggtttattaatatataccctactaataaatattttaacaaatcaaaataatcattatattttctctattgtaacttctacacgaggtctatcactgtaaaacttcttagatacaacctctacaacttgagcatcatccttatatgctatcccatttaaactatcagctatggcttttataatattatctagatctggtttcttagttggtcttataatcccatctagtttagctttagcttcttgaaatgctttagttttaacattatttttttctatagcttccctatctttttttgtgattccgtagtaacatgttatagacatttttacatttccctcgaaataatgtttaactgtgcttctatataataactttatccagttttcataaatcttagtttgctctggtgtaaatggctttccatttttagttgcaaatctaggtctttcttttccctttgcttctccatctattgtaaagttaattttcatactacctccctttatctcatatagctataaatatcatttcgttttgcttataggactttaaatatattgattaaatcattaatatgaaatttgatttcgtaacatttcgacatttttatgcatattatacattacatgggttttactattaattttgttcataaagtaaaacctatgctagtcaatttattataggagtgattttatgtgttataacacaacttcatataacaatatgcccactaattcatgtgaacctattggacctttctatttatatctaattgatgatggtatttataaacattatgaagtttattattatggaataagaggcagaaatggtgattgttggcttacaacagaatttagcaataatccaaatatagaaggtccatatttctatagaagtaccggtagatcgcctgatagattttgtgctcttacttatgttctaagtggagaaccaaattcctcaaaggataactattacgttactagaagtaatatagatggatcttattatatctcttctagaaacagaaatggccatggctacctaaaatctactaatggtatatatggaccatattatcttatctgtaatgatagtataaataacaataataacttcatatctgattgcgattgttataaaaaaccttattgttgctgctatttctatactaaatgctgtttctataattagcatttaaaatttttaagggctatggtaacttaaactatagtccttatataatatattcgattagttcaaatattcatcaactcttacgtctaacatagataccataacaagtgtacaatcagtattgctcatagtatattttttacttaaaaataattgtataattattactgctgtcattattagccatcctgtatttttctcatagttactcctataataacttgattataagatccaggatatttattcctctttttcacattcacatacacatccatcttcactacaaaattcacatctccagtgtttgcaattgttgtcaaaatttataattgtatgtcctaacttagtacatccatttttccctaaaatgtaaactctattatcacagtccttacaagttttacacttatatttcataatcctcatcccctaatttatcatttagttatcattatcaatatacctatgcagatatactgataatgatatgtattccatgtttattttttagttaaaagaatttattctacttctatatgttcacctatctttgtagcttgagaattgtatgtaacttctacctctctgctccattcgtattcagagccgcaatcatcacatatatgagaatcactatcacaactatattcccatgaatccgattgtttagaaccacatacaggacaagttatttcatcttctccaaatgtttctaaatcgtctatatcttcattgaacttaaaatattctaactctactattttaaaattattaccttggctactacttactgtgtaaaatgtattatttataagtataggagttgaccatatatcaaaatcgtcattaacttctatagttttaaatataggagacatctcccaatcatagctccagttaccatctttacacacgacttttttatacaactttaacttcttcataattaatctctacctcctattttctagtcagacacccacatactggacattgataatactcactacctcttatctctatgaccatgtatttctcattgcaataattacactttttcttagttactaactgtaatatatgagccattacaacatcatccctatcttagtgtatatttcaactaaatcttcacctatattcacacttagctttttaacatcttccggctttatagttcttacagctcctcttggtgtaatctttttatttacgaaatctataataaatgctgtatctattttgtccttaacttgtctttgcatttcactagccatctctaattttttatacatcttaaaattgtcttgctttaaattctcaattttcttatctcgctcctgtatgcaccattccataccttgtatttttttattagcttcttctagatctgcttctaatttagctattatagcgttcttattttcattcctagcatctgaatttcgtctatttatatataattcatcttttaactcttttacttttttatctgctgcagctcttgcgctttcttgaattcttatatccttaactaactcattagtttctctttcataagtacttcttaaaacaaatggtaatttaactttcatctttagttccccctatataatttaattttcaatgtaaaatctatttataagataatctccataatctttaccttcttgataaacttcttctttttcaaaagtattaaaactcttatattttttcttaagctgcaattcatgcttagctataataacgttgtagttatcaactacaaacttttctataactctgttgtgagtatttgtaaatgacttatttgcaaggtccttcaaactaactacaagtgaaccactagctatttttacttcttgattgatttgcatttatttaactcctccctttgttctataactacatatctatctaatatttcacttaacctaactgtaacaggagtatgtccaaactctgcatacagttcccctaaagcttgtcttaatgcttccatacattaccctcttattcttctccacctttaattccccaggcaatcatagccttatctgcactaactggatattgtatttctccatctatttcttttccacatatacactgtgctaatgccatgtaatttggatatgttctataatcacttggtttaaagaatgtatcttttacacttggtataatggcttcttttttcatatctctaactctccataaatttaggattttgatagttcttttccattttcttaaagtaagcttcctggatctcttccatatcaaatcctaatgaatatacaagctctacatatttacttattaaagtatctagcttatgtctaccaaacatctttttccaaggtagtgtagttattttataagctatataaataaattgtctttctaagctcgtagtttgagtttcatcaactgtaactactaagtctgcatctaattcatttgctaggtttcctaaatgacttaataagtccgctagttcctctttcaatctatcctggttaacttgtgatctatcccaccacttatgtatcttagtttcattaagaacttctaccaactcacttagtaaagctaatgtaagccacatagggacttcaaatttactttcttgataatttataccttcaacaaggtgtaaataccctatgaacttgtcctgctctttttttacatagtttaaatctataatcttactcatgtatgtcatcccccactttgtactcaattttatatctatttttatataatcttttattttcgatatattttcctatgctcttattatcagttttaagaaacttaccagatttactcatgctgccaaattctaaaacttcattagttaatgtatctataactttaactggtctagctttatttctagaatttatataatcaccatctgctaaaattctgtatctcttcttgtatttacttttatatctaatgtatgttgttatagtttttcttttcatatttagaaactcgcaacagtcatttaagttttcaaattcgtattccttattttctaattcatctataactttcacttttaaatcatcagataatttagttgatttttcacttctaactgaaatttgagctataattcctaacgctttttctgttgttaattctggatttaatatacaagctaatagtgcttgataatttgttgtataatcaaaatcatatgtgttcatatattgcattactaatctcccctttattaccaggagggattaaccctccactatttaagctccataaactctataatttaatttacttcctttcatagtaactacataatctttactcatttcatataatctagaccctatagcttcatcaatctctaataaatcatctatagttttttctgtagtaactataataggtaaatttttaaaatatctatagtcaattatttcgtacataatatttacatcagattcagtaattctacctttgaataaatcatctatgaataatacttgagcatctttgtatttacctatttctctttgataattttcttcatcggttatactttgcttaattttggttataatacttctatatggcatatatataacaccaattgcattatcaagcattatgttagatatagccattgctaagtgggtttttccacttcccacttgccccattaacattatagaatttttacgaactgctctattctcctcaaaatttttagagtagttttttgtttttgcataagcctccatagtttcaatgctattttcatatttaaaattttcaaatctctttttcctaaattcttcacttacaccagatgcttttaatttatcctctgctatcctaagatttctacattcacaagctccaaaacttccatcttctagctctataaaaagcatgtccttacatttatcacatttgtatttactcttggctgagtcttctacattcttcgagcaatctagcttttcttgcttcttcactttctgtattatcatctgtactctctgttgtaatattgctttttcttcctctgacatctgacttcactcccttttgagtttctacctgaagattatatgcttctaactgtccaaatgttaaaatatttctgtttgtccatttttttattatgccttttaaatatcctaagtttaggtttcctctgtcagtacatatctctatagcttttttaaataatccaatatctataagctctgaccattctataagttgttccgctactaagccattaatcattcctatattggattgatatagttttgagaattcttttatcgtttcttctttatctaaatacatataattattaattgtattattaatatatgtattattatcttcacagttttccgaataccctctgtcgagatttcgagtaccctcttcgaaatttcgaacacctatattcgattttccgaacacctttataactctcttctctatcaatttcgtatttttcttatagatgtatgaaattttcacaattccttttttctccaaagattttataacctctgaacatctattctttgatagtttaaaaaactttgaaaaataatcgttactagcaaaacatccatcttcattatctaaactatctatttctactaaaaacactttttctaataaggtaagctcttcatttaaccatatttcagcaggtatccaaatacctttaaatgctctttccacttttctcaccttcttcttatgttaattactagaagtaagagtagataataaactcctacttcttttgtaaatttagttacatatctaatttagtttgaactacttcatcttttggatccgtatctacttctttaaagtctgcatctattatcttttcttttggttcatagttagttaataaatctaaaacttcgttaacttcatcaaatttaagttcttttaaagaatatccattactttcacagaaactttccatctttgatatatctttaggattgttgtaatcatatagacctttcatagatgctaatttcattattccttgcttttgacctggtgtagcataaccaactttaatttctttttcaggtaactttcgttccattcccatttcttcttgttgatatagtcctcttagttcattagggaaagcttctcgaagagcttgtgattgagctactttccttatcatagttgctccttttgttgaccacatactatttaaagttcctgcttttgtcttttgagcatattcttcaaagctaactacagatttaaccggaaaatctttatcttttaaatatacttcacaccatcctcctaccaattcctctcctggtaatttaagcgcaccttctcgttcttttatatctccatttttatctaatacaactattcctgctttcattccgttgaaattatgatgttcactagctctttttatgaaaacatccttacctactataatttgagctggatatgcatctcccatctttactaaatatgcatcccttacaaaaggattaagattttgtgctttgcataattctataaacattattacttcttggtcactaacctttccatttccacttgtaagataatttctaactgtatctgccgttaatacttgtccaccatctaacttgaactctgctaatgctaatgcactagattgtgtcttttgtatgttattcataaccttaacctcctatttaatcattagtgacatacctggttcgctcatatatgccccttcaacttctatcccagcttttaaatctgatttaactaagtctttatttactttataggtttgaactacttctatatatttacttggaagtttactttcatcatctatctttagagttgaaataccttttcttaaagtaagattacctactggtgtttctattttcttaacttccatttgctccatacaaaccttagtgtaatctcttaatctttttatattgttttctttaactttttttagcttgtttagcctgtccatttcagcttttattgcatcaacatcactttctaaacttctaacaacttgtataatccctttacctttgttcgctacttcactagctataatttcttttatctgttgaacctcttctatttcatccatatcccttaaagctactaaatcattttataactcatataaattcattgatatttcctccattttttcatataatataatcagttttaaatttttatatttacttgaattgagtcactgccaatgactcttttcttttatccataataagtttcatagttattaggtttaaatatctctaactcctcaagttctctttcttcattttctatatacttgttagcataatctagcactatattagccattgtccttataccaacccagtaatttctttcttcactttcaacactaactattgctttgttttcgaaatactcatcatttatattgttaatattcatgttattttttgctgtttctatttttatatctttttcagaaatcatttgttcagcttgttctttattagactctgcaatcttttttaaagttctcattatctagcacctcctttcaaatgaaaattaattaatttctttacaaaccacattgacttttcctctgttgtcatagctttaaagtctttaacactcattcttgatacctccaatcattgaattaacatcctttccatccatttcagctaagaaacgattaacctctgcatttctaacttttaaagaacctaacttcaatcctattaataatccagaatctataagtttataaacataatgaggtgtagtttttaatctctttgaaacctctttaacagttaataagtaatcttccatatgatcctcctatgcaaatgccacttggctatttatcatacttatttgttcatttaatgatattgttaagttatatctctcaactatatcaagagcttcacttaagtgttttctctttatagctttataactgttaacatcaaactctcttttcaattgtctatgtatatcactgtatactttcgctcttactgacttattgttatatgctttgcttccatgaccaccaagcactctagttcctactctcttaactgcttttgatatttcctcacactcaactgcaaaaagtggtatatcttctttaaagtcttttaaatcttcttttacttcttctatcttttggtcttgctcttcaagtgccttatattgaagttttaataattccatagcacttaattgtttagatggttgttttaacttattttctaagatttctatatactgttgagttttatatctaactaatgcactttctttatttaacatttgcattattcctgttttgttcattttgtaacatggatttgtttttccattttccgctacatatgagtagggtacaaaaatgttctctactctaacattaagcttttttaatgtttctatctcttttctgatatctctcataaaagtcttatgctcttttattacttcattttcttcctcttttctaaagttgtttattaactctacaacttctaaacttgtcattgttactgtttcagtttgagctattactaaatttgtcatttatttcatcctcctattttgaatttttgatatttaattggttaaactagtttaaataactttttaatgttacatagtcaacttattgttgtctaaattattaaaaaaaagttccattactgatactccaaaatattcagctaattttttagcttcggatattgtaaactcagtttttccattttctttactccaataagtatttggacttattcctagatatttagctacttccgactgatttacagcttttaattctctttcagctttaagttttagattaggcattattcattcacctccttggtcaactttttgttgtcttattacatttacaattatagacaacgatatgtttactgtcaacactatttttgcatttttttatgaaaaatattcattttgttatacttttttcttaaaaatcaacaaatcgtttataatatattgtgaaaataatcgtaggaggtggttatatgaagttcgctgaaatacttagagaagaaagattgaatttaggtttaaaccaagtcgaatttgcaaaaatttttaacgtaactaaacagactgtttctaattgggaaaatggaaatagaaacccagatagtgctactctatctaaattagctgattactttggtgtaactgtagattatctccttggaagaacagataaaaggactataaacaaagaaaaagcaaaactagattcaagtataaaaacaatagctgcacatagattaggggatgtagaagatttaaatgatgaagctattgagaaaataaatgagtatatagaatttataagaatgcaacaaaataaaaataaataaattatcgagcagttgttctgctcttttttatacacatcaaaagaacatatgttcttggttctttgggggttaatatgacaaaatcagaaaaattatttaatttagctgaaaaggaaggtataggaatatattacaaagatttaaaaagtttggggttcctgggattatatatagaatgttatgaatccccttctatgatactattagatgattctctaaaaaatgattataagaaagcgtatacagttcttttagaagaattaggtcatcactatacgagttctggagattctattagttgtgttgatacttacttagataaacttaaggttaataaatgtgaaataaaagctgaacgctggctttgccattatttaatatcaaataatgatttaattaatgctataaataaatatcctacatctgtagaagatatatgtgactatttaaacgttgatatagaaatgcttttaagtaaattaaaatttttagcattagagactaaatctttatacttaggtaatgataggtttctttcattaaccaatttacctaatatatctatctatgatacgtctattatttaggtatattttatagtattaaaactaaaatataatattaattaccatataaaataaaagatagtacatttattcgttgtactatgttaatgcattaagaatttatttcaacatggaggtggcataaaatgaaaggtggagttagaaaacgaggtaagaaatggtactactattttgatgctggtactgttaatggaaaaagaaagaaaatagaaagagttggtggattaactaaaaaagaagctcaagaagcattaagaaatgctttgaatgaatttgataactgtggttctatagttgatcaaagtaatataagcgtttctgactatcttgacttttggtacaatgagtatgttttaattaattgcaagtttaatactcaagtaaattataaagctactatagaaaatcatataaagccagaattgggtatttataaacttaagtctataacaactgctagattacaggaattttttaataaaaagttcaaagaaggaatcagtagaagtagtttggatggatataaaggtattttaagcttatcatttaaaatggctgtacatccataccaacttataaaagagaatcctatgacttatataaaactgcctaaagctaacaaaagcgataaaaactctgtgaagactgtaagcattgaagattttaatagaattcttcaaagattcccatttggccataaactacacattccattacaaatagcattccatactggacttagagcatctgaggtatgtggtttaacttgggacaatattgactttgaaaataaaacacttacagttgaaaaaatattacttactaaaagtgccaaggtatcagagtttcaatcacctaaaacaaatagctctcttagaactattcatataggagatacactgtgtaatctattgaaaagaaataaaatttggcaaaaggaaaacaaactaaaatatggtgaattttatattggttctgaacatgattttgtatgtttagccgaaaatggtgaatttgttactactatgaactttagacacctatgtcatgtagtcaataaagatttaggtatagattttaattttcatatgctaagacatactcacgctactctattgtttgttaatggagctaatccgaaagatatacaagagcgtttaggccacagtagaatagatattacattaaatacttattctcacctaactaaaaagataaaaaaagaaactgttaatatatttgaagaagctataaaataaatattgccaccatttttaatctatggtggcaaatgggtggcaatttgatgattctaagtgtgaaattaaaccctaaatatattgcaattacttattttatactatttaaatctatgtaagcttctatttgtggtatatataacatattatcttttatatgggtatttccaaattcctttaactctaatcctttatcatctttagttatcttatactttacaaccagattttcttcatttacatcaccaaagaaatatgtaccttcatattgtttaaatctaaaattgaaattatctctagttagctttatttttaaatttttcataacttattcctttcgataataatttaatgtttacactatattataagaaaaaataaatttattcaagggtataaatgaatttaaatttttaaatcttagttctaacttatagttatttttattgaatcattacctttagtttgtatatgagctatatcaccagttaaattaaaatctagtgcatgagttacaaccttagccaaattttcagtgtcaattaaatcactttttaaatttaaccaattaaatccattaattttaatcattctttttacaaactcaacgggaaacttaagataaattttatctccactatttgataaaattcttattctaaaaagcatattttcttctaaattattaaatctattaaccacctaatcccctcctcttcttacttttattaatatgacttaactatttaataatataacttttatttagtgtattatttttaaaagcctagttataaaggaactagctttagttagttccttttattttatataaataaaacttttattaaattttattttatgttaaaatctttctagtatataattgaaatattgctactatatttatagtatgcgtgaagggaagattgattaaattgtttaattatattaagtttgctattttccaatttattgggtttatattatcattatttaagttaaataagtttttaaaatctcctgataaatatacaatggaaaataaatttagctttttaaaaaatcaagctaaaaattctttaaaactagtaaatattaatgttaatatacttggcaaggataaaatacctaaagaaccggtgttatttgttgttaatcattctagtatgttagatagctatatattaatttctagtgttgatagacctattggatgtataatagccgatgaaccaatttggaaaaagatgcctatagttaataaatgggcttctgtaataaaatgtatatatattaataggcataataatagagaggctttaaatagcattttagaagcttctaataatattataaatggtcacagtatggctgtatttccagagggagatttaacatggataaaagattcaaaatctttggtttctgagtttaaaagtggagccttaaagattgcatataaggcaaaatgtcctatagttccattagttataaaaaattctagagaaacttatagcggatatgaacctataggcaaaattaaatctataaatgttgaaatagaatttttagaacctgtatatctacatataaataatcctaaaatgaaaactatggatttagcaaaattaataagagaagatatgataaatactattttagaatttgataataaatataataaaagtgctacatcaatatagatgtaacactttttatatttataatacttttatttcatcattagggtatattataccttcttttataacttttacaaatatgccttctcttggcataacacaatctccagtttttttctttatctcacaaccaccatgacattttttgcctatttgtgtaacttcaacttcacattccccaatttgaagtctctgtcctactggcaatttataaacatctatgccttctgttgttatattttccgcaaaatctccaaattttaattcattaaatcctttagatttcatcttatctatactttcttttgataataagcttatttgtctatgccaattaccagcatgagcatctccaactatcccatagtcaacttttaacttggcttcatttataggtgttttaattacaccttttctatcgcttatatttattgatacaatcttagccataatatgccccactttcaatgttatttttatcttttgtatatatagcttgtctaactatttctttaaacataagaggtttatttatataattttttatatcaacaccagtatttgaatgaatacaggtttttatatatccattttcatctaatataatctcattgcatcctctacaaatattaaagtcattatgagtatctatgcttattattcccttagcattatttaaactataatatctatacctttggtttacataattcatttcatgtaaaccttctatattatttattatattttgtatatttacatatcctcttttaaaaaagttaatagagctagattctggaattaattctgtaaagtttacttctactggtaagcattttgttaaataaataaaatctaatatttcatcaatattaaaatcatttataagagtacaaattattatatatcatctcgtattagcatacctttcggtatgttatccgtgtgtacagggcaggttacccacgcgttactcacccgtccgccgctcttctccgaagagaatcgctcgacttgcatgtgttaggcacgccgccagcgttcatcctgagccaggatcaaactctcaaataaaagttgtccatcgctcagctatcattatctgaatatctggcttggttgtttgttgtttaattctttaaaaagaatttttataattaacctactgtttaattttcaaagttcttaatttgttttgtccgtttctcaaggacaagtaatactatatcaccttttttttacatcgtcaacactttttcaaaaacttttttatttttttactaaaagtttaaaaacaacccatatatgcttaaatatatagttgcgtatataggttgttttctttaattttttattaattatgtacattagttccaaaatatctttgtatacctgcatatatagcccaagcaattttttcttgatatttttcatcatttagtaacttcgattctttctcattagataaaaaaccacactctattagtactgatggaatttcattatcttttagtaaatataaatcatctcttggttttatttctctattgttagttttatcaactacacgttttaattcgtcttgaataaatttacctaataatttactatcttctttatcctttggataaaatgtttgagctccataatatttactttcttcaaatgcattaagatgtatagatacaaatgcatctacgtttgattccttcaataattttttacggttttttaaattttcattatacttttgtctaattgttttcttaccatcttcttcgtataaactaacatcctcatctctagttaataatactaaacatccacttgattctaacaactcccttagcttcaaagttatttttagatttacatctttctcaagtatagttttgtcattatttagagttccaggatctatacccccatgccctgcatctaacattataaccctattcgttgtaggcatatatgacataacatcttgagagttctttttaacttcaaatataaatatagaaagaaaacataaaagcgcacctataatgcttacatgcttaatatatttcatataatatcaccccatatattatataaaaaaagactttggaatattccaaagtctttgtataagcatatataattatctctttgagaattgtggagctcttcttgctgcctttaatccgtatttctttctttccttcattctagcatctctagttaagaatccttctttctttaaagctggtcttaactcagcgtctactgttaataaagctctagatataccgtgtcttatagcaccagcttgtccagtgaatcctccaccttcaacctttactataacatcgtatttgttttcagttcctgttaaaactaatggttgtttaacatctcttattaaagtttcgtagttgaagtattcttcaacttttcttccatttactattatatttccttcacctgcaactagtcttactcttgctacagagtgctttcttcttcctgttccgtagtattgaacgttagccatgattaactcctcctttcacccgttatgattatttgaagtttaaaacttctggattttgagcttcgtgtccgtggtttggtccagcaaatactcttaatctagtcatcattctgcttcttaatttgttcttacataacataccgctaacagcatgcataacaacctcttcaggtttcttttccatcatttctctataagttatttcctttaatccacctacatatccagtgtggtatctgtacatcttttgatctaatttctttcctgttaaaactactttatcagcatttacaacaacaacgaaatctccaccatcaacgtgaggagtgaaagttggtttatgctttcctcttaatattgtagctatttctgtagccatacgacctaatgtttttccttcagcatcaactacgtaccattttctttgtacgtcagctggcttagctatataacttttcattacaagtccctccttatcttatttccatatgatattttaccgtctatgtcaagtccggggcaagtggacttattaacacactcttgtatattttaatacatgcaccctggagtgtcaagctaataatcaacttttttaagaaataatccatgagctggcgcagtgtgtccagccatagatcttgacttagattctattatacttagcatgtcaatatctattcttcctcggccaatatcaactaatgttccaactaaaatccttaccatattatacaagaatccattaccttctacttctataattattaagtcttcttgtcttgatatatctatgtcataaatagtccttaccgtatctttcactgatgatccagaactcataaaccctttgaaatcatatgttccaattaaagctttagcttcttttttcatcttttcaaagtctagatcatacttaactaaatacgatatattattatatataggacttctatatgcattattatatattaaatatctatatctttttccttttgctgaataccttgaatgaaaatctaaatccatctcttgtgcgtctattatagatatatcctttggcaactttgagtttagtgcacctggtattttctcaacaggtatattacaacttgtattaaaatttgcaacttgacctaaagcatgtactcctgcatcagttcttcctgatccaattattttaacatcttctttagttatctcttttatagctttttctatagttccttgtatacccaaaaaatcattttgcttttgccaaccacaataatttttaccattatattgaatagtcaattttatatttctcatatgatacctctttatataaacctaataacaactattacacctaaataaataaattgaatagcatatgctatatagtcagctttagtcattatactttgcttcatcttagttctattatatccacctctataacatctagcttccatagccatagctaattcatcagctctcctaaatgcacttataaataaaggtattaaaagcggaactaagttctttgctctatttattatatttttactttcaaaatcggcccctctagacatctgagctttcattattttatctgtttcatctaataaagtaggtataaatcttaatgcaatagtcatcatcatagctaactcatgcacagggaatcctatctttcttaatggatttaataatttttctatcccatctgtaagttctataggcgatgtcgtaagtgtaagtaatgatgttccaacaactaagaatataagtcttagtgccataaaaacagcttgacttaacccctggctagtgatctttataaagccaaatgaccatataggatctccaggcagaaagaatatattaattacaaatgtaaatactataatccatctcaaaggtttaagcccttttataatatacttagatggtattttagacatggccactacagccatcaaacttcctaccactattaaatatggccaaattttatttattataaacagtgataccataaatataaaagttgctataagtttaactctagcatctaatttatgaataattgagttagtaggataatattgacctatagttatatcttttaacattttcctttacctctcataactcttattatttctttcttagcttcttcaatagtaattatatcaggcttaatatcaaaccctctgtctcttaatttaatgcataattctagtacttgaggaatatctaaacctatatcttttaatctattagaatgatttttaaatacttctctagtaggtcccataaattctatttttcctgaattcataactattatatttttaactaatttagccatatcatccatactatgtgatgaaagtattatcgtcatatttttttctttatgtaatgtctttattaaattaaatatttcatctcttcctttaggatctaatccagctgtaggttcatctaatattaagacttcaggattcatagctataactccagctatagctaccctacgcttttgtccgcctgataattcaaatggagatttatctttaaattcatcatagtcaagcccaacagcctccatagatgctttaatcctattagttatttcaatatcatctaagcctaaatttgaaggtccaaaggctatgtcctttgcaacagtctcttcaaatagttgatattcaggatattgaaataccactccaactttctttctgatatcagttaaatttaaatctttatcagttatatcaaatccatttattaaaatttttcctgatgaaggcttaagtataccatttaaatgctgaattaatgttgatttacccgatccagtatgacctattaacccaacaaaatctccatcttctatacttaaatttatattgtctaatgctttactagcaaatggcatgccttcattgtatatatgtgttaaattttctattataattgacataatctcatcaccatctcatccacagttaatatatcatcctctatatgcataccttcttccttaagttctttacttaattcagtcatataaggtacatctaatcctatactttttaatttttcaactttagagaatacttgtttcggagttccctctaatacttttttccctttctccataactataactctatctgcatctacagcttcttccataaagtgagttatatgcattatagttatgttctcttctttgttgagtctttttatagtattcattacttcttttcttccagatggatctagcatagctgtagcttcatcaaagattatacacttaggcttcatagctattatacctgctatcgcaactctttgcttttgtccaccagataatagatgaggttgtctatcttttagctcatacataccaacacttgttaatgcttcttttaccctctttctgatttctacaggttctatccccaaattttcaggaccaaaggctacatcttcttctattattgtagctacaatttggttatctggattttgaaaaaccatacctgctgtctgtctaatatcccataaatgctcttcatctttagtatttagaccatctatatatatatcacctttagtaggcattagaattgcatttaagttcttagaaagcgttgacttccctgacccattgtgacctataactacaacaaattcaccttgtttaacatttaaagttaaatcatctatggccttaaatgtactatcttcagttacatattcaaatgatacatctttaacacttactatatctttcataaatttgttctcctttaattagtagtgtttatcaatttgcaatttatattgtattatatcataatttaaattacagattaacacaaaagttcctcttcaattaagcaatacactattaaattatagcaccactattaacaaatttgatatttaattgcaataaaaaaaggattaggctttgcctaatccttttacatactatactaattctattagagccatttcagcagcgtcgcctcttcttggtcccatttttattattctagtatatccaccgtttctctcagcatactttggagctatatcagtgaataagttgttaactactgtctcatctaaaacataagctaaaacttgtcttctagcgtgaagatctcctctcttagcaagagttatcatcttttctgccattctacgagtttctttcgctctagtaactgtagtttctatttttccatttcttagtaagtctgttactaagtttcttaacataagatttctgtgagcagttacacgtcctaatttacggtacttagccatgcttatccctcctttgcgcttactcttcgcttggtttaagatttaatccaagttcctctaacttttgaattacttcttctaacgactttttacctaagtttctaactttcatcatgtcttcttcagatctattagctaattcttcaactgtgtttattcccgctctctttaaacagttgtaagatctaactgataagtcaagttcttcgatagtcatctcaagaactttctctttttgatcttcttctttttctaccattatttcaacattgcttacatgctctgttaaatctatgaatagatttagatgttcaactagaaccttagctgcaagtgatattccttcttgaggatttatacttccattagtccaaacttcaagtattaatttatcataatctgatttttgaccaactctagtattttctacatggtagctaactttttcaacaggagtatatattgagtctacaggaagaactcctataggcatatgctctgttttattgtcttcagaagatacatatcctcttcctttatcaacagatatttccatgttaaacttagcattatcatctagcgtagctatatgtaagtctttgcttattatttcaacatctggaggacatattatgtcagcacctgttattgtacatggtccttgtgcttctattttaagtgttctatttccttcaccatctatagtagctgataattcttttaatgctaatattatttcagtaacatcttctttaacaccaggaactgttgagaattcatgaagaactccatctatttttatagagttaacagctactcctggtaaagaagataataatattcttcttaatgcattacctatagttattccatatcctctttctagaggctctataacgaatttaccatatctatggtcttcgctaatttcaattatatctactcttggtttttctatttctatcatggacaaaaccctccttaaaatttattaatccactgagggtaaacaaaatcttaaaatatttgttataactatacttattacttagagtaaagctctattattaagtgttcagctatttcaagatctatatcttctcttcctggattagcaacaacagaagctgtcatgttctctaagttagcatctaaccatttaggagctattcttgagttattttctactaatcctttgaattttgcagaagacttagatgtttctttaacagttataacatctccattagcaactgttaaagaaggtatatttaccttatgtccgtttaaagtgaaatgaccgtgtcttactaattgtctagcttcttttctagaagatgctaatcccattctgtaaactacgttatctaatcttctttctaataagcttagtaagttttcccctgttataccaggcattttttcagcacgctcgtataagtttctgaattgagtttctaaaactccgtatattctcttaactttttgtttttctcttaattgtaatccatagttagaaactttctttcttccttgtccatgttgtcctggagcatagtttctcttaactatagcacatttgtcagtataacatctgtcacctttaaggaataacttcattccttctctacgacattgtctacatgatgcacctgtatatcttgccatttatttacacctcctaaattacactcttcttctttttggtggtctacatccgttgtgtggtattggagtaacgtcttttatcatagttacttctaaaccagttgcttgtaaagctcttatagcagcttctctaccagaacctggtcctttaacgaatacttctacactctttaatccgtgttccattgcagccttagcagcagtttcagcagccatttgagatgcaaatggagttgcttttcttgatcctttgaatcctaattgtccagaacttgcccaagataatgcattaccgtgaacgtctgttaaagttattatagtattgttaaaagttgattgtatatgagcatgtccacgttctatgtttttacgctctcttcttctaacacgtgtaactttcttttttggtttagccattattcttccctcctcttctaactattacttcttcttcttacgagatacagtttttctaggaccttttctagttctagcgttagtcttagttttttgtcctcttaaaggaagacctttagcatgtctcatacctctgtaacactttatatctcttaatctctttatgtttaaagctatttctcttcttaaatctccttcaactaagaaatcattgtctattatctttcttaagtcgttaacttgatcttcagataaatctttgattcttacgttaggatctatgtcagctttagctaatatttcgttagcagttgccttacctataccatagatatatgttaagcctatttctgctcttttttctctaggtaaatctaccccagctattcttgccatactttgcacctcctacaacttaactttttaaacttttttcatgattaaattttcttaaataataagtgaattccgattcatgtttatataaaatccaaaaaaagtttgttaattatcacaatataatattatactataatatttaacaaaatgctagcacaatttattaaccttgcttttgcttgtgcttaggattttcacatataaccattactctaccttttctctttattactttacatttttcacatattggttttactgatggtcttactttcattattaatccctccttagactagcattgatagtctacttcttacgccaagtaattcttcctcttgtaaggtcatatggagaaagctcaacattaaccttatctccttcaagaatccttataaagttcattcttagctttccagaaatgtgacataaaacttcatgcccgttttctagtttaactttgaacatggcattcggtaaagcttctgaaactgtaccttctatttctataacatcttttttggccattaactaaccaaacctccattcaataagctaaacattgtttaactttccaagttcagctcttaaaaaagcatctttaatagactcattagattctatcatatctttaacagcattgttaattatatcatacttttgtaagtgcttaactttttttagtttaggtttttcaagttttcttttctttccatctgagattaaaacatactcatcatcaactacttttactacgaaaaataatctcccagtatctcttccagatgtatttctaacaacttgccctatacatatatcttttgatagcataaatctcacctactttttttgattataactttgttaatatcaaaggttcatcttcagtaatagctatcgtatgctcataatgagctgactttttagagtcaatagtaacaatcgtccaaccatcacctaacatcttaacatagtgtgtaccatagttaaccataggttcaattgcaagtaccatcccttctttaagttttggtcccttacctggtcgtccatagttaggtatttgaggatcttcatgtagctgtgtgccaactccatgacctacaagatctctaactactgaaaaattgtttttttctacgtgtgtttgtattgcgtgcgaaatatcagaaagtctatatcctagtttagcaaactttaatccttcatagaagctttcttttgttacttctattaatttcctatcttcttcagatattatacctactccatgcgtttttgccgagtctgcatgatatcctttataataagcacctatatcgatacttataatatctccttcttttaaagttttaggtccaggaattccatgtacaacctcttcattaatagaagcgcatatagatcccttaaaaccattatatcctttaaaagatgggatagcattatattttctaatatgattttcagctattttatctaactctaaagtagatattcccggtttaatagcatctcttaaaatctcatgtgtttcagcaacaattttaccagattctctcataagttcaatttgttgcttagattttaaaataatcattatttttcacttcctagagcatctactatatctgcaaataccttatctatagattgttcaccatttatattagctattataccttcttttgaataataatcaactaaaggcttagtttcgtctagataaacttgtattctctttgatacagtttcttcattatcatctgctctttggtaaagttctcctccgcatacatcgcatacgccatctgcttttggaggattaaactcaacatggtaagtagcaccgcaagatttacatattcttcttcctactgctctaccaactaatatatctttgtcaacttctatgttaactactttatctaaagatataccaacttcttttagatatttatctaaatgttgagcttgagctacatttcttgggaatccatctaacatgaatcctttttcgcagtctggttgagatattctatcagtaactagaccaactgttaattcatctggaactaaaagaccttgatctataaatcctttagcttttttaccaagttctgtaccttcttttatattctttctgaatatatctcctgttgatatatgaggtatattgtatttttctactattcctgctgcttgagtacccttacccgcaccaggaggtccaagtaatattattctcatatgatcatctccatctattttaagaagccttgataacttctcattactaagtttgattctaactgtctcttaagttcaagcgcaactccaacaactataagtaaagatgttccagccatacttaaatgtactcctgtgaatttacttattatagatggaattactgctacaacagctaagaataaagctcctgctaatgttaatctagataatattctatttaagtaatccatagttgggttacctggtcttatacctggtataaaacctccactatttttcatattattagttatatcttcagtattgaatgatatagtagtatagaaataagagaagaatattattaaaataacttctataactaaataaatccagaatcctggttctccactaggagataagaatttagttacaaatgcttgagcatcttttcccataaatattgctatagtttgagggaatgctaacaatgaacttgcaaatattactggtataactccagattgatttaccttcattggtatatgagagttttgacccccatatgtttttcttccaacaactcttttagcatattgtacaggtatttttcttgttgcttcttgtatataagtaaccgcagctactgtaagaagcgatactatagtcataacaactaatacccatagtccaatgcttccgcttttaaattgtcctatagcttgtgttatgtctgtaggaattcttgatataattcctataaatattattacagagcttccgttacctaatcctttttcagtaatcttatcacccatccacatcaatagcatactggctgatattaatgtgactataactgtaactataaaaaatacactatctgtttgtaaagcacgtctcactattcctagtgttataccgatagcctgtattatagctaatcctaatgctgtatacttagtgtatttatttatctttttcttaccttcttcaccagacttttgaagttcttcaagagatgggaatccgatagttaaaagttgaattattatagatgccgttatataaggactgattcctaatgcaaataaggtaaagctactgaaagctcctcctgtaaacatattatacagggaaagaagaccgtttccgtcaaccattccctttataatagttctattaactccaggaacaggaatagtacatcctatcctaaagataacaatcatcatcaaagtatataaaatttttcttcttacatcttttattttccaagcttgtttaaagtttgacagcacgttaaactcacccctgccttatggccaagagttagcagattagattaaactaattctgcctttcctccagctttttctattttttcttgtgctgaagcagtaaacttagcagcttttacagttaaagctctttctaagttaccttcacctaagattttaacgccgtctttttctattttgcttattactccagttgccttaagtaattcagctgttatttctgttccgttttcgaatctatttaaagtttctacgttaactagtgagtaaactttcttacaaggatttttgaatcctctcttaggaagtcttctagcaagtggcatttgtccaccttcgaatccaactcttactccaccacctgaacgagacttttgacctttttgtccacgtcctgaagttttaccttgtccagtagcagtacctctacctaatctctttttagatgaaactgcaccttcagcaggtcttaattcatgtaacttcatggattgcacctcccttagtatgtttaaaatttattattcagctatttcagttacttctactaagtgactaactttagctattatacctctcatttgagcgttgtcttctttaacaactacttgctctctttttcttaatcctaacgcttctacgttctttctttggttaggagtagttcctattgtacttctaactaattttatttgtaatttagccattctttactacctccttaccctagaagatcttctacttttttacctctaagtttagctatatcttcagctgttcttaaagattttaaaccttctattgtagcatttaccatgtttcttgggttgttagttcctaaagatttagctctaacatcctttaatccagctaactcaagtacggctctagcaggtcccccagctataactcctgtaccttgactagcaggcattattaatattttaccagcaccaaagtgtccgtttgtttggtgaggtatagttgtaccaaccataggtacagttattaaattcttcttagcatcttcaactgcttttcttatagcatctggtacttccatagctttaccagtacctataccaacgtgtccgttttcatctccaacaactactaaagctgcaaatctaaagtttctaccacctttaacaaccttagtaacacgtcttacttcgataactttctcttgaagatcaagttgtcttgcatctattggcttacgacgtagcattattttccctcctttgtattagaacttaagtccagcttctctagcaccttcagctaattcttgaactcttccgtgatataagtatccacctctgtcaaatacaacttcagttatacctttttctacagctctcttagcaacaagttctccaacttttctagctgcatctttatttccacagtgattaacagcaccttttatttcagcttctaaagaagatgcagaaacaacagttactctgttagtatcatctattatttgagcatatatgttattagaacttctgaatacacataatcttggtctttgagtagttccagttatttttctacgaactctcttatgtctttgaagtctatttgcgtttttgttagcttttttaaacacagagatcactcctttctagcgtttatcttttggtattatttcttaccagttttaccttctttacgtcttacaacttcaccagcgtatcttatacctttacctttgtatggctctggctctctccaagctcttatcttagcagcatagttacctactaattgcttgtctatacctttaacaactaattcagtttggtttggagcttcaacagttattccttctggatctaccatctcaactggatgagagaatcctaagttcataactaacttgtttccttgcttttgagctctgtacccaacaccaactaactctaacttcttctcgaaaccagcagtaacacctactaccatgttatctattaaagttctagttaatccgtgtaaagatctatgtttcttattattagttggtctctcaactaatatagtattctcttctttttttatagctaattcattgttgaattgcttagttaaagttccttttggtccttttactgtaactaagttgttttcagctatagttacttcaacacctgcaggaacagttattggtttaacacctattcttgacatagttgcacctccttacattgttcgtttttattaccaaacgtagcagattacttctccaccaacgccttcatttctagcttgcttgtcagttaatattccttttgaagtagatattattgatatacctaatccgtttaatacttttggtaattcttctttagcagcgtaaactctcataccaggcttagatattctctttaatcctgttataactttctctcctgcttgtccgtactttaattgtattcttattattccttgctttccatcttctataacatcgtaccctcttatgaaaccttcttctaataagattctagctaattctttcttcatattagaagcaggaacatcaacagtttcatgcttaactgtgttagcatttcttatacgagttagcatatctgctattggatctgtcattgtcatattgtaaccctccttccattttaaccaagtcttaccaacttgcttttcttacaccaggtatttgacctttataagctaattctctaaagcatatacggcatataccgaattttcttaatacagaatgtggtctaccacatattgtacatctagtatactctctagttgcgtacttttgctttttttgttgttttacaaccatcgcttttctagccactggaatccctcctttatttacttagaatatggcattcctaataattttaataactcactagcttcttcatcagttttagctgtagttacaaatattacatccattcctcttactttatcaactttatcgtactctatttcagggaatataaattgttcttttaatcctaaagcgtagttacctcttccgtcaaatgcgttagcattaactcctctgaagtctctaactcttggtaaagatatattaactaacttgtccatgaagtagtacattttgtcagctcttaaagtaactttagttccaacaggcataccttctcttaatttgaagttagctactgattttctagccttagttataacaggcttttgaccagatatcatttctaattctgcaactgcagcttctaatccttttggattttctcttgcatcacctatacccatgtttattactattttctctaacttaggtatttccataacgtttttgtatccaaatttctccattaaagctggagcaacttctttaacatatttttcttgtaatctagaagtcatttgtagtccctcctttcaagcttattataattcttttccgctctttactgatactctaacttttttcccatctttaacttcaaatctaactcttgtaccttttcctgtttcaggatcaactggcattacgttagatatgtgtattggggcttctttatttattattccaccttgtgggttaacagcagttggtttttggtgcttagttattacgttaacaccttcaactaatactctattagctttagtgaaaaccttagtaactgtaccttttttacctttatctttacctgctataactacaacagtgtcaccttttttaacacgcatcatgtcctattgcacctccttattatagtacttctggagcaagagatactattttcataaagtcgttgtctcttaactctctagcaacaggcccgaatatacgagttcctactggagttttatcatcttttatgataactgcagcattctcgtcaaatgatatataactaccatctttacgtcttacgccttgcttagttcttactataacagctttaactactttacctttttttacaactccacctggtgttgcacttttaacagttgcaactataacgtcacctatgttaccatatcttcttttacttccgcctaatacacgaatagttaaaagttctttagctcctgagttatcagcaactcttagacgtgattcttgttgtatcatatcgtaatccctccttcttcaaaaactacttaaccttctctataacgtcaactagtctgaatctcttatccttagataaaggtctagtttccattattcttactctatctccgatgctacatacgttgttttcatcgtgagccttaaatttcttagttctcttaactggcttgttatataatggatgacgtacgaaatcttcaacagaaacaactattgttttatccattttattactaacaacacggcctactcttacttttcttcttcctctttccatgtttgacagcctcctttccaaaattaagctctagtttcgtttaactttctttcagcaagtatagttttaactctagctatatctttcttaacgaatttgattcttgctgtgttttctaattgaccagtagctaattggaatcttaagctaaataattcacttttaaaaccatttaacttgttcattaattcttcgcttgttaaatctcttagttctttagctttcatcctattcaccaccctttacttctaaatcttcacgcttcacaaacttacatttaactggaagtttatgcatcgcaagtctcattgcttctctagctttatcttcagaaacacctgctaattcgaacattactcttcctggttttactactgctacccagtattctggtgaacctttaccagcacccatacgagtttctgcaggttttcttgttactggtttatgagggaatatctttatccaaacttttccccctctttttatatatctagtcatagctattctggcagcttctatttggttagaagttatccaagatggctctaaagcaactaaaccgaactctccgtaagtaactttgttacctttgtgagcttttccagctaagctacctctgtgtactctacgacgttttactctttttggcattaacatgagtattttcctccttccttaactgtgctttaattaagcttgtttgttttcagttctttgaggtctttgtcctctgttgtttcttctgttgttgtctcttctatcgtttcttctatcgtttcttctgttatctcttctatctcttctgttgttatctcttctatcttctcttggatttacaccgtttctagttggtaaaacttctccgttgcatatccaaactttgataccagtttttccataagtagtatttgcttcagcaaatccaaactctatgtcagatcttatagtttgaagaggtacatttccttcgctgtatccttcagttctagccatttcagctccacctaatctaccagaagcagatacctttatacctttaactcctgacttcatagctctttgtatagcttgcttcatagctcttctgaaagcaacccttctttctatagctaaagctatattttctgctactaattgagcatctttatctgggtttctaacttctactatgttaactataacatttttcttagtcattttttctaactcagctttaagagcttctattccagctccacctttacctataactacacctggcttagcaacgtgtaagtctagctttaatttgtttgctgatctttctatttctattttagcaacaccagctgagtataatttattctttaagaatttacgtacattatggtcttctaataataagtttccgaactcttttttatcagtagcgaaccatcttgagtcccagtcctttataacaccgactcttaaaccgtgtggattaaccttttgacccatttgtttccctcctatctgttattattttctttctttaagaactacctctatgtgagaagttctctttcttatcatagttgcacgacccatagctctaggcatgaatctcttcatagttggcccttgattagcaactattgaagctatatataatttttcaacatccatttcgtgattgttttctgcattagcttttgctgactttacaaccttagctattattgaagcagctcctcttggagtgtactttaatattgctaaagcttcgtcaacattctttcctctaacaaggccgcatatttgacctgcttttctaggtgatacacgtacgtatttagcagtagcttttgcttccattacaaattcctccttcctcagttagatcttaattattttctcttattagatttttcgtcgtccttgtgccctttgaaagttcttgtaggaacgaattcacctaatttgtgtccaaccatatcttctgttatataaactggcacatgctttcttccatcatgtacagctattgtatgttcaaccatttgtgggaatatagttgaagatcttgaccaagtttttataacttctttatttccagaagcgttcatatcttctatcttctttaaaagtcttgcatgtataaaaggtccttttttagttgatcttgacattttatttcctcctttcgagcaaaagtaaatctattacttagttcttcttgatactattaacttatcagaagctttatttttctttctagttttgtatccaagtgctggtttaccccaaggagtaactggattagctctacctattggagatctaccttcccctccaccgtgtggatggtcacaagggttcattacagaacctctaactgtaggtcttatacccatatgtctttttctaccagctttacctataacaacattaccgtgttctaagtttccaacttgtcctatagtagctttacagtttatgcttactaatctcatctctccagatggtaatcttaataatgcatttttaccttctttagccattaattgagcagatgctccagcagatctaactaactgagctccttttcctggctttaattctacgttgtgtactactgtaccaactggcatatcttttaatgccattgcgttacctggctttatgtctgcttcaggtcctgataataaagtatctccaacttgtattccaactggagctaatatatatctcttttcaccatcagcatagtttaataatgctatgttagcagttctatttggatcatactcaacagtagcaacttttgcaggtattccatctttatttctcttgaaatctattattctatattttcttctgtttcctccacctctgtgacgaacagttattttaccatgtacgtttctaccagaatttttctttaatgaaactaaaagagatttttctggttcgttacaagttatttcatcagaaactaaaactgtcatttgtcttaaggcaggagaagttggtctaaacttttttatagccatctgttttccctccttcgtttattaaggtcaattacataccttggaagaattctatttctttgctatcagcagctaatttaactactgctttcttgaaacttgcagttcttccttcgtatctacccattctcttaacttttccatcgtagtttaaagtatttactctgtcaactttaactccgaatatgctttctacagctttctttatttcagttttgtttgcgcttttagcaacaacaaaagtatatttcttttcaaccatttcagtcatactttgctcagttacaactggctttattattatatcatgtggattagtcattatgcgtacacctcctccactttcttaaccgcatctgtagttattacgaaagtatcgtactttaatatgtcataaacatttatagtgttaactgtagcagcttgaacaccttctatgtttctagctgactttacaacgttctcgtctttttcagctgttactactaaagctttcttagaagcgtttatgttctttaatatttgagcgaactctttagtttttggagcttccatagttaaagcatctaaaactattatttcgttattttgaactttagatgataaagctgatttcatagctaatcttctaactttctttggtaaagtgtatctgtagtttcttggcttaggtgcaaaagcaactcctccaccaacccattgtacagctcttatagaaccttgtctagctctaccagttcctttttgtttccaaggttttcttccgccacctctaacttctgctctagttttagcagattgagtaccttgtctcttgtttgctaattgatttttaactacttcgtataatacgtgctcgttaacttcaacaccgaatatagcttctgctaattcgatttctccaacattttgtccattaacatttaatatatttaattttggcattgtgcttcctcctttcttaggttagttattatttagaagcctttactgcttcttttatagttactattgaacctttagctcctggtatagcacctttaactaatataaggttcttttcagcatctactctaactacttctaagttttgaacagttactgtaacgctacccatgtgaccagctagttttttgtttttgaaaactctacctgggaaagaacatgctcccattgaacctggtcttctgtggtatctagaaccgtgagattcaggacctctagattgtccatgtctctttataggaccttggaatcccttacctttacttgttccagtaacatctattacttctccagctgcaaatatatcagcttttatttcttgtcctactgagaactcttcaacagaatccattctgaattcttttaagtgtttctttaatacgttagcagcagcaagatgtcctttttgaggcttgtttaaagatttctctttagcatctacaaaacctacttgaactgcattgtatccttctttttctgttgtttttatttgagtaaccactactggtccagcttcaacaacagttacaggtactacattccctgcttcagtgaatatttgagtcattcctaacttcttacctaatattcctttcatatcgcacctcctataatcttacagcggattatgttttatcataatcattctaagatagttgccttataggatcgtatcttagaggcttatcttataactttatttctatatcaacaccagctggtaagtctaacttcattaatgagtcaactgtcttaggtgttgggtttgctatgtctattaatctcttgtgagttcttatttcgaattgctctctagagtccttatacttgtgtacagctcttaatatagttacaacttgcttttcagttggtagtggcacaggtcctgaaacttgtgatccagcttttttagcagtttcaactattttcccagctgaaaaatctaataatttgtgatcatatgactttaatcttattcttatttttccattgttagccattttagtttccctcctttatcgtacgtttaatttttttagttacgcacgactgataccgatacacagttccgggtgtgttgtgttttttatcaaatcggcatctcgtcgcctatctctaggatattactttacttttccttacatttcgcatctctcaagcacactattatattttatattattttttactgtttttcaagttttttttataattttacaaaatattttttgtatgtaaatcttactacaaaacttgtgttgagaatcttaacgggtactaggttagtatatcttttttaagtacgtttgtcaacaagttttatccttccaatgtttagttaaatatttttctttatataaatatctcctataagctttttacaaataaaaaagagaaagatgaatttcatctttctctttatttatattaggaataagagaattactctattatagaagcaacaacacctgatgctactgttcttccaccttctcttattgcgaatcttaatccttcttctattgctattgagtttattaactctatagtcatttggatgttatctccaggcataaccatttcagttccttctggtaacttacaagctcctgttacgtcagttgttctgaagtagaattgtggtctatatccatcgaagaatggagtatgtcttccaccttcttctttctttaatacgtatacttctgcattgaacttagtgtgaggcttaacagttcctggcttagctaaaacttgtcctctttctatttcatttctttgtatacctcttattaatgctcctatgttatctccagcttgtgcttggtctaataactttctgaacatttctactcctgttactactaactttcttggctcgtcagctaatccaactaactcaacttcgtcttgtacttttaatactcctctttcaactcttcctgtagcaactgttcctcttcctgttatagagaatacgtcttctactggcattaagaagtctttatctacatctctctctggagctggtatatattcgtctatttgctcgaataattcaactattctgtctccccactctgaagaagaatcttgtaatgccattaaagcagatcctcttactattggagtgtcatctcctgggaattcgtactcgtttaataagtctctaacttccatttcaactaactctaataattcttcgtcgtctaccatatcacatttgtttaagaatactactatgtatggtacaccaacttgtcttgataataatatatgctctcttgtttgaggcattggtccatctgttgctgaacatactaatatagcaccgtccatttgagcagcacctgttatcatgttcttaacgtagtcagcgtgtcctgggcagtcaacgtgagcgtagtgtctgtttggagtttcgtattcaacgtgtgcagttgatattgtgattcctctttctctttcttctggagctttatctatgttagcgaaatctactgcttctcctaattgatatctatcgtataatgtttttgttatagctgcagttaatgtagttttaccgtggtcaacgtgacctattgttcctatattaacgtgtggcttatttctttcaaatttagctttagccattttgaattcctccctttaatattggtttattttgtgtaagacgaggaattcctcgtcttacttatttattatatacaaaattaattaaaattaattaattatttaccttcagctattttcttagcaactgaagctggaacttgctcatagtggtcgaatatcatagtgtatgttgcacgaccttgagtagttgatcttaactctgtagagtatccaaacatttcagaaagtggaacgaatgcatttataacttgtgcaccagatctagcttccataccttggattaatcctctcttagagtttaatccacccataacgtctcccatgtattcttctggagtaacaacttcaactttgaagtatggctcaagtaatacagcattacctttcttaagagcgtccttcatagccattgatcctgccatcttgaatgccatttctgaagagtcaacctcatggtaagaaccatcgtataactcaacagcaacgtcaacaactgggtatccagcaactatacctgaagccatagctccttgtatacctgcatcagttggtccaacgtactcttttggtacagatccaccaacagttttgttttcaaacttgtaaccagcacctggatcttgaggagtaactctgatcttaacgtgaccgtattgtcctctacctcctgattgcttagagtacttgtactcaacgtcaactggttgagttatagtttctctgtaagcaacttgtggagcaccaacgttagcttcaactttgaattctcttaataatctatctactattatctctaagtgtaattcacccataccagatattatagtttgtcctgtttcttcatcagtcttaactctgaaagttggatcctcttcagctaatttttgaagagctatacccattttttcttgagcagcttttgatttaggctctatagcaacagatataactggctctgggaattccatagattcaagtattattggagcagctggatcacataaagtatctccagtagtagtatcttttaatcctactgctgcagctatatctccagcatatacttctgttatttcttctcttgtgttagcatgcatttgtagtatacgacctattctctctctcttaccttttgtagagttaagaacataagatccaccttgcattattcctgagtaaactctgaagaatgctaacttaccaacgaatgggtcagtcattattttgaatgctaaagctgagaatggctcttcatcagatgaatgtctttcagcttcctctccgttttctaatataccttttatagctggtatatcagttggagctggtaagtagtctataacagcatctagtaataattgaacacctttatttctgtaagcagatccacagaatactggattcatttcacaagctattgtagcctttcttatagcaacttttaattcttctatagttggctcttcaccttcaagatatttcatcattagatcttcgtcagtttcagctactgcttcaaccattttttctctccactcttgagctaattctttcatatcttcaggtatttcagttatttctatttcttttcctaagtcgtctttatagatatgagctttcatttctaataagtcaacttcaccttctaaccaatcttctttacctattggtaattgcattggtactgcatttgcatttaatctttctttcatcatttctacaacattgtagaagtctgcacccatgatgtccattttgtttacaaatgctattctaggtacaccgtagttgtcagcttgtctccatacgttctcagattgaggctcaaccccacctttagcacagaatacagcaacagatccgtcaagaactcttagagatctttcaacctcaactgtaaagtcgacgtgtcctggtgtatctattatgtttattctatggtctttccatgcagcagtagtagcagcagaagttattgttatacctctctccttctcttgctccatccagtccatttgagaagctccttcatgagtttctcctattttatgagtttgccctgtatagaataagattctttctgtagtagtagttttcccagcatctatatgagccatgattcctatatttctagttctttctaaaggaaactttctagacatgattctcctccttacgatatccttttaataggatatcaaatatatcctattattagaatctgtagtgagcaaatgctttattagcctctgccattttatgagtatcttctttcttcttaacagaagctcctgtattgttagcagcatccattatttctttagctagcttttcaaccatacctttttcaccacgagctctagtatagtttactaaccatcttaaacctaaagtttgtcttctttcaggtctaacttcaactggaacttggtagttagctccaccaactcttctagctttaacttctaaaacaggcattatgttgttcatagctgtttcgaaaacttctaaagcattttctccagttttttcagcgatcatctcgaaagcatcatatactatcttttgagattttcctttttttccatctatcattaaattgtttattaacttagttactaccttacttccgtatactggatctggtaaaacttctctctttggaacattaccttttcttggcattttgcttccctccttaattatttaatcttaaatcataggtactcgacattcaataaaatgccgtgatgccataaatatatatatatttaaagcaccgaactataattgatttttaattgcttatttctttgcagctttaggtctcttagcaccgtacttagatctagcttgcattctcttatcaacaccagctgtatctaatgtacctcttaatatgtggtatctaacccctggaaggtctttaactcttcctcctcttataagaacaacactatgctcttgtaagttgtgtccttctcctggtatataagcagaaacttctataccgttagttaatctaactctggcaacttttcttaaagctgagttaggtttcttaggagtaaatgttttaactgaagtacaaactcctcttttttgtggagcactagcatcagttgatttcttgtgtaaagaatcgtatcctttttgtaatgctggagcagtagattttttttctatcgcttttcttttcttacgaactaattggttaattgttggcatcatctgcacctccttccaaaattttcgatcttaaaaatgaccgccaactacatcaatatgagcacatattgatatcatatgtagcttaagctacatcgcaataaatgtctataacacacaattgtggttttagcacttttagtttggtgcatattattatgctttttaaagtaaaaataaagtatattttaaatattactaagggttttgaccccttagtaatatttgatatctttattttacatacctttacattttagcatcagagatgctttatgtcaagttatgtttaatttatatagtaaagtaaaattactcttctatcttttcaacagctatatttttatatctcttcattcctgtacctgctggtattaacttacctattataacattttctttaagacctattaagtgatcttcttttccttttatagcagcttctgttaatactcttgtagtttcttggaatgatgcagctgataagaatgattctgttgcaagagatgccttagttataccaagtaatactctagtagctgatgcaggctttaatccttgagctatagcttcttcattagtttggttgaatgtaagaacatcttcatatcctcctggtaataaatctgtatcacctggatcttcaactttaactttagatagcatttgtctaacaattacttctatatgtttatcgttgatgtcaaccccttgcattctataaactctttgaacctctttaacaacataatcttgaacaccttcaatacctttaactcttactatgtcatgaggatttatagatccttgagttaaagcctctccagcttcaacaaattgtccattcttaactcttaatcttgaaccataaggtatagcatatacttgtgattcaccttgttctggaattacagtaacttcttttctcttaccagtctcatctatttctattctacctgatatttcagttatagtagcaagaccttttggttttctagcttcaaataattcctcaacccttggaagaccttgtgttatatctcctccggcaaccccacctgtatggaaagtacgcattgtaagctgtgtacctggttcaccgattgattgagcagctattataccaacagcttctccgatatttacttctttaccagtagctaagtttctaccgtaacacttagaacatactccatggttagttttacagttaagaactgttcttattttaactatctcgattccagcttctataattttttcagcttgatcttcttgtatcattgcatcagcttcaactattacttcaccagtagtaggatgtactatagcttctaaagtatatcttcctactattctatcgtatagttcttctataacttcatttccatcttttattgcaaagatttctgtatcttctgtagttccacagtctatatctctaactataacatcttgactgacatcaacaagtcttcttgttaagtatcctgagtcagctgtacgtagagctgtatcggcaagaccctttctagcaccgtgtgaagatgtgaagtattcaagtactgataaaccttcacggaagttagatttaactgggatttcaactgtttgcccagatgcattggccatcagaccacgcatacctgctaactgtcttatctggttcttagaacctctggctccagagtgagccattatgaatatattgtttaatctgtctagattagccataagagcatctgtaactttttcagtagtttctgtccaagtttctattactctttcatatctttcttcatcagatataagacctcttctaaacgccttttcatacttatcaactttagcttcagcctcagctaagtaacctttcttagcttctggtattttcatatctgcaacggcaacagttataccacctcttgtagagtatttaaatcctaaagattttatatggtctaacatttgagctgttactgtatttccatgctttctgaagcatttatctattatcttacctaaagactttttatcagctaagaaatctacttcaagtgcaaatttatctttttctctgtcaacaaatcctaagtcttgaggaatattttcattgaatataaatctaccaacagtagcttcaactaatttagttccaacaccttcaatagttcttcttactttaactaatgaatgtaatgtaactgctttattgtcataagcaagcatcatttcattgtagtctttaaagatcattccagtacctttagcaccttcttgagcttctatagttaggtaataacatcctaaaaccatatcctgagaaggagtagttataggtgaaccgtctttaggagcaagtatgttatttatagataacattaagaatcttgcttcagcttgagcttcaacagataatggtacgtgtaccgccatttggtcaccgtcgaagtcagcgttgtatgctgtacatactagagggtgtagctttatagctttaccttcaactaaaactggttcaaatgcttgtatacctagtctgtgtagagtcggagcacggttaagcattactggatgtccttttataacatcttctaatacatcccatacttctggtttaactttctctactatagattttgcactctttatgttgtgtgcatatccttctttaactaatctatccataacaaatggtttgaataattcaagagccattttctttggaagaccacattgatagaatttaagttctggccctacaactataacagaacgtcctgaatagtcaacacgcttaccaagtaagttttgacggaaacgtccttgcttacctttaagcatatctgataatgattttaatggtctattaccaggtccagttactggtctacctcttctaccattgtcgattaaagcatctacagcctcttgaagcattcttttttcgtttcttactattatatcaggagctccaagctctaataatctctttaatctgttatttctatttataactcttctgtataagtcatttaaatcagatgtagcaaatcttcctccatctaattgaaccattggtcttaaatcaggtggtataactggaattgcatctaatatcatccattctggcttatttccagatttcttaaatgcttctacaacttctaatcttcttatagttctaactcttttttgacctgtactgtcttttaagtcagctcttaattctttactttgttgctctaagtctatattttgtaaaagtttcttaacagcttcagcacccatacctacttcgaaagtattgtatccatacttttctacagcagttctgtattctttttctgttaataattgtttttcgtttaatccagtttctcctggattagttactacataagatgcaaaatatagtattttttctaatgatctaggagacatatcaagtaaaagtcccattctacttggtatacctttgaagtaccagatatgagacataggagctgctagctctatatgtcccattctttctcttcttacctttgccttagttacttctactccacatctatcacaaacaacacctttgtatcttactcttctgtacttaccacagtgacactcccagtccttttgaggtccaaatattctttcacagaaaagaccatctttctctggcttaagtgtacggtagtttattgtttctggcttttttacttctcctctagaccattgtcttattttttctggagaagccaatgctatttttattgactcgaaattgtttagttcaaacaaggagttctctcccttctatttgagatttacttaaaataagaaactatatatcaaagtcttcatcttcatagtttaattcttcataaactacgtcttcttcaaaatctaattcttctatatcttcttcatttgattcaaagtcatctatttcttctactatgctattttcttcaagttcatttatgttttccataacatctaattcgaactctttagcatcttcgtcgatgtctattgattctctaacttctatttcttgatcttcttctgttaatacttttacatctaagcataaactttgaagttcttttattagaaccttaaatgattctggtatacctggttcaggtatattctcacctttaactatagcttcgtaagttctaacacgtcctacaacgtcgtcagacttaacagtaagtatttcttgaagtatgtgtgcagcaccgtatgcttctagtgcccaaacctccatctctccgaatctctgaccaccaaattgtgctttaccaccaagaggttgttgagttactaaagagtatggtcctgtacttcttgcatgtaacttatcatcaactaagtgatgtagttttaacatgtacatgtatcctactgtaattctattgtcaaatacttctccagttctaccatcatataaagttaatttaccatcttctgggtatcctgctttaactaaagcttctctgatgttttcttctttcgctccatcaaatacagatgttgcaacatgccatcctaaagttttagctgcaagccctaagtgaacttcaagaacctgtccgatgttcatacgtgatggtataccttgtgggttaagtactatatcaagtggttgtccgttttccatgaatggcatatcttcttctggtaatactcttgatataacccctttgttaccatgacgtccggccattttatctccgactcttatctttctcttcttagctatataacatctaactaattcattaactcctggagataaatcatcaccattttctctagtgaatacttttacgtcaactattataccagattctccatgaggaacttttaatgaagtatctctaacttctctagctttttctccgaatattgcacgaagtaatctttcctctgctgtaagttcagtttctcccttaggagttactttacctactaatatgtctccagaatcaacttcagcacctattctgattatacctctttcgtctaagttcttagtagcactttctccaacgttaggtatatctctagttatttcctctggtcctagtttagtatctcttgcttcacattcatattcttctatatgaattgtagataatctatcttctttaacaagtctttcgtttattaatatagcatcctcgtagttatatccttcccatgtcatgaatgcgataaagcagtttcttcctaatgctacttctcccatttcagtagatggtccatcagctataacatctccagcttcaatcttatcacctttatttattataggtgtttgatttatacaagtaccttggttagaacgcttaaacttaagaagcttgtatctatctttgtttccatcttctctttttattattatttcatctgcagttactctttcagctataccagaatttttagctactacaactactccagagtctttagctgctctatattcaacacctgtacctatgataggtgcttctcttcttactagtggcactgcttgacgttgcatgtttgatcccataagtgcacggttggcgtcatcattctctaagaatggtatcatagctgttgctatagatacaacttgcttaggagatatatccatgtaatcaactttgtcagttggaactaattccattgcaccatttacagttctacatacaactctgttatttacgaatgcatcattctcatctaaaggctcgttagcttgagctcttataaataagtcttcttcgtcagcagttaagtaatgtatttcatctgtaactctcttgttttctttgtcaacttttctataaggagactctataaatccaaattcatttatcttagcataagttcctaaagagtttataagaccgatgtttggtccctctggagtctctatcggacacattcttccgtagtgagaatggtgaacgtcacgaacttcgaatccagctctttctcttgaaagaccccctggtccaagtgctgataatcttcttttgtgagttaactctgatagtgggtttgtttgatccatgaattgtgataactgtgaactaccaaagaactcttttatagcagctgacacaggtcttatgtttactaatgcttgtggagttatagcttccatgtcttgaacagtcattctttcttttataactctttccattcttgaaagacctattctaacttggttttgtaataattcaccaactgatcttattcttctgtttcctaaatgatctatatcatctatactacctattccatagaatatattgaattggtagcttattgaagctattatgtcatctagtaatatgtgctttggtataagctctttcattcttgattttatagcttcttttatttcttcttcatcactatactcatctaaaatttcttttaatgttggatagtgaactttttcttttatctttaagtcatctatatcaaagcttatatgtgattttatatctacaaagttatttcctataactttaacaactttttcatcttcagttaataactcaacaacatttattcctgagttttgtatagctattgctacatctaaagatatcttttcttcagctttaacaaaaacttctccagtttctggatttataatatcattagctgatattttattcattattctgtagcataatgcaagttttttattaaacttgtatctaccaactttagctaagtcatatctcttagcatcaaagaataatgcatttaataatgatgatgcactttcaactgttggtggttcacctggtcttaattttttgtatatttctataagaccttcttcaactgttttagtgttatctttttctaatgtagccattagtctttcatcttcgcctaataactctattatttctgcatctgaacctattccaaatgctcttaataagactgtcacaggttgttttctagttctatcaacccttacagatattacatcattagaatctgtttcgtattctaaccatgcacctctgttaggtataacagtagatgatataagtcttttacctgacttatccatttcttgagcatagtaaacaccaggagatctaactaactgacttactataactctttctgctccatttattatgaaagttcccttttctgtcattaaagggaaatcacccataaatacttcctgctcttttatttcacctgtttctttatttataagtcttactttaacttttagaggtgcacaatatgtagcatctctttctttacattcttctatgtcatactttggtttctcatctaaagaataatcaacaaattctaatataagattacctgtataatcttctataggtgaaatgtcttcaaacacttcttttaaaccttcttttaaaaaccactcataggaatcacattgtatttctataagatttggtacatcagctatctcttttatttttgagtagctcattctagttctcttacctatcgtgacaggatgtggcattcacttttcacctctcaataattaaaaataaaaccatagtttattctaacgcatctaataattttaacataattgaaagcttatttcaatatataacttttatgtatatgtataatattatgtttttttgttcgacataaaatatgcattatttattatgttcaaaaattaagtctctaattcttatttttctaaaatatacagttattttttgtaatttagaaaaaaaaaagatgtcctttggacatcttctttaaaagaaaactacttaacttctactgaagctccagcagcttctaatttttctttcatttggtcagcttcttctttagaaactccttcttttaatgtcttaggagcgttgtcaactaattctttagcttcttttaatcctaatccagttatttctctaactgcttttataactccaacttttgaagaaccagcgtttgctaatactacatcaaactcagttttttcttcagcagctccaccagcaactgcaccagccatcataactggagctgaagcagatactccgaatttctcttctgcagctttaactaattcatttaattctaaaactttcatattttctatagcttctaatatttgttctattgtcattgttagcacctccgaattatattcttttcaattaataattgttaattaatcttttttcttacgtttaagctattattaagcttcttgtccttcttgttttttgatcattgcatctaataagtatgcgaagtttgacattggagcttttaagcttccaagtaattttgcaagaagtacttctcttgatggtatgttagcgaatgcaacgatatcttctttaccgtagaattctccttcaacaacacccatttttaaatccatattaggatgagaatccatgaactcttttattattctagctggagcaactggatcttcgtatccgaatgctatcgcatttgttcctactaataattcatcgttgaattgttctataccaacttctttagctgcttttctaactaaagtgtttttgtatactttgtattcaacaccagcttctctcattttctttcttaattcagttacttcttcaactgttaatcctttgtaatcaacaactatagcagaagaagagttttgtaacttctcaactatttcagcaaccacttgtgattttacttctatagcttttctcatctagtcagcacctccttcatccgataggttcatctgccgtaaatatcaaaagcttttgcaatccttatagacatacaaaagctttagtatcaaaatttatctaaaacctcggtaggatattaagcttaaagcccctactgtctacggcaaatctattcttttttatttattaacgaatattattttaacatcgttatttacacatgtcaagctttttattattcagctattttagcagggttaactttaactcctggtcccatagttgaagtaacagctacgctctttaagtattgtcctttagcagcagctggcttagctttaactatagcatccattaatgcagcaaagttttcagttaacttttctccaccgaaagatacttttccaaccggaacgtgtattatgttagttttgtctaatctatattcaactttaccagcttttatttcttctatagccttagctacgtcgaaagtaactgttcctgatttagggtttggcattaaacctttaggtcctaatactctacctaatctaccaactacacccatcatatctggagtagcaacaactacatcaaattcaaaccagttttcaccttgtattttttgtactaattcttcagcacctacaaagtcagcaccagcatttgtagcttcttcagcttttgcacctttagcaaaaactaaaactctcttagttttaccagttccgtgtggtaatacaaccgcacctcttacttgttggtcagcgtgtcttgagtcaacacctaattttatatgagcttctacagtctcatcaaacttagcactagcaacttctgcaactaaagctaaagcttctgaagcatcatataatctagttctatctattttatttaaagcttctacgtactttttaccttttttagccattttcatgtcctccttgtggttatattggttttttacctcccactttttcaagcgaagataactaatttaatattaattagtcttcaacaacgatacccatacttctagcagtaccagctatcattctcatagcagattctacagaagcagcgtttaagtcaggcatttttaactcagctatttctcttatcttagctgaagataaagttgcaaccttcttcttgtttggttctcctgaagcagtatctaatccagcagctttctttaataatactgcagctggaggagtttttgttatgaagctgaaagatctatcttgatatacagttataacaactggtattatcattccagcttgatctgcagtcttagcattgaattccttagtgaatcccattatattaaccccgtgttgtcctaatgctggcccaactggtggagctggtgtagctttacctgcaggtatttgtaattttatttgacctataacttttttagccattgagcgcacctcctcagattatttattctctagttatatttttctatgcctttgtagtctattgcaaatagagtttttttaccaaaagcatctatacacacttttacttcttttgtttccaggtctatttcttctatagttcctatttgaccttcaaaaggaccattagcaacttttattacttcgccaatttcaaaatttatgtctccgcttactaatttaggaacagctgtatctatgcccatagctattacttcttcttcacttaaaggaactggcttagaacctggtcctacaaacccagtaacccctttagtatttcttacgacataccaagattcatcggtaataaccattttcactagcacgtaccctggaaataccttacgttgtctagttttttctttcccagtttttgtagtctcaactacatcttcagtagggacaactacttgagttatgcaatcttccatacctcttgttttaacagctttttcaattgttgctttaactttattttcatgacctgaataagtatgtactacataccatctagcctcttgtaattccgacattctgattcttcctttctattttagtattagatttagtgcaccagataatacactatctaaagcccatactaagatagtagccgaaacaacaacagttaaaacaactcctgtgttttttaaaagctctttctttgttggccacgtaactctttttaattcttgcttagtttctttaacatatctaaaaaaactaaacttttttttagttcttggactttcatttaattgggcagccattccacactcacatccttaataaaactattttgtttctttatgagcagtatgcttcttgcagaatctacagtatttttgtagttctattctatctgggttattctttttgtttttagtagtgttgtagtttctttgcttacactctgtacatgctaaagttactttaactctcatctgctacacctccaactcgtaaatacaatatatatattgttaactttattgcctactctgtataataggttcaatatctcatttttgaatcatcacctcatataaattatcacaaattagtaggcatgtcaatgtttttgttgatttcaagttaaaaaaagaggaggttatccccctcttttttttagttttaaaatttatattaggaataagagaattactctattatagaagcaacaacacctgatgctactgttcttccaccttctcttattgcgaatcttaatccttcttctattgctattgagtttattaactctatagtcatttggatgttatctccaggcataaccatttcagttccttctggtaacttacaagctcctgttacgtcagttgttctgaagtagaattgtggtctatatccatcgaagaatggagtatgtcttccaccttcttctttctttaatacgtatacttctgcattgaacttagtgtgaggcttaacagttcctggcttagctaaaacttgtcctctttctatttcatttctttgtatacctcttattaatgctcctatgttatctccagcttgtgcttggtctaataactttctgaacatttctactcctgttactactaactttcttggctcgtcagctaatccaactaactcaacttcgtcttgtacttttaatactcctctttcaactcttcctgtagcaactgttcctcttcctgttatagagaatacgtcttctactggcattaagaagtctttatctacatctctctctggagctggtatatattcgtctatttgctcgaataattcaactattctgtctccccactctgaagaagaatcttgtaatgccattaaagcagatcctcttactattggagtgtcatctcctgggaattcgtactcgtttaataagtctctaacttccatttcaactaactctaataattcttcgtcgtctaccatatcacatttgtttaagaatactactatgtatggtacaccaacttgtcttgataataatatatgctctcttgtttgaggcattggtccatctgttgctgaacatactaatatagcaccgtccatttgagcagcacctgttatcatgttcttaacgtagtcagcgtgtcctgggcagtcaacgtgagcgtagtgtctgtttggagtttcgtattcaacgtgtgcagttgatattgtgattcctctttctctttcttctggagctttatctatgttagcgaaatctactgcttctcctaattgatatctatcgtataatgtttttgttatagctgcagttaatgtagttttaccgtggtcaacgtgacctattgttcctatattaacgtgtggcttatttctttcaaatttagctttagccattttgaattcctcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtgtggcttatttctttcaaatttagctttagccattttgaattcctcccttatttttatatttgttaatgcttacattaagcttatgctaagtattttactattaattatttctgttttcaagatatttttccaattttctcttcactctttgaagtgcattatcaattgatttaacatctctatctaatctatcagctatatactgataagacttgccatttaagtatagttctaaaacttctaattctaatttacttaaaatttcattcatctttgattctatatttttaagctcttctttgcttattattaactcttctggatcagttattatacttgtcgctattatatctaataatgttctttctgattcttcatcatatataggcttatttaaagatacatatgaattaagaggtatgtgcttttgtcttgttgcagtttttattgccgttataatctgtctagttatacatatctctgcaaaacacttaaatgagtttgtcttacttccgtcaaaatcccttattgccttataaagacctatcataccttcttgaattatatcttccttatctgcaccaactaaaaaatatgactttgcttttgatttaacaaagtttttatatttggtaattatatactctaatgctagtgtatcccctttattagcttttaatactatctcatattcatcttgttgagaattatttacaaattcaaaaccattttctttagctactaacattttactccccccattacttaacttaataggtatattataatttataaaacttagtattttcaacggtttctacgaatgttctcaagtttcgacaaagtttctttatctaacctatcttctaaccaatttctctgtatttttcgttctgagtttacttgtttacttttaatcttagttttagcttcttcaatatccaacttaagctctctagcagatactctgctagcaccttttcctaatactatttgttgttctgcataatcatttgttgctactttcacaatatcatacttagataaagatgttataaatttttcaatatagctatctgccgtttggtgttcttttgtgtaaaccacagttatatattttcttttctcaactttttccatagagtttttaacattatatgcatcaaaaactactatagctttttgtcccgaaaactcagcatattctattatgatatcaattaacttttctcttgctccatctaagtcatctactgaaattttctttaagtctccccatgcatttataatattatatccatcaattattagataatggttaatttttcttatcattacctatttagaacccattctttgtttgaatatttcatataaaagaatgcttcctgctactgatgcatttaaagatgtaacatttcctaccataggcatcttaactgtaaaatcacagttctttttaactagtcttgatataccaaaaccttcacttcctattactaatcctattggtcctgttaagttttgttcataaaatgtttgtccatccatatccgctgctgcaatccataatccatgctcttttaatgtttttattgtatttacaatattagttactttgcatacaggaacatattcaactgcaccagcagatgctttagcaactgttggagttatgtgtacagatcttctctttggtattataacaccatgtgctcctacagcatcagcagttcttattattgatcctaaattgtgaggatctgttatttcatctaatattataaaaaatgggtcttcacctttatcttttacgctatgaattaactcatctaattcatagtatttgtattcacttacattagctattacaccttgatgtgaatggcttgtacttatttcatctaatttatttctgtctacatattgaattacaatatttttttctttcgccatagctataatcttttttatagagccttcctttgctccattagctatcattatcttatctatctctctgtcattttttatagcttctataactggatttcttccttctatatttgccaaactcttcaccgcctataaattattaaacttttctcttacttgtgtaatgtttccacacgtcatttttccttctggacaaggtccttttatgcacttaggtcctatattcttaaataatataggtgctatttctcttacctgtcttagcatttctacagataaatctcttatttcccattgagctctttcacaacatctatggttaaagaagttatataaacttctagtattcatagtaaataccattttcgtctcacatgcattagggaatacatatcttgcatcttctattgcttttttctctgcatttcttttagcttctttctcatttttcccacattttactaaattattataatgtttctcaaataagatatctactaacttatcataagcttcttgatctttattcatagcatctataaataatgcttttgcttcctctatttgttctatttcaggaggaactatatattcaaattgattaagtttaacatatctttgactttgctgtgaaaagcttgctatacgatgtctaacaatttgatgagagcaacttcttgatatcccctctacagcaaatgtaaatgtaacatgttctaatggagattcatgtcctatatttattaacatatttaaaaacttctctacactctcgtctgttaaattttgttctatttcatctactcctactgatgagtagcatagctttgcagccattgatatcaccttttctggctctggtgtatgtgctattactttaactttcataagtatacctccttaatagtttattatattattataccttattttgtctaaaaatgtagtgtctcaaataaatagaattctttggcagtaaaaaggagctatcctcacttagagttagctccttttaattacatactctcttctgttatttcaattgccttttgaattacttccttaagtctatcatagtctttcttcatatgaaggtaccctattaaagcctcaaatcctgtagcatttttataatctataatatctgcatttttaggtgtagtatgagatttttggttacgacctcttttatatatcctatgttcttcttctgttaaggaatcttctatcgtaagaattacattagcttgtgccttagctttaacatactttattgctgtcttatgtaaatcattaacttttttatttacattcttatttataagatactctcttatatatgattcatatacagtatctcctaaataagcaagtactaatggtgatactgtagctaagtttatattttccattattacacccttttccatttagttccttgtctagtatcttctaaaacaatacccatatctaataatttatttcttatttcatctgctaaagcaaagtttttatttttctttgcatcagttctatcttgtattaatttttctatatctgcatctaaaacttcatcttgttttttattaactatgtttaatacattagttaattcctcaaactctgataagcattttttagcaaattcaattgatgattcttcacttacatttgaatttataaatctcgctaattcaaatatagcacttatagcatctgctgtatttatatcgtcatccatagcatctataaatttatctctatatgaatctaattctttgactaaagctttttcattttcttttatattctcatcttttaaattacttaaagtaaattctaatttttctttagtattatataatctttcaagacctgcttttgcttgtgataacatttcatcactaaagtttactggatttctataatgagcagataacataaagaatcttactacttctaaatcatatttgtcagctatatctcttactgtaaagaaattgcctttagacttactcattttttcattatttatatttatatatccattatgtatccagtaattagagaatgtttttccacttcttgcttcactttgagctatttcattttcatgatgtgggaatgctaaatcttgtcctccagcatgtatatctatagtatctcctaaatatctcttagacattactgaacattcaatatgccaacctggtctacctacactccatggactttcccatcctggctctccttcttttcttggtttccataaaacgaaatccattggatgtcttttttgagagtttacttctattcttgctccagcttctaaatcttcttgattttgcttagaaagttttccatacccttcaaacttttgagtatcaaaatatacttctccatttacttcataagcatatcctttttcttctaactcttttataaattctattatttcatttatattttctgtaactcttgggtgtactgtagctctttttatacctagaccatctgcgtccttgaaatattcatctatgtacttattggcaacttgttcaggagttattccttcctcattacttctttttattattttatcatcaacatctgtaaagttttgaatatacgttacatcatatcctctgtactctaagtatcttctaaatgtatcaaatattataaatggtctagcatttcctatgtggaaaaagttataaactgtaggtccacaaacatacatctttacctttccttcttctattggaacaaattcttcttttgttctagttaacgtattgtataacttcatcctattcacctcactattttatttatattctaaatctaactattataatctattataatttatattctctttaattaatagtactactattatacccgcttgtattcgtaaagaaactatttatattttatagttttttagttatttctaaaaaatccattttatttaatacacatttttgatacaaatctttattgataattttatcatctttcatcttattaagtatatttatatagtcttcacaaagttgacttaactccccctttatatctttaatatctatactcatacaatcctcctaaaaatatacatttaacatataactatttaacatatattaagtttatatatataaaatccctctatttttgtatgtataatctttcttcaaaaacttacataaataaaacccatcttttattaagacgggttttttataattataataagttttcttttacatattttattctatttaaacaagtttctttacctataacagctgctgcctttggtaaatctggaccatgcatttgtcctgttaatataactcttgttcccatgaataagtttttaccttttattccatgctctttttgtatttctttgaacatagccttaaagaactcttcacttatttcatctgcagcagttattttttcttctaaagcatttattaaagttggtatatgctctaattttaagaattcagcacactcttcagtttccaatttaacttcatcaccaaagaatatattaacatgatctgttatttcttttacatattgtaatttttctttaacaacagaaaccataccttttacaaaatcatatctatttgtaacatcttcttctgttatatatccagcttctattaaaaatggtatagctaaatctgttatatactcatctgaagcttcttttatatagtgttggttaacccagtttaatttatctgtatcaaatactccaccactcttagacactctttcaactgagaaatgctcttctaattctttcattgtgaataactcttggttatcttctggtgaccatccaactagtgcaacatagttaactagaccttctggtaagtatccttttttcttgaagtcttctactgcaacatctccatgtcttttacttaattttttcttttccttattaagtatgtttggaaggtgtacaaaagtaggagcttcccatccaaatgcttcatataagtatacatgctttggagttgatgatatccattcttctcctcttataacgtgtgttattttcatcatatggtcgtccactacaactgcaaagtgatatgtagggaacccatctgtttttattaatacttgatcatctaactcatcagtattaaattcagtttctcctcttactaaatcagtgaactttatcacatgattttctggtaattttaatcttattacatattcttcaccagcagctaatttagcttcaacctcttcttttgataagtttctacaatgaccatcatattttggagtttctccagcttctttttgcttttctcttacttcatctaatctttcttttgaacagaagcaatagtatgcttttccactatctagtaattgttgtatataatctttgtatatatctaatctttctgattgtatatatggtccatattctccaacttgagttacttctttattctcgtctaatataacaccttctgtatggttaacaccagcccatgccatagcttctaacatgttttctattgcaccatcaacaagtcttgttctatcagtatcttcaactcttaatatgtattctccacccattctctttgcaaataagtagttatataaagccgttcttaaactacctatatgtacaaatccagtaggacttggagcaaatcttactctaacactcataatcttacctcctaagttttgttctatttattataataccaaatttatcccatatttataatataattttgcacaattatatttttaaatactataatttattttaattttttcctgtggataatttgatttttatataaaattaaatagtatatatatccacattttattaaaaatgttaataatttagtggattatatatactatctaagttttaaactatcctaatttaacttcattctttacaaattcagcttttatcttgtcagttatttcatctaaagatattaattctttttctgattcacttcttaatttaaattctacttttccatcagttatatctttacctactgtaattctcataggtatacctattaattcagagtccttaaacttaactcctactctttcatctctatcatctagtaatacttctactcccatagaaagtaattcattgtatatcttttcagcggcttccatttgctctgctttcttaacatttactggaactacaactacatgatatggagctatagctaaaggccatattataccattttcatcattgtgttgttctattacagccgcggcagttctttcaactcctataccataacatcccataactattggtttactttttccgtctttgtctatgaagtttgcacccatagtttcagaatacttagttcctaatttgaatatatgaccaacttcaactcctctagctatttcaagtggagctccacaacatgtacacttatctccttcttgtacatttctgaaatctccaactacaccatcaaagtctctaccaaagttagcatttcttatatgatagtctgttttatttccacctacaccgatattgctttgttctgctacttctttatctatgaatatatagtcagctttcattcctataggtcctgcaaatccaacttctgcattagttaactcttttacaacttcttctctagctaagtcaaattctataacttcacctatagcattagctactttaacttcattaacatctctatctcctcttactaaaacaacaactgtttttccgtcagcttcatatattaaagttttagcaaaagtatctgctgtagtgttaaagaattcgcataattgttctatagtagttactcctggagtatgaactggctctaattctctcatttcttctttagcttttaaatcattcactgaatgagctttttctatattagctgcataatcacatccactacagaatactatttcatcttctccaacaggagacttaaccataaattctgctgaagtagatccacctatagctcctgaatcagcttgaacagggctgttctctaagtcacatcttctaaatatttctgtatatgcatcatacatatcttgatatgacttgtctaatcctgcttcatcaacgtcaaagctgtatgcatccttcattgtgaaagatttagttctcataactccaaatcttggtcttctttcatctctatatttagtttgtatttgatataagtttaaaggtaattgcttatatgatgtaacatcttgtcttattatatctgtgaaaacttcctcatgtgttggtcctaagcagtaatctctattatttctgtcttttaatctaaacatttctgctcccattacatcccatcttccagactcttgccataattcagctgggattaatgctgaacataatatctcttgacatccttttttatttaactcttctcttattatgttttctatttttttgaaaactcttattcccataggtaattgattatatacccctgatgacattttctttatcataccagccctcatcattaattgatgacttgttatttctgcatctgctggaacctctcttaaagtaggcataaacatctttgacattttcataatattgttcctcctatttttataataaaaaaacctttcatctctattatagagacgaaaggttatatttccgcggtaccactctagttaatcaatatactttttatattgattctctttataggatataacggtccttaccgtaagaactttttaccgttcttaagctctgagattggttcaaaaacttatttttagaagctctcacctaatacttcttctctgtaaaaaactctattttttactatttctcttcttagctttttaattctaaaatttatttattataattttatagtaattatttaatattgtcaatcttaactaataaacatatactttgtgctgatataccttctttgtttcctgtgaaaccaagcccttcttctgtagttgctttaacatttatattgtctatatctgtatttaatacttttgctatattagctctcatagtttgtatatgaggtgccatctttggtgcttgagctattatcgtagcatctaaatttcctatagcatatcccttttcttttattaaattatatacaaattctaataatttcatactatctgcacctttatatttttcatctgtgtcagggaagtgcttacctatatctccaagagctaatgctcctaatattgagtccattattgcatgaagtaatacatctgcatcagagtgacctaacaaacctttttcatgttgtatttcaactccacctaatattagctttctattttcaactaacttatgaacatcataacccattccaactctcataattatcctccgttaatttttattttttaatatttgttctccaaattttaaatcttctggtgtcgttatttttatattatcatatgacccttctaccatcttaacattatatcctattcgttctactaacattgcatcatctgtaccgtaataattaccattatatgcatcttcatatgcttttgctataatatcatacttaaaaacttgaggagtttgcacagaccataaaaaatttctatttggagtatctataatatttccatcttcactaaccatttttatagtatctttaactttaacccctacaaccactgcattatgttttttagcttcttctatagaattttttattatatcacctgttacaaaaggtcttgctccatcatgaacaagaattacatcacaattattattaagcttctttattccattataaacagaatcttgtctctcatttcctccatatgcaatttttatattatcaaatccatatttatttataacattatctatgaagtacttctcctcttcttcttttataactacaactatatcatctatattatcattattgtaaaacttatctatagtatgcgctataatttccttgccatttaactttataaactgtttatttatatcttttttcattctacttccagttcctgcagctacaactataaccccattcatattatcacctctttagtaacctaaaataatttatatatattttaacatatggggttaaataaatatttattaaaattaaaaagccttcagatttgaattctgaagacttttttttaatctactttaggttttccaaatatcattcttcctgctggtgtttgtaatacagatgtaactaaaactcttatagtttctcccatatatttctttccaccatcaactacaatcatagtaccatcatctaggtacgcaattccttgatttgattctttaccttctttaacaacttgtactatcatatgttcacctggtattgctactggtttaattgcattagctaattcgtttatattaagaacttcaacaccttgaacttgagctactttatttaagttataatcattagtaacaactttacctccaagagtttccgctaactttaataattttgcatcaacttctgctatatcatcaaaatctttattgcttatttcaacttctatgtttaattctttttgtattatgttaagtatatctaaacctcgtctacctctaactctctttaaatcatcagacgaatctgctatatgtcttaactcatctaatacaaaagttggaattacaattttaccttctataaatccagtttggcatatttcagcaattctaccatctataataacactagtgtctaaaaccttaggtggtatacttttttccttcttaatgtttttatctttaattggtgctaattttgttagtttatttaagttaaatatgtcatctttactctttaatgcaactctaattcctagatatcctaagaatacatatgtaaataatgataataaattacctactataggtatcttaagtgatagtattaattgacttactaaataagctataacaagtcccactattaaccctatagtccctaatattatatcagtttgaggatatttagatatttctctatccatatctttagctaatttcctagatctattcataatccaaggtcccatcatatagaaaatgcaccctagtactaaaccaacaactatagaaattataaaggtgtatagttcagatccaaaagaaagattaggaaagttttgagctgctgatatgtatgttgtcatacctactgcaaatcctaagattcctattattgctcttattatcttcgataacaaattttcaccccctatattttttccttaatatttttttattataatcaaactactaattatattcaagaacaaacttatatcaatattttatatatgtctatctataagtgacaattcttgcatttttataagtccattttttatatattttgcccttatttctcctattccctcaacatcatctaaatcttctattgaggcattaagtatatcttgaaaatcttcaaaatagtttactaaattttctattatagtgctaggtaatctatgtattttatttaaaattctataacctctaggtcttattggcatatccatactttctgagaatccagtatatccaatcattttagctatattagctaaatctaataactcttctgatgacaatgatataatttttttcttaaattcgcttaaagtcatatcatttctttgataatcttttagtatttggttttgatctattttggtagttcccattagttcatcaacttgcatacttataagcataccttcaacacctagttctactatatacttttctattatatttgtaactctcataaccatttctattttttgaactacaagtacaacatcatataaagttaccaaatctttaaattccaatgcatttaaacttatgatagcttggtctaaaactgacttgtatttttctaaggtttgtaatgcttgattagctttagtaaaaatctttgatatgtcatcaattacatattttttatcaccttgataaacagttattacatttcttctttgtgatattgcaattactataccaccagtttgtttagcaactctttcagctgttctatgtctagttcctgtttctccagtttcaatcgaataatctggtataagctgagcatttgcatatagtatcttttttatatctccacttaatactatagctccatccatttttgcaagctcatataaatatgcaggtgagtaatctgcatttatgttaaagcctccatctacaattttcataacttcatcactatcagctataactataagtcctcctgttttagcttttaatacatggtctattcctattctaagacttgtaccaggagatatcatttttaatgtggtaattgctttttttccactaaaaaaatcatccattattatctattcccccctaatactatatttatagcttgtcttacactatctactggacaaatttctatatcttttatatctttaactgcttcataattactctttggtataacaattttagtaaatcctaatttcttgcattctgctattcttttttctataaaacttacagctcttatttctcctgttaatccaacttccccagttatagccacagtaccatctattggtatatttctgaaactagaagctatagacataacaattcctaagtctatagatggttcattaacttttagtcctccaacaacatttatatatacatcctgattttgtatttgcataccaacacgtttttctagaactgccataagtaaagatactctattataatctactcctgttgctgttctttttggtataccaaaactagttggtgaaactaaagcttgaagttctaatagcattggtctggtcccttcaactgtagatataattactgatcctgcaacatctttgggtttttcagctataagtatttttgatggattttctaactctattaatccaagttctctcatctcaaagactcctagttcatttgtagatccaaatctattttttacagctcttattaatctatatgtattaaatctttctccttcaaaatacaggactgtatcgaccatatgctctaaaactttaggtcctgccaatgaaccttccttagttacatgtccaaccacaaaggtagatatacccatttttttagaaattttcataaatcttgatgtaccttcttttatttgacttacagtacctggagcagatgtaatctcgggactaaaaacagtttgtatagagtcaacaattattaaatctggattaacactttctaagtgagcttctattatacttagattgttttcagcgaatatatataaattatcggactgtattcctagcctttgagccctcatttttatttgagatgcagattcttcccctgatatgtataaaacttttttcccgctattagctacgttacttgcaacttgtataagtaatgtagatttccctatacctggatctccaccaactaaaactaaagatcctttaactactcctccacctaaaactctatctaattcatttatacaagttgagaatctttgttcctttatggtttctatagaatttatatttaaaggtctagatgatgatttatctataacaaatacttctttgttagacttagaacgtttatcttctatttcttcaataaaagtattccatttactacactctggacattttcctagccatttgctattttcatatccacattcttgacacacatatttagtttttattttcgccatttataaactcacccttatgcaattttttattctaatattaattttaacatatataatacttaatatgttaaatttatagtgtaaaggagcttatttaagctcctttgttatctattctttaaattaggttcaaatactatcttttcatttaccatcttcgcaataatataatcacctttttttatattttcactcaaaatattctctgataaactatcttctaattctttttgtataactctctttaatggtctagctccatattccaaatctattccatatttagctataaattttatcacagtttcttctatatctaattctatatccattttttttagtctttttattaaatctttagtcatgatttttactatatcatataaattatctaaacttagtttgtggaatactactatatcatctattctatttataaattctggtctaaatctaattttgacttcttccattattttatctttcatatcattataattttcttcttttatttggctttcattatttccaattgaaaaacctgtttttctttgatttgatatagatgtagctcctaaatttgatgtcattattattatggtatttttaaaatctacagttcttcctttagaatcagttaatctaccttcatctagtatttgtaataatatattaaatatatcttcatgagctttttctatctcatcaaataaaactactgaatatggatgacttcttacgctttcagttaactgacctccgtcatcatgacctatatatcctggaggagatcctattaatcttgatactgaatgtttttccatatactctgacatatctattctaattattttatcttcatttccaaagtgactttcagctaaagctttacacagttcagtttttccaacaccggttggccctaagaacaaaaatgaacctattggttttttaggatctttaattcctgatctagatcttcttatagcttttgatatagcttttatagcttcattttgacctataactctctcttgtaatatatcttctaaatttaataacttatccccttcagatttaactattttacttataggtataccagtccataattctactacttctgaaactatattactatcaactattcttttgcctctttccgatttaaatttattaacgctaactcttgatgcagattcatctataatatctatagctttatctggtaagtatctatcagttatatatctacttgataattctacagcttgttttattgcattgtctgttatttttacactatggtgtctttcatatttatgcttcagcccatttaatatttttatagcaccctcttttgttggctcttcaactattattggttgtagtcttctttctaatgctacatctttttctatattttttctatattcatctatagttgtagctcctataacctgaatatcacctctagataacactggtttcagtatattagatgcatccataggattttcacctgtggccccagctcctactatagtgtgtatttcatctataaataatataatttctttggcattaatagcctcatcaattattttttttattctttcttcaaattcacctctatatttagctcctgcaagtactcctgatatatctaagttgtatataatcttgttttctaatgattttggtacatctttttcttctatttttatagctaatccctcaattattgctgttttaccaactcctggatctccaattactacaggattattctttgttcttctacttaaaacttgaattattctttgaacttctttttctctaccaattaaaggatcaattttattattctttgcattatcatttaaatttatagcatacttttctaatatagatattttaagtttatcctttttcttgtcttcaatatctatttgatttactattaatcctatactatcatctatatctatatactcttttatagatttctctaatagttgtttatctatacctcttttcttcaatatcttaattgctagactatcttcttcttgtgaaagtgctaatagtatatgttcagtatctatcagtttattttttgatttatttagaaaaataattgatttatctaatatacttctgcttctaggacttaaaaaaatgtcatctgtattatcatttatgcctattccgtatatatctacaatctgtttacttactacttctgattcaatgcctagtctaattaaaatcttagaagctataccttcttccactttaattaggcctaatagtatatgttcagttcctacaacactatgccctaaatcctttgcgcactttatagatatatctattactttttgagcttttttagtaaatttatcaaaatacaatatcgtccccccttgcctaaaaatattagatatatatttatactatatgcacaattggactttattgcttcattgtattaatttttatgcttaattttttaaggctgaataaataataagtaaaaaataaggttctagatatatatctagaaccttattttttacttatactttagaattttattcaaagtcaaatgaactagtcaaaatcaattcaaatataatcatagaaaactttaacagcaataaaagtatttttattataggtaaagaagtacagtcaaaacaatatacgatggaaatattagaggatcttttagataatattaatgtttgtgcatttgttatagatgatgatggaaagtatttatacgtaaataagtattttactgaaatgttagacaaaaaaagagaagatattattggaagttatagcagtgataattgggaatataatacttataatgaatttgaaaaaaataatagagaagtttttgaaagtaaaagtccaaagatatttaatgagaaattagtatatgatgataatattcattggtatgaaagttacaaagctccaatatttgatgaaaataaaaaacctaaatatattgtagcaaaatctaaaaatattaatttatcaaaaatcacagcagaagagttatataaaaactataatagagtaacaattgaaaatgactttagtggcagtagtaagaagagtgtagatttaaatgaaatattaaaaaatattggagaacatatacttgattatacaaaagcagatggtatttctatgttactttatgatagttataaagaaggtttaatacctattataaaattaaaaaattctaatacacatcttgaaaatgtagaatttattccactaaaaaaattcgatgtatatttagataaatataaaagttattttaactgtatatttaaaaaagataaaatagataatttatcaaacatagattctatatgtatagatgaattagattattgtggtaattatataatagatttatatgatgaatttattggaatgatatgtttaagttatagtaaggggaatgctcctaaatttaatagcgacgagtatatgaaatatatatgtaataaaatagcgatgataattaacaatatcagactttcaaatgaggtatctattgaaaataaaaagcgtaaacatacagaaaaagagttagaaagatatttaaatatttcagttgatttagtatctatagtaggaaaggataaacattttaaaagactaagtcctaattggtgtgatgttttaggatggacagaagaagaattattatcaatgccagttgaagatattattcatcctaaagatttagaagactttagaaagaaaaataaattagatcctaaagaatgtaaaattactagaaatattattcgattcaggcataagaatggaaaatatatttatcttgaatggagtagtgagtatataggcgatgaagaaatatatgttacaacggcaagagatattacaagaaatctagaaatagaaaaagaaaaaagaacgttagaagaagctgtcaaggtagaggttgtaaaaaatgaattcttttcaaatatatctcatgaatttagaacgccaataaatattatacttgggactatgcaagtgattaataaaaatatagagaaaaataatatacaaataaatgatttaaagaaacatactaactatataaaacaaaactcatacagattattaaagttagtaaataatctaatagatataagcaaaatggatataggaatgtatgagctaagatgttctaatcaaaatattataaatattattgaggatataactctatctgtagcagattatacaaagaataataaaattaatcttatatttgatacaaacgatgaagatgttattacatattgtgatccagataaaatagaaagaataatgttaaatcttttatctaatgcgataaaatatacaccagagaatggttttataaaagttaaaattaattctacaaaagatgaaataataatttctgtaaaagatagcggagtaggtataccaaatgaaaaattatatgatatatttgatagatttgggcaagtagatgattcacttaatagaaaatgtgaaggaagtggcattggactatcactagtgaaaaacttagtagaaatgcatggaggagaaatacatgtaaatagtgaagttaataaaggctcagaatttgtatttagtattccaattaagataaaaaaagaagataatgataatgtatgtgatattgatagaaaatttaagcatgtagaacgatgtgatatagaattttcagatatatatagtatataaaaataaaaaaagcatttatacaactatgtataagtgctttttttataaaagttaaaaaatttatgatttagttcgttcctttcttttgatttatgtagaatttatttgttatattgtttataattgttaaataatgagaaagaataatatttctaataaatgatttggggtatttaaagaggtaaagtaatataaaattcaattattataaggggtgaacttatgaaagaatatataataactaataaactagaacagtttatagaaaactaccaacaaataaaagaagttaaaggcgcatggagtatggggatgatacaatatagctgtgctttatctctaacaattaaaaatcaacacgcaaataaagaaaaaatagaagaaaatctaaaaataataaaagacaacacaggaattttttcaaactttaggggttatagcatgtactatacagctacactattatcaactaaaattaattcagaaaatgattttagagaaatcttagatatatataaacaattaaaaggtaaaagcttttggaacgatacttatctaccatttgtagcaataatattatatgaaaataaaaataaaatagatatagatacctgtatcgataatatgaagtatgtatatgagtttatgaaaaagcatcatccatttttaacttcaagtgatgattattgtagaatagcacttatagctataaactcaaaagatatagacaaagacttaaactacatagaaaagtgttatgaaaatcttaaatcaaatggattttatccatcaaataatcttcaagccttatctcatataatgtgttttgataaatatagaaatgatgaaagcatagataaaattataagacttaaagacttaatggctaaagaaaattgcaagatggatagctacggatatcctttaataggagctatatcattattagattgcaatgaagatacattagtaagtcaaataaagaaagtatcagatagtttaaaggaagtaaaaggctttggtaactggacattaggaaaaaataatagaaatatgataagctcggctatagtagcatcggctcatgcagattatttaaaagaagaaagtaacgtagatactataagtaataatatatttttagatataattatagcaatagaaatagcttgtatggttgcaactatggctgcggtttcagcttcagctgcatcaaatagctaatccacgtaattatataaaaaaacacccctaagagtgatagtctaacacaaggggtgttttttcaaatatatattcatcaacaatttcattattttctaaatcaacaagcattacagaaactaaaatatttaaattaatagggtttttatttataaattttttaaaagcatcttcattattagtagcaatagtaaacttagaaatattaaactcatcataacaagctagatatccataaacatccattaaataacgattagccatagctcctatattttcatggataggaataaatctaatcctccaaatataattatccttagtagctataatattacctaaaaaagttttcttagataatttcatattaaatccttctttaagaattctaggagatataatactaataaatctatcttcacattgttctttataaatattgaaatttgttttatctacaagattggcgttataaaaggaaggctcaagatttaaataacaagacttttctaaaagatcattaaaatctacttcaagtacgaaagctaaagctcttaaaacttcttcagatggtttttttctttcgcccgattcaatcctacttatttcagcattactaacaccagatttttcagctaaagctctttgtgataatttacgctcaagccttaaagtttttaagtattctcctatcataatataaagccctcatttctaaaattccgtatatacgtataaaagtatgatattatcatatatttacgataagttaattatactcaaagtggtgattatattcaacgatttaacaaaaaaaggtattcctattgactgaataatcaccaagatgataatataatgttaccaattggtaacaaaaattaataaacttgtttaataaaaaatcagtaaagaaactaattaaggagatagggtaaatggagttaaacgttgagtattttagggaagtattaattagaaaggatattacaaatagggaatttgcaaggatggctggaatttgccacactagcgttactaaaatattaaataaaaatatgaaagcaggaatgaaaacttgtaaagctataaggggagctttaaaagatgaacctataaataaattattcatataaagtgttaccataggtaacaaaaaattaaaagggggataaaatatgaaatttattactaaagtggtaacaggggaagtaagatttaattatgtaaatacaactgaagctagagcaaacgacctagactcagagccaaagtttggtttaactatacttataccaaaagaaaatagtgaaactatgggcaaaatttatacaggtatgtctaatgctacaaaaaatgggcttaatatatggggtggacaagttccagaggatttaataacttgtttaaaagatggagatctactagacagaccagaatacaaaaatcacttctatataaatactaattctaaatacaaacctcaagtagttaatcgagaattaaaagaaattacaaatccagaacaactttacaacggctgctatggaagagtaagtataaacttttatccatataaccacctagaaagtggtaattgtggtattgctgctggacttttaaacatccaaaagttaagagatgggcaaagaataagtaacagaagtagtgcagcagatgattttgacatagtagaagatgatgggattttaatataatgaaaaccatatcaattgacatagaaacttattcaaaaatagaccttaccaaaagtggggtctataaatatattgaagaagactttgaaatactacttattgcctatgcttataatgatgaagaagttcaaattatagacttaaaaaatggagaaaaaataccaccacaatttaaaaaagatttatttgatgaaagtataataaaaacagcttttaacgcaaactttgaaagagtatgtttatctaagtattttaacaaaaacttaagccccaaaatgtttagatgcacgcaagttcacgccctatacttaggattacctcatggacttgataatgtggctaaaactctaagactaaaagaacaaaaactagaagaaggcaaaaacttaataagattttttatgaatgaaaaaaatgtagctttaataaattcaaaagaaaatagtaaagaaaagttagaagtacttaaaaaatacgaagaatttaaaaagtactgtataaatgatgtagtagttgaaagaagtataaaaaaagttttagaaaaagttaaaattccagaaatagaaaataaactttggcaactagatcaagagataaatgatagaggagtattagtagataaaaaattattagaaaatgcttgtatatatgatagtgagtttaaagaagctttgataaaaaaacttaaaaacataaccaaagtagaaaatccaaatagtaataatcaaataaagttatatcttaaaagtttaggactagaagttagttcacttaataaagaaagtgtagaaaaactattaaaaagtaaagaagttttaaataatcctaagtttgaagaaataaaagaagttttaaacttaagaagtaaattaaataaaacttctactaaaaagtatgaagcaatgaaaagatgtgtttgtagtgatggacgtataagaggattatttcaattttatggagcaaacagaactggacgatgggcaggaagattggtacaagttcaaaatcttccacaaaataagctaagtaatttagaagaagtaagaagtattataagtaatagttataaaagtaaattacctagtagagatgaatgcaataaatataatgaagacatttcaaatatattatctcaattaataagaacaacttttataccaaagaaaaaccacagatttataatagcagactttagtgcaatagaagcaaggataattgcttatctttcaaatgaaaaatggagaatagatgtatttaacacacatggaaagatttatgaagctagtgcatctaaaatgtttaatgtagatattaatgaaataaccaaagaaagcgaactaaggcaaaaaggtaaaattgcagaattagctttggggtatcaaggtggagtaggagcacttgttagtatgagtgcttataatatgaatttatgtgaagaagatcttatagaaattgtaaaagcttttagaagttctaatataaatatcgttaacttatggaaaaaggtagaaagagcttttataaaagctgtaaaagataaaactgttgtaaatatagataaaaatataagttttatatatgaaggaaacatactttttataaagctaccatcaggaagaagactttcttatataagaccaagaatagattataacaactcttttaacaaatacgttataacttacgaaggagtagattctgtaagtaaaaagcaaacaaggttaactacctatggaggaaagttggtagaaaatattgtacaagctatagccagggatatattaggatatgcaatgcttaatctaaaagctaagggctttgatattgtaatgcatgtgcatgatgaaattgtagttgaagtagaaaataatatttcaagtgtagaagaaatttgtcaaataatgtgtgaaggaaatccatatttaaaagatttaactttaaaagctgatggatttgaaagtatgtattataaaaagtaattaagtatgatgggggataatatgaagcatgacaagattataaatgtagctataggaagaagtagaaaagaaattaattatattaataaaagtgttagatattcagattttataaattataatttaagaaatactacatatacaaatgagactttcaaagagtatatgaacttttcaaaagacatacaagataatataaaagatgttgggggatttgtaggtggagttttaaaaaacggaaaacgaagaaaagacactgttataagtagaagtcttgtaactttagatgcagattttgcttatgaaaatatgatagaggatattgaaaaaaattgtgattttggtatgtgtatatatacaactcataagcataccaaagaaaacccaaggtttaggatagttattcctttaattaaagaagtaggacctatagagtatgaagctatagctagaaagttagcttttgatataggtatagactattttgacgatactacctattccccttctaggcttatgtattttccatccactagtaaagatggtgaatatatttttaaaattatagataaaaagtggctcaatccaaaagatatattaaatacttatgaaaattataaagatgaaagtttgtggcctgtttcttcaagaacaaagccaaagattattaattataactctaacaaacttaaggaaaatcctagattaaaagaaggaattataggagctttttgcagagtttataatgtgtttgatgttattgataaatttttaagtcatatttataaaaaaggtgatagtgagtatagatacacttatataaatggaagcagttctaatggtttgattatatatgaaaatggagattttgcatattctcatcatagtacagatgtatgcttaaataagctttgtaattcttttgatttattaagattacataagttttcaagcttagatgaaaaagtaagtgctgatactcctattaacaagctaccttcttatataaagatgattgagtttataagtcaagatgaaaaagttatgttagaactgggaaatagtaaactaaaaaaagctaaagaagattttagtgacttttataatatacaagaaaataatataaataaaaattgtgaaaacaattgggttacaaagcttgaagtagataaaaaaggtatgtataaagctagtaataaaaatattgttactatattagaaaatgatgtgaatttaaaaggaaagattgcctataacttattttcaaacagaaccatggttaaaggtgatttgccttggcgaagtatttcagataaggaaaatggagatgtctggcaagatagtgatgatgcaaatcttagagtttatatagatatcgcttatggtatagttgctccatacaagattaatgatggagtagctattatagaaaagaaaaatcaatatcacccaataagggattatttaaattctaatacatgggataaagttagtagagtagatagtttaatgattgattatttaggtgcagatgatagtaaatacacaagaaatgtaactagaaaaatgcttgttgcagcagttgctcgtgtttttaatccgggtgttaagtttgattatatgttggttttggttggaaaacagggtataggaaaaagtcatattataagtttgttagggaaaatgtggtattcagattctttaaatactgtttatggaaaagaggcttatgaacagttacaaaatgcgtggatagtggaaatggcagagctttcggctactaaaaaagctgagtcagaagcagttaagcactttatatcaaaaactgaagatagttataggcaagcttatggaagaagggttgaaacttttaaaagacagtgtgtgttttttggtactactaatgaaagtgagtttttaaaagatagaactggtaatagaagatattggcctttggtggttggaagaaataaagttgtaaaaaatttgtttaaagatttaactaaatatgaactagaccaaatttgggcagaggctttgtatttatatagatgtggtgaaaagttaattttagatgtagatgctcaaaaagaagctactttaaaacaagaacaacatttagaaagtaatagcaaggaaggtatgataagagagtttttagatatgaagcttcctaaaaattgggacaagatggatatttatgaaagaaggatatacataggtgaaaatgatactttgagaaaagaaggatgtgtagttcgtgagaaggtttgtagtgctgagatttgggttgagttgtttggtggtgatatgaagatgttttatggaagtaatgctagggaaattaatgatattttgagaaagatagaaggttggagtgctttgagaaatggagaaggaaagcttagatttggtaaaaattatggagttcaaagagcttttgtaagagataagtagatgttaccatagtattttttagtgttgacgaaagctataatttgacatcactaagtttagacttaggtgttaacaaatatttaggacaacacttaaggtaacacctttagggaacggttaaatatagttttatcaatacttataatatgatgtagtctaattatacaaatatttataaagagtagttgagtaggtaaaataattaaaaaaatttatctaatacataaataagttatagaaaaatttatttggtaacataaaaaaagagctatctcgagatagcccttggataaaactatgcagttattaagtcgaattcttctgtatctgttactattactttcgcatctacagtagcaactaattcagatccatatggagcgaatatgtttttttcaactattaagttcatagcatctactatttctgcttcagttatgttttcttttggatcatctattgatatagatatttttctacctacaccagttaagaaggtcattactaatctttttttagtttccatttgtttcacctacctttcaaaattttaagaagtttaagcaacggacctgcttttcaaggtcgttggcgccatgagcaaagcgaatttttagtttaatatagtgttatctacttttaagatttcaagaacgtcgtggttttgtaatcctattaatgcgtttgctacatcaagtatgtcttgagaagtggcattgtctgctacgtttgagaatgtacgagatttaactatcgttttaccgtcgtcgtttagtccacagtcaaattttatttttaaaactgatggatttttagtttcactaactgccattttatttctcctttctttaaagatatgggggtatctttaagtttcatttgaagtgttagcttctaatttaattatagaaggaagttgtttttttctatattaaagaagtttagaaaaaatttttaggagggtgagtttatggaggataagattttagagtttgttaaggttgaggatgttccagaggggtgtagagatttggttgaggtgtttgggatggaggtttttattagtttgattgagttttgtggtgggagtaccgtttatttgcctagtaaggggtctgttgtgaaaaaggctagaaataggattattaaggaggagtttgatggggggaattttagggagctttctagtaagtttgggattagtgatattcaggttaggaagattgttaggtgagttttagtttgtttcgtgggggtgtttgaggttatatagcatcttcctgcactgtaaagcctaaagtgcaggctttaacgtttcgtcagattactatataacctcaagttattaggaaaatttggtaaataaattgatgaaaaaaataaaaatatgatattatatataggtgattattatttaattggtaaaaagcagaatttaatatattgtaaaattaaataatatggattaaagagtggttcagttatattcgtctccaccattgaaattcaagaattactcatacttataagtatgagtaatttttatattgaaaataaatttatattatatcaattttaaatttgaatagggaggatgctattgatgccagaagcatttataaaactatataaggttaaatcaggagactgtatacaggtaagatggtatgatgataaagcatatcgtaatataataatagactgtggatacggaaataccttcaaccaaactttaggacctgaaattaaaagattaaagagtaatggagaatttatagatctattaatattaacacacacacatcaagatcatataggtggaatgaaaaagataataagtagtaagaatgatgatattataaaacactgttggtttaatggtggaagagtaaatatgaacttagataattcgaacaagataagcatttctaaaggagtagaactagatgagtacttaataagcaaaggaatcggaaatactgaaaaaattatgtatgataataagatatataatatatatggtgcaaatataaaaatattatctccaagaaaagaggctttggaagaatttttgctaaaatttcaagagaaaattatattaaaaaataataaaacgacaacttctttctgtgattgggatatagagttagaagattttaatttagatgaattttatgctgatgctgaacttgaaaatagaataagtatatcttttataatggaaattaaaaataagaagatattattcttggctgatagccaccccgatgaaatagaaaaatctttgaaaaaattagggtgtaatgtaagaaatagactttatgtagattatataaagttatctcatcatgctagtaaaggaaacacaagtaatgaattattagatttgataaagtgtaataattttataattagtacagatggagctaataaagatcaatttcctcataaagaaacttttgctcgtattttaagacatccactaagaaatatagatgaaaaaataaaatttatatttaattacgatacacctagtttactaaatattttttcaaatgatgattatggtaaatataattttgaatgtatttatccagaaaggggtaagaataatgtcaaaatatcaatctagtctaaataaagtagattcaattacatgtaaaattatagtatatgataaacttaataggcatcagcatggatcaggtgtgattttaaacttaaaagagtcagaatgtgtatatatactgactgcaaaacactgtatatggggtgatgatgcacagtgtgatttaaacaatatgcaaattgatattttagtgagaaataaagattatgataacgagtatgtaagagttagcattgataaaagtgatgatattttatatgacaaggatgatagcgaagatattgctataatagttcttaaaaaaaatagaatcgatagtttaaaagatatttcatctataggtatattagatgaagaaagtgtgttgaatgagtgtataataaggggatatccagcaccttataatgattctagcaataatcaagcaataacaatacctagttgtaaatacatagatacaaatatacttgcaacggaaactaaattagaaagtcaaagttatggagattcaagttataatttaaaaggatgctctggaggtggagtatttacattattgaatggtgacttttatttaataggaatagtatatgaatttggagaagtatttgaaagaataattattaatccggttagaaaatataataaactattaataaagtcaaagtataaaattatacccatggaaaaaaatttaaatagtgctaatatgaagattataaatgatattacagaaaattcacttgataatcttggagaaaggtttaatagaaattttaatgtagatactgagatttatgacatattaaataaattttatataactaatatcatattagatcaaatttatgagttattaaaagaagtaaaaacaacagtttcaatgttacacaaagtaaataataaggacttgctaagcagtatagatatattaataaataatatattaaaaagtagagtatttgattatgatttattaaaagaaatgtttgatatatttatagataaagctagtaaattaattgatgagagtaaggaagaaaatagaaatgacaatattatgtatttttatggaaaattaattaatttaaatgaaaagctagataactataggataatgcttaattcaagaactttaatattaacaggtacagcaggtataggtaagtcacattcagtagctagtttttgctatgaaaatttttacttgaagaataaagcttgtatatttatattaggacaacagctaaatgattctgcagacataatatcaatgattgaaaaaatattacatatagatgggactttacaatcgtttttagatgaattagagaatattgcagaatataacaacataataattccttttgtaatagatgcaataaatgaagggagacattctgaaatctggaaaactcagtttaatgggttagcttcaatattcagcaaatataaaaggataaaattaactataagtataagaagtacatatataagaaaatgccttcctaatgattttaagaaaattgaaggagtaatagaagtagaacatagaggatttgagcaaaattcaatagatgctgtaagacaattttttgaattttataaattgcaacttccaacttttcctatattatactcacaatattacaatccactttttctacatatcttatgcaagacattaacaaaactagatatacaagaaattatagaatataagtcttttaatgatatattcgaaaaatatttttatgttatagaagaagaagtatctattaaattaggttatatgaaatcgcttaaattaattaaaagggtaattgataagataatagaatacagtctagaacacgataaactatatggaatagaagttgaaattttttatgagatagtaaatgaacaagtgaataaatttggtgttaactcaaatcaatttattcaaatattaattgaagaaaatatattttttatagaaatttatggtgaagaagataatgaatatgttagatttgcatatgagagatatcataacatactttcagctaaatttttattaaaggatgttaggactattgaagaagtaatatcatatattaagtgtggaccattgaagtcatattttaagaatccatataacggtataacagaagagttatttattttaataccagatagatatgatgtagaagtcataacagaaatagaggagcaatacgttagtcataatttgaaaaattatttgaatagtttaatttggagagataaagaaaaattacagatagatattataaaaaaaataattaatgaagagattttgccgagaaaatactattttaataaatttattgagatgttaattatgttatccccaatagaaggacatccattaaatatattattttttcaacagtatttaaaaaaactagaaatgtataaacgagatcatttgctgtctaatattttctatagaggtcaagtagataataggacattaaataatttaataagcttttgctttagtcgagcaattaaaaaaactagcaaagaaagtttaaagtatataatattcatggtttcgtggtctatgtgtagctcgaacttaaaatatcgtaagttagctatgaaagcattaacaatagctttggaaagtcaggtagaattatctgaagatttaattttaaatttcaaaactatagacgatccatacataaaggaaggcatatattgttcgatatatggttttatccttaggtctaatttaaagaataaagatttagagaaaatttgccagcttgtatatgatgatatatttatgtgtgatgaagtatatccaaatatacttgtaagagattatgctagaggaattatagaatatagctatagaatgggttgtaaaatgacttttgatataaaagatgtacagccaccttatagaagtaaatggtatgagaatataccatcaaatgaagaaatttataatttgaattatgattatagagatgacaaggtagaaagagttatgtattcagcaaatgagattataagctctatggcaactaatactggtgaacaatctatgatgtatggggattttggacgatatgtgtttgaaggctgggtagacccttgggattatcattttaaagcatatgaattaagtaatatagtaattaaagaaattttcacaaaatggggttataatcccaaattacatggagaatttgatttgagcgttaaatcatatgataggcatagaaatgagtgtgaaagaatagggaagaaatatcaaagaatagcaagttatgaaatgctagctagattatctgataatttttcaccaggaaatatagaacgcatatacagtgaagattataaatacaagtcaagcaagaagtttgaaaggtttctctcttctattcatggaattactgaagatgaactagacatacatgaagatatagatttggaatacgaggaaccaactattgtttttaaagaatacccatatgaaggaccgtggcaaattaatttacgaggagtagatacttcgattttaattaaaaagaatactgaaaaagaagtaaattatttaggtgatatttttaaaattcctgaaatacctgataatgaatgggcgagtaaaaattctccaaagctagagaatagtgaaataatatatacaaaatataatggagatgaatttatagtactagagatgtataattcttggaattcagaggaattggataatagtataagtaataaatcctattttgttaaagctatagctttaattgtagatgaagaaaagatagatggattattgagtaatgagcagattactagatattgctatggaaataataataatgaaataagatatgtgtttgcaaaagaatttccagaatcttcatcttacttaagttataaaaatgaaatgcagagagattattatgaggatgtagattacattgaaacaggtataaattatagaactgaagaatctgaagatggatttatagattcattttcaatgcctagtgaatttattataaaagacttaagtctacatcaaaaaaatgatggtaagtggtatgataaaaatgataacctagtgtcttttgatttatctttagatggatatagaagtatgttgataattaaaaaagacattatggagaagttattgaaagaaaagaacttgtctattatatggtgtatgtatatagaaaaacaaggtggaaaatatcactattcagaaagaaatatagtgtaccagagaagaggtatcttaaaaaagaaattaatagaagaagagagttggacaaacaagtttatgcacttaagaaatagttagataattaaaagttttagtttataaaattggaattttattcaattaaaatgtaaacaaagaggataaaaaaactactaagtttataatttagtagtttttttgtgttaataccccttacgtttaaaatagacacagggggattaacatttattttttataaagaagtttcttttaaaactaaaccttcatttctctcaagtagatgtctaatagaccattcgttttgtaataacaatactggattgctatttttatcttcaactagtaatgtatccattgtcattgaaagcttaccaaatttagaaagatcattttcaatccaacgtacataacggtaaggtagtgggttcattagtatatcaacattatattcctgttttagacgatattctaaaacttcaaactgaagaactccaactactcctataataagttcttccataccaccattaggttgtctataaacctgaatcgcaccttcttctgataattgtgtaataccttttacgaattgttttcttttaagggcattctttgtagatactctcataaagtgttcaggagcaaattgtggtatattagtgtattgtaaatttgattgtttttcacttaatgtatcaccaatattaaatattcctgggtcatgtatacctataatgtcccctgggtaagctgaatctattataacacggtcttgtgccacaaactgttgaggttgtgaaagtttgacctttttatttctttgtacatgagttactgtcatacctttttcaaatttaccagagcaaattctaaggaatgcaattctatctctatgatttttatccatattagcttgaattttaaatataaatcctgagaaattattagagttaggatcaatatcgcctaaattactgctacgaggacttggtggtgatgttatttctaggaatgattctaaaaatggctctacaccaaagttagtaagggcacttccaaagaatacaggcgttaattcaccatttaatattgcatctaaatcaaaattatctccagcaatatctaaaagttcaatatcatttagtagttgttcatgaagagcatcacctaataaagtattaaatttttcatcagacacctctccagttatagatttagcaatatcttgtccatggttaccatcatcaaatacttcaatttgatttttatgacggttaaacacacctttgaactctttaccagaaccaattggccagtttactggacaagagcgaattcctagaacattttcaatatcctcaagtagttcaaaaggatcctttcctttacggtccattttattgataaaagtgaaaattggtattcctctcattttacaaacttggaataatttcttagtttgatcctcaacacctttagcagagtcaataaccattactgcactgtctgctgccataagagttctataagtgtcctcactgaaatcttgatgccctggagtatcaagaatatttatacaaaagttattatattcaaattgaagaacacttgaggcaacagatatacctctttgcttttcaatttccatccagtcagatactgcatgtttttgagatcttcttgatttaaccgaacctgcttcacgaatggcacctccatacaatagaaacttttcagttaatgtagtttttcctgcatcgggatgggaaatgattgcaaaggttcttcttcttttaatctcatcaatcaagcttaaattttgttctgtcattttttatcatcctttattttaattttattattatataaattatattgattaatagttttaaaatgaacttaattttctatgtactataaaaaactacaatcctattgatattataactttattgcaagactgtcaatatagaaacaagcaatagatttcttaagtgtcttggattagtactttaaactttaatttatagttgtgttttgttaatatagatgtataaaagattaaaggagatagattatggagtatactaaagcgcagttagatgagattaaggctaagataatagatatattagatgaaaatggagaaatgagatttggaaagttagcaaaaattattatacattcaggtatggctgagtctagttttatagtacaaaagattttaaaaagaggatgtgttgagtataaggagtttgatgggactgagttgtttgtaagtcctagaactggatattggaagttggtagattaatttttagggcactgattttaaagcttaggctttgagttagtgcttttttatgtgaaagtttagtttggctttgggggggagtttgaggttatatagcgggctttaacgtttcgtcggattgctatatagcctctaactttttattcttcaataaatttggtcaattcttcattaaatttctctcgctgatcatagaaagatgcgtgaccgctaaactcaaatggtataagttttgaatttttaatatattgattttgtattttagccagtggaaatggaacaactttgtcatgaatgccatgaataattaaagttggaacatttattgtttctaagtcagaaaacagtacttcctctatccaagtatttgcgatagccgcagttgcccaaccagccgcctgaaagcctaattgaaggaaccaatcagagaatggttcagttatatactgaaagaaaaaagtatcaccgaaatcactcagcattttaggtcgatcagtgtatgtttcctcaattattttgattacatcctctttttctaaaccatatgggaaatttggacgtttgataaggctaggagctgctgctgcaaaaagagcaagtttagatactccgtatcctttatggcgagacatgtatcgaatagctatagctccccagtcgaatgacctgccagtgtgaaatcatgtaaatttaaagcattaactacacatctaacatcgtctgataatctatcatagtcgtaacctgtataaggtttatctgatttaccaaatcctctcatgtctataccaatacatcggtatcccatttttggaagataattaaactgatattcaaataaattatgattcccaggccacccgtgtagaaataagattgtcttatcgccctctggattaagatcctctacataaacttttacctttgattctactttaacataatatcccatacaaacacctccattaatgaaaatcatttattaataggttattcttctagacataagtatgtgagttgtctgtttattttataaagataagcattaaatttcatattggttttacattaaaacactatattatttataaagacaaatattaggagggaaatatatgaataaaagtaaattaaaaaagagtgtgacactattattatcagctataactatatttttaatagttgggtgtacaaattcaggaaataatgaccaaaatatttcatctagtaatatttttaaagagatgcaaactacagatattaatgggaatacagtagatagttctatcttctcagaaaagaaacttacattagttaatgtatggaatacagggtgtactccttgtatagatgaaattccagttttagacaaattaaataaagagtatgagaaaaaaggtgtttcaataaaagggttattgttagagtcaggggtaggactaactgaacaagaaaaatcagtagtagaggaaatattaagtaaatctaaatcaagttatcaacagataactatgtcaaagaagatgttagaagatgatatttttaaaaacatagcagcatttcctaccacattttttatagacaaggatggaaatattgtagatcaaatagatggttctagtgattatgaaggatggaaatctagaatagaagacgtattaaaaaaggttgatataaatgagtaaatttatgagaaaaaataaaataggcatagctttaataatcttaggtgctttatcattatttcttggtattcatagaaatgagcatttaactgtagccaaaaaatctaatattatatgtcttgaatgcataggaattggataggggatagctatgaatttaataaccaaaataaaatctaattttagactaatttttcaaattgtatttacagctttaactaacggttacttactaggatatatgaatggtaagatatataaagggaatagtaaaaaactatgtgtaccagggttaaattgttattcttgcccaggtgcaatagcatcttgtccgattggatctcttcaagcagttttgggaagtagagattttaaaatttcgttttatataataggttttttaatgattataggtgcatttatcggaagatttgtatgcggttggctatgcccatttggattagtacaggatttattatataagatttcatgtattaagaaaataaaaaaagtacctaatgataagtacctaaggtttttaaaatatattatattagtagtatttgtaattatattgccattatttatatctaactattcaggtgatgggaagccatggttctgtaaattaatttgtccttctggtacactgcttgcaggtataccacttatatcaatgaatagttcacttagacgtataataggacctctatttgcttggaaaatgttaattttaataagtattattattttatcgattaagatatacagaccattttgtaaatatatatgtccgttaggagctatatatggtttatttaataaatattctatttatagatatgaaatagaccacaataaatgtactaaatgtaatttatgtcataaaaaatgtgatatgaatgtaattgtgcatgagacaccaaatagtgtagaatgtataaggtgtggaaagtgtatagacgtatgtcctaaaaatgcaataacaactactttttctcaatctaaaggtttaaaggagaagttaaatatttaaaatttactaatggcaattataatatactatattatgttttgcctatattaattaaaataataatgagggtattaaaagtgaatgcaaagatattaattgtagaagatgaaagagatataagagaaggaataagtgaatatttatctgaggtgggatatgaagttatggtagccgaagatggacaagaaggaatagatttatttaaaggaagtaaatttgacttagtagtattagacataatgctaccaaaattaaatggatttggtgttttaaatcaaatcagggaaataagtaatgtaccagtaattatgttaactgctatgagcgatgattatactcaaattatgagctttaatgaaaaggcggatgattatataactaagcctttctctgtaataatacttcataaaagaatagaggcactattaagacgtagtcaagatgtagaaaatacaaacaaatgggtgtataaagatatagaggtagatttcttaggtttttcagcaaaaaagcaaggagaatcagtagatttaaagccaaaggaaattaaattattggagctactattaaaatataaaaatcaagtattaactaggggtcaaatattagacaatttatgggatattgatgaagctccaactgatcgtgtaatagatgtgtatattaaaaaccttcgtaagaagttgttgatagactgtattgtaacagttaaaggaattggatataagtttgaggagcagatatgaaaaaattaaagctatttcaaaaaacttatttatttacaatgatattaatggggataataattattatctctcataccttactatatatgctattacctacattttatattaataaaaagcaacaagacttagagaatattagtaggcaattgatagaaaagttagaagacagtgatgaaaatgctagtaagagtatagcaaaagattttgctaatagatataatgttaatatttcattaactataaaagatgaaacctccgtatttgaaggtattaagcaagctgatgtgtatatagagcctgaattacttaatgaaaaacctttaataattcctgaagtagaaaaagttataaactcagaaggagtaaataatttacctaataaaatagaacaaaatgctaattacttcaaggcaaaagtcaactcaataattactaataaaaaatttaatacattaggtaatataaatgggtccgtaaaaattgtaatggatttacagtcttttaaagaagctagaagtattgtatttatgatattaccctattctatagggataagtttagttatttcactatttgcatcatatgtttatgtaaaaataataactaatccaataaaagaaatatgtgaagtaacaaaagaaatgaaggacttaaataaagatgcttattgtaatataaatacaggtgatgaaatagaattattagcaaccaatataaatagtttatataaaaccctttggaatactatacattctttaaaacaagaaattgaaaatgtaagtaaatctgagcaaagtaaagtagactttttaagaagtgcttctcatgaacttaagacacctcttatgagtattcatataatgttagaaaatatgatgcttaatattggaaaatataaaaatcatgatgtttatttacctaaatgtaaggatgcagtggttgatttaagtaacatggttcaagagatactagatacatcaaggctaaatactttaagtgagcatagtgaatataaaattataaacataaaaaatgtattagagaaaactatagagccatataaaataacagcaaaatataagaatattaacatgagtattgattattctaattcattaaatataaatacagatgaaagtttattaaagaaagctttatcaaatattatttctaatgcagtaaactatacagattcaggaaaaaatataaatatatactttaacaacaattcattgattatagaaaatgaatgtgagccaatctcaaaagaacatttagagcgaatatttgaagctttttatagagcggaatttgatagaaataaaaatactggaggaaatggattaggtctatatattgttaaacagatattaaatacattagatataccatattcatttgatgctactgaaacaggtatgaaatttactatgacttttaaataatataattgtatagaaactattaaagaacacttagcagtgttcttttttttagaaatagaagaagaaatatataaaatacacatgattagttatttaattttatatttgtttcacattggaattatattatttagctataaacaaaagaaatattatttaaggaggataaataatggacgtactaaagagagcttggttatatataactaggaagaagaagaaaagtttaataatgctatttatattatttgcaatagctacagctatattaagtggtatagcagtaaaaaaagctacaaatatagcaaaagagaatgctacctcagggttaagcaacttctttagtataaattcgcaaagaatttcaagaaaaactatagaagagatattaaagattaaagatattaaaaactataatgcatcaatagatggtggaggaaatattgatgggcttaaaaaagtaaagccaactaaagaagcaccatatgactatgaaggattagaaaaaacttttatagcaactggaaatgatgatacagaatcagatcttaagtttgttaataagagtattaaattagttgaaggaaggcacataaagcctggagataaaggcaaagtgctagtacataagagtttagctaaacttaataatttaaagataggcgataaattaactataaataaaatgcatggaagagatagtcatgcagttccaggaaaaggtcaagatcaaatgacacttgaaattgttggtatatttgataatgtaatagaacaagcagaaagagaagggacttatttagatttaatagaaaattatttattaactgataataattctatacaagagttttatggatatacagataatgatgatgtattttatacaacaagtttctatgcagataaaaatactaatatagattctgttatatctaaggtaaaacaattacctataaacttaaatggtgcaagaatcgacaagagcggggatatattccttgcattatctaagtcatttgagacaatggataaaatagtaaatatgatgttaatcggaagtacagtaattggtgtagttatattatcactaatattaacattctggattcaaggaagaattcatgaaacaggaatattattatctattggagtttcaaagtttaagataatagcacaatatataagcgaattattgataattagtgtattagcatttagtttatcatatttctcagggcaattaatagctcaaaatgttggggattcattaatgcaaaaggcagcaaatgaaactgtacaaagtataaaacaagaagctggatttgctttaggaaatgaccctgacactaagatgcttactcacacatcaaaagatatagaagttaaaataactcctaaagaaatggtatatgtatgggctgtaggatcagcagttataactgcatcagtagctatatcatcattatctataatacgtttaaaacctaaagaaatattatctaaaatgagttaggagtgaagaatatgtctattttaaaattaaatcaaattgattattcatataaaaatggaaaaaatgtattaaaaaatataaatatggaatttgagcaaggtaagttctatacaattttaggtacatcaggagctgggaaaagtacattattatccttattagcaggattagatgaacctaaaaatggtcaaattttattcgaaaatacagatataaaagaaaaaggatatgaataccatagaaaaaataatgtatctttagttttccaaaattataatttaatagattatttaacaccattagaaaatataaaaatagtaaatccaaaagctagcaaaatggatttagaggtacttggattaaaagaagaagagataaatagaaatgttttacagttatcaggaggacaacaacaacgtgttgcaatagcaagggcattagttgctaattcacctataatactagctgatgagccaactggaaacttagatagtgatacagcaagtgaaattgtagagatattaaagtcaagtgcacatgaacatggaaagtgtgtaattgttgtaactcatagcaaagaaatggctaaagaagctgatgtgatactaagattaaaaaatagggatttagtagaaatttaaatttataaaaaggaggattaattatgagaaaatatagtaaacaaaataagaattttatagttgtagtattatatgttatatcttctattacagctatatacacattatttagtatatataattcatatatatacatttcgggacttgtaaataacaagggtttagttataagtgaacagttaatgagtgttatatcttattacataaatgcatcgatgccatatgtattttatactatagctatttgggggataggttatattatatataagctagataacttaaaaatgtatgaggcaaatagtgaagataatcaggtagaaaagtatattgatatggaaaaagctgagcaagatttagattcttttgtcagtacattgaaaagtaaatagtatttaataacaaaggaaaagctaataaataatagttaagaaaatcgtctcaaccattgaaatctacgaaaaggtattgattaaaaaatcaataccttttttatttttaatatttataatagattaacactaatccattcttcaaaataattcatatataattaaaaagctataatatatgaaacttatgattttcatagagttataggtgttaataattagttaaaatattaaaaataatgtaataaattcttttttatactttaaatttatccaattaagatatattataaaaaagaatgtatatgttaatattttattatattaatgttaattttataacatacattaaagtaatatattggagggaaaatgatactttacgagagaaaacataaagaaatagcaaaagaatatgcttatagggttttaaaagataatattatgtatttagatttaaaaccaggggaattattaagtgagtctaatttatctgaaaaattaaaaatttctagaacaccaataagagaaattttaatgaaattaaaaaatgaacaccttattgaagttaaacctcaagcaggtacttatgtatcactgatagatatggaccttataaatgaagccatatttatgagatctgtactagaaaaagaagttttaatacaagcttgtaatacatttccagaagaattatttatagaattagaaaaaaatttatttgcacaaaaattagttgttgataaaccaggaaaagaaatcgagtttcatgatttagataaaaattttcacaagttaatattcttaggatgtaataaagcaaatatatgggatgctattatgaatataggcactcactacaatagaatgcggcttttagctgaaatgaaaagcaataaaatgcagataataaaacagcatgaagaaatgctagatataattaaaaataaagaatttgataagatagatacgtacataaacaaacatatagtagaacctgcaagtaaatgggaaacattaataaatgaaaatgaagaactaaaggcgtttttcaagtaaaagtatataaaacatacatcaataaattacaagtgtatgttttatatactttttatttgtaactaattgtagaaatatttgtaatttattgtaaaaattttaggaaaaggtattgcattggtaaaattgatatgctagtatacaagtatatcataagagtggaggtacaatatatgaaattaccatttagtattgacttaaaagataaggtagctgtagtaacaggtggtacaggtatactttgtggggctatggttgatgctttagctgaatgtggagctaaagtagctatacttgcattagggaaagaagcttgtgaagctaaagctaaagaaatagtagacaacgggggatgtgctataggtatagaagctaatgttttagataaagaaagtttaaaaagagcacatgagataattttaaaagaatttggcccatgtgatatattaataaatggagctggtggaaaccatccaaaaggaactacaactaaagaatacttacttgaagaagatttagataatgaagaattaacatcattctttgacctagatcaaaaaggggtagagtttgtatttaatttaaatttcttaggaacattacttccatcacaagaatttagtagagatatgataaatagagaaggatgtacaattataaatatatcttcaatgaatgcatatactcctcttactaaaataccagcatactcaggagcaaaggctgcagtaagtaattttactcaatggttagctgtacatatgtcaaaggttggaataagagtaaatgctatagcacctggattctttgtaacagctcaaaatgaaaagttattatttaatgaagatggaactccaacagaaagaagtcaaaaaatattaaatagtacaccaatgggaagatatggtgaagctgaagaattaataggaacattattatatttagtaagtagtgaggcatcaggatttgtaaatggtgtagtaataccagtagatggagcatttagtgcttactcaggagtataggagatagattatgttaaatactataaaaaatgagggaattgttgcagttataagagcaaaggaccatgatgaagctaaaggatatattaatgcttgtgtaaatggtggaataagagcagtagaattaacatattcaatacctaatgttgttgatttaataaatgaattaagctgtgatgaaaatcttatattaggggttggaagtgttttaaataaaaaaatggctaaagatgcaattttagctggagcaaaatatgttgtaagtccagggtataatgaagaagttaataaagtatgtaaggaattaaacactctttatttaccaggatgtatgacagtaactgaaataatgaatgctatagaaaatggaaataaaatggtaaaattattcccaggagacgtatttggacctaaatatgtaaaagctataaaagctccaataccccatgttgaaataatgccaacaggtggagttagtatagataatgtagataagtggtttgaaatgggagtttcttgtgtaggagtaggtagttcattatttggagcaggaagcttagaagatatagaaaaactagctaaagaatttgtggagaaaataaaagatgttaaaaacaaataataaaaaggttttaggatttggggaaataatgctaagacttacacctcctaataatcaaaagattatacaagttaattcatttgatgcaacttatggtggaggagaagcaaatgtagttgcgagtttagcaagttttggacatcaaactaagtttgtgacgaaattacctaataactctttaggtgataaagttataagagacttaaggggttataatgtagatacaagtgacatattacaaggtgatggaagacttggtatttattttttagaaattgggcatggacttagaagcactgaagttatatatgatagaaaatattccgctatatctatggctaataaagatgagtttgatatagagaatatgctaaaagatgttaaaatggttcatttatcagggataacaccagcgttaagtaaagaattatatgaattaactatagagatagcaaaatattgtcataatactggtatactagtatccttggattctaattatagagcgaaactttggagcttagaggatgctaaaggatttttagaagaaatacttccttttgtagatatagcttttttaggaagtttagatatgacaaatatattaaaatatgaagatttaggtttggaatttgaagataaccttaaaaatttatataaaagattatttgaaaaatatccaaatataaaatatgcagcttgtacaaagagaactgttcattcaataaataataattcattaaaaggttatttatttgataatgaaaacttatatagttcaaaggaatacaaattcgatatattagatagagttggtggaggagatgcatttacagcaggcatacttcacggaattttagataatttagataaaaaagatatcatagagtttggagtttgcgcaagtgcattaaagcactctataaagggtgatataaacataatcgataaagatagtgtaacaggcttgataggaaaaggattacaaaatataaaaagataattggggagaataagaatatggaaatgacgtttagatggtatggaaaagatgaccctgtaaagatagagtacatcagacaaatacctggtatgaaagggatagtaactgcaatatatgatataccggtaggagaagtttggccattagaaaacatattagagttaaaaaagactgtagaagacaatggactaaagctttcagttatagaaagtgtaccagttcatgaagatataaaattaggtttaccaactagagaaagatacatagaaaattacaaggaaacattaagaaacttaggaaaagcaggtatagaaacagtatgttataactttatgccagtatttgattggactcgttcagatctaagctatgagcttgaagatggttcaacttgcttaatatatgatgaagaaacagttaagaagatggacccagcattaggtgaattagaacttccaggatgggatacatcttatggagaaggtggattaggtgcattacttgataaatacaaggatgtagatgaagaaaaattatgggaaaacttagagtattttataaaagaaataatacctgtagctgaagaaagtaacgtaaaaatggctatacacccagacgatccaccgtggggaatatttggacttccaagaataataactaactttgaaaacttagaaagatttataaatctttatgatagtgaatataatggtataactttatgtacaggatcattaggatgtactaaaactaatgatatagtaaaaatggtaaattactttggtaaagaaaagaacagaataaactttgcccatttaagaaatgttttaataacaggagatagcagtttcaacgaagttgctcatttatctgaggcagggtcactagatttttatgaaatagtaaaagcatactgtgattatgaatttacaggtccatacagaccagatcatggaagaatgatatggggagaaactggaagaccaggatatggattatatgatagagcactaggagctgtttatataaacggattaatagaagcaataaataaaaataaataattaaaataattaagtagtgttttaaaataaattttattttaaaacactacttataaaaatagcataaaaaagtaaaaagtgaaaactaaaatactaatttaggagaaaattatgaaaaagtttatggaccaagattttatattatcaaatgaagtagctaaaatcttatatcataataatgcttcaaaaatgccgatatttgattaccactgtcatttgccagcaattgaaatagcacaagataaagaatatgaaaatgtaactcaattatggttatatcatgatcattataagtggagagcaatgagaagttttgggatagacgaaaagtatataacaggggacgctagtgattttgaaaaattttatgaatttgcaaatatgatgccttacttaataggaaatcctatatatcattggacacatttagaacttaaaagatatttcaatgtagaagaaactttaagtgcaaagactgcaaaagatatttgggaaaaatgtaataatgctatagttaaaaataatttaactgcaagaaacttaatccgtatgtctaatgtagtttacataggaactacagatgatccaattgatgatttaagataccacaaagaaattaatagtgatgatagttttgagtgtgaggtaagacctacatttagaccagataaagcattaaaaatacaaaatgaagatttctgtgattatataaagttattaggggaaacagaaaatacagaaattaaagactatgataaattaatagaaatattagaaaaaagattaaattactttgtagaaaatggctgtaatataacagatcatagtttagaaagagtttattttaaacctgctagcaaagaagaagtcgaaaatatttttgttaaagttttagcgaaagagaaaataagtatagaagatgctcaaaaatacacaacatttacattaatagaattagggaaaatgtatagtgaaagaaacatggtaatgcaacttcacataggggcgcttagaaataataatactagaatgtttaatgctgttggagtagatgcaggatttgatagtattgacgatggagaaatcgctttctcgttatcaaggttattagatagcttagatgtagaagataagttaccaaaaactatcctttattgtttaaatccaaaagataatgaagtattaggaactatgataggaaacttccaaggaggacaagttgcaggaaaaattcaatttggatctggatggtggtttaacgaccaaaaagatggaatggaaagacagcttatagcactttcacaattaggtctagttagtaagtttgtaggaatgcttacagattcaagaagtttcttatcatttacaagacatgaatatttcagaaggattctttgtaattatttaggagagttagttgaaaatggagagtatccatatgatttagaaacattaggaaatatagtagaagatatatgttacaacaatgctaaaaaatattttacaaaataatcctagggggaatttaaatatgaataaaaggattaaagcgcttttacttgtggctataactagtttatcggtagttggatgtagttcaagtaaagataatgaagcaagagttatgagagttgctcacaaccaaggtgaggatcatccaatacatctagcgttaaaaaagtttgaggaaattgtagaagataaaactaataatgaaatagatatacaagtatatccaaatgaattattaggtggacagcgtgagtcagtagagcttactcaaacaggagctatagatatagctgttggaagtataagtttgcttgaaagttttaacaaatcatatagtgtatttaaccttccatatttatttgatagtaaagaacactaccattctgtgatgaatgacgaaaatataatgaacgatatatatgaatcaactagagaatctggatttgttggtcttacatggtttgatgcaggttcaagaaatatgtacacaacagataaacctataatgaagccacaagatttaaagggtaagaaaataagagtacaacaaagtcaaacaaacataagaatgatggaattattaggtggttctgctacaccaatgagtttcggagaagtttatactgctcttcaacaaaaggttatagatggagctgaaaataatgaattagcacttactaataataagcatggagaagttgcaaaacattattcatataaccaacatggtatgattccagatatattaataatgaatgctaagctattagaaaatttaagtgaagaacatagaaatataatattagatgcagttgacgaaataaataaatttgaagttgatgcttgggaagataaagtaaatgaagcagtagaacaatcaaaaaagatgggagtaaaattttactatccagatatagaaccatttaaagaaaaggttttaccacttcacagagaactgactgaaaaagacaaagaagttaaagctgtatacgataagatacaagcaaaagcaccaaaaagtaaataaatactagtagggaggaacaaaggtgaataaattcagaaatatattaaacaaagtaatagaagtaatatgtattacactactagcatttatggtagttttaggtacttggcaaataataactcgttatgttttaaataatccaagtacagtatcagaagatttactaatatattcatttgtatggatgtctttactaggttcagcttatgtatttggtaaaaaagatcacatgactatggtgttttttagacaaaaacttgaatcaaaaagtcctaaggtaaaaattatattaaatgtaattacagaattactagtaatgatattttcagcattcgttttagtgctaggaggattccaaataagtatgttagctatgggtcaaatatcaccagcactaggaatatctatgggatatatatatttatcacttccattatctggagtgataacaatcatttacaatatattaaacttaatggatttaaagcaagaaatcgctcaatcaaataaaaagaatgtaaatgttatgtagaaattaaaaataataattaatccgagggagataagattatggaattagcatttcaagcaggttcagctatagctattgtgtttcctatactacttttattaggaataccaatatctgtgactatagggatagcatctatatttggaataatcactacactatcgtgggatgtagcagtattaactggggcacaaagaatatttacgggaataggtagtttctcattattggcaataccatttttcgtattagcaggaataataatgaataatggtggtattgcattaaaattagtaaatttcgcaaaaatattaagtggtaaattgccaggatctttagctcatacaaatgtagtaggaaatatgttatttggagcagtaagtggttcttcagttgcagcagcggcggcaatcggtggaacaatggctccacttcaagctgaggaaggttatgataaaaactatagtgcagcagttaatatagcctctgcaccaactgggcttttaattcctccaagtaactcacttataatatattcattagtaagtggaggaacatcagtagcagcactgtttatggctgggtatatacctggtatattatggggattatcagtaattatagtagcatttatacttgctaaaaagtataagtattcaaataaatataatataagctttaaggaagctatgaaagtatttatagaggcacttcctagtttagctttaatatttataataataggtggtatagtaggtggaatattcacagctacagaaggagcagctgttgcagttgtatattcttttgtattatcattctttttttataaatctataaaagtaaaagatattccaagaatattattagaaacagttgaaatgacaggtataatagtattcttaataggtgtatcatcaataatgtcttgggttatggcatttacaaatattccaagtgcaataacagaattattattaggaatatcttcaagtccagttgtaatattattaataatgaatttaatattattaatagttggtacatttatggacttaactccagcaatattaatatttacaccaatatttttaccaatagctaaaaactttggaatggatcctatccaatttggtataatgcttatatttaacttatgtataggtaatataacaccgccagttggaaatacactatttattggatgtaaagtaggtaaaacaaaaatagaagaagtaataaaacacttattaccattttatataggtatattggttgtacttatattagtaacatttataccagaaataagtttatttatacctaaacttatgggaatgatttagtataaaaaaacttaataatataaaaaagagatattggataattagtctaatatctcttttattatgaccacaaccaactgttacttgaagtaataatgattcagattcaaatggtggacgaaaagttggtcttgtatatttcatgaaaattcactcctaatttcttaatatattaatttatatatattttactataaaaaaaatatatagtagtacacactttaggtaagtaagaagttcaaaatgaaatagataggatgtatttaaagtttattatgaagttagtttataattatttatttttacacaatattgaacatatataacttcatatgctaatctatataagagaataattgtaaaataatataaaaagttataaataaaatacatatcaaaaaacaagaggagtaaaacatgaaggaagaaataacaaaaccattaggcgaagtaacttcagaaaaaataataaagttaatagtagaccacaacctaaaaataggagacaaattacccaacgaatatgaactagcagataaattaggtgtaggtagaagtacaataagagaagcaataaaagcactagtatcaagaaatatactagaaataaaaagaggttcgggaacatttataagatgtggggtagcagatgatccattaggattaatatttgtaaaagacaaactaaaactagcggttgacttactagaaataagatttatgatagagcctaaaatagcaagtttagcagctataaacgcaactaaagaagatatagaagaaatgtcaaaactatgtgatgaagtagaagaacttatattaaatggcataccacatatggaaaaagatatagaatttcatacagcaatagctagaagtagcaaaaacttagtaacaacaaacttagttccaataataaataaatccatatcagtatttatagacattacaaatacacaactaaaaaatgaaacaatagaaacgcatagagaaattttaaatgcaataaaaaacaagaatgcaaatgaagcacatgatgctatgttacttcacttagcatacaaccgtagaaatataaacaggatagtagctgaaaacaaattaaataaataaaacaaaaatacatctgattaatcggatgtatttttgtttttgtatctaatgatatgtcgattaaaactgcttgaatagcttaggaaaaagttttttatggaaaaatagataaaatattgtaaaaatacatcagacgtgttaatattaagaaaagaaagacgtctgacgtattataaaaaatcaataaggagagtaagatatgattagtcaagaagttagaaaaatagctcctgaaatggatcctttaagaagaggtatgggatggagtgtggatgatttatctaaaccacaaataataattgaaagtacttttggagatagccatccaggaagtgcgcaccttgatatatttgtaaatcaagctattaaaggtgttaatgaacttgggggaaaaggttctcgattttatgcaactgatatatgtgatggtcaagcacaaggccatgatggaataaattattcgttagtatcaagggatatactagcagctttaatagaaatacatgcaaatgcaacgccttttgatgctggagtatttatatcaagctgtgataagggagttccgtctcatttaatggcaataggtagagtaaatattccatcaatagttgttactggtggagttatggaagctgggcctaatttacttacattagagcaaataggaatgtatagcgctatgtatcaaaggggagaaataacagaagatgagttaacatattacaagcataatgcatgtccttcatgtggtgcatgttcatttatgggaacggcttcaacaatgcaagttatggcagaagcattaggattaatgttaccaggaagttctttaatgccggcaacatgtaaagatttagaagatgtagcaaaagaagcaggacgttatgctgtgaagttagctaagttaaatttaaagccaagagatatagtaacttataaatcttttgaaaacgctattatgattcatgcagcaatttcaggttcaagtaattcattattacacataccagcaattgcacgtgaatttggaatagaacttgatgcaaatgaatttgataaaatacatagaaatataccgtacttactagacatcagacctgctggaaaatggccagcagagtacttctactatgctggcggagttcctgcaataatggaagaaataaaagattatttacatttagatgttatgacagttacaggaaaaacattaggtgaaaacttagaagatttaaaaacaaatgggtattatgaaaagtgtgatgagtatttaagtaaagttggattaaaaagagaagacgtaatacgtaaaaatacaaatccaataggtgacaatggtgcaatagctatacttggaggtaatctagcaccgaaaggagctgttgttaagcactctgcagttccaaaagaaatgcacaaagctatattaaaagctagaccatttgatagtgaagaagaagctataaatgcaatattaacaaaagctataaagccaggtgatgcagttatcataagatatgaagggccaaagggaagtggaatgcctgaaatgttttatacaacagaagctatatcatcagatgaagaattatcagcaagtatagcattattaacagatggaagattctctggggcgtctaaagggcctgcaatagggcatatatcaccagaagctgcagtagggggaccaatagctttagtttgtgaaaatgatttaatagaaattgatatagaaagtagaaaattacaggtcataggaattaatggtaaaaaatgtagcttagacgaagttgaaaaagtatttgaagaacgtagaaaaaattgggttcctaaagaggaaaaatacaaatcaggaatactaagtatatactctaagaatgcagttgatccaatgctaggtggatatatgaaataattaaaaatcaattataaaatgggggaaaaatatgttaacgggaccattattaataggtgtatttttattagcaatcgctatattattagtttcaataataaagtttagacttaatgcatttatagcattattaataacatcattagtaacatctattttagttggaatgccaataggagatatagcctctactatctcaggtggatttggttctacattaagtggaattggtatagtaactggattaggtgtaatgttaggaaagttcatgtttgaatgtggagcaatagaaactatatctaatgcaatacttaaaaagtttggcgagaaaaatagtccatcagcaatagctatatcaggatttttaactgggataccagtatttggggatgtagtatatataatgtttgcgcctatgttaagagtgttatctagaaaaactaatatatcaatggtaacattcgcatgtgcaatatcagtagcaacaacttgtacatattcattagtaatacctacaccagcaccacttgttgtttcagaaagtttaggagtagatgtaggaatattctttgtatatgcaattttaacagcttttgtagcaacacttacaggtggaatattatatggaaagtttttagataagcaagataagaaaaatggacatttctatacttttgaagatatagaagaagtagaagatgaattagaagcgactaaagaaactagagctatgccatcttttatgaagtctttatcaatcttattagttccaataatgcttatacttttaggaagttttatacctttagcattgggggatgacaattcggtagtacctttgtttaagttcttgggagataaaaatgttgcaatgttaataggtgttatatatgcagcgcttatatcaaaaccttatataaatagaagtatatctgatattatgaatgacgcagctgaccaaattggtcttatattactaataactggagcagggggagctttcggaaaagttctacaagcgacaggaatagcagattatatagctggttcattatcacaatttagtataccaatattactgctttgtttcttaatatcacaaattatacgttgtgcacaaggttcaacaacagttgcgcttatgacaactgcatctatattaggtggaacaatagcagtaagttctgtatctcctgtattatgtgcaatagcaatatgtgcaggtggaatagggttatcacttccaaatgattcgggattctgggctataagtagattctttaaaatatcagttcaagacactataagaggttggacagtaggtggatttatagcaggtttatcagcacttgcatttgtatctatactatctttattccaaaactttttaccaggtcttatgtaattagatttttaatatataagtttaatcggaggaatttattatgaaaaagatgaaagttttaaaagcactacaagagtgtggagtagttgctgttgttcgtggaaacacaaaagaaacaggaataaacattgcaaaagcttgtataaaaggaaatgtaaaagcaatagaagtaacttatactaataaatttgcaaatgaaataatacgtgaattaagtgaagaatttaaaactcaagatgatgtagtaataggagcaggaacagtactagaccctgaaactgcaagacttgctatattacaaggagctgaatatatagtatcaccatcatttaatttagaaactgctactttatgtaatagatataaagtagcttatataccaggagttatgactataaatgaaatagttttagcacatgaaagtggagtcgatgttattaaattattcccaggaagtgcatttggaccaagctatataaaagctataaaaggaccgcttccatatgcaaatgtaatggtaactggaggagttaacatagacaacttagatacatggataaatgctggagctgatttagtaggaatcggtggagaattaaacactatcggagaagaaggtaaatttgatgaaataacgtcaatatgcaaaaagtatatagaaaaaataaacaaagtaagaggttaatagaatgagagtagctggatttggggaaataatgcttagactagcaactaataaaggttttattgtatctaacacaaacaactataatgcaaattatggtggaggagaagcaaatgttttaatatctttatcaaagtttggtctagatacaaaaatgataaccaaagtttctaataatgacattggagaaggaatcataaattacttaaatagccatagagtaaatactaaccaagttcaaaaaggtgaagaaagaacgggaatatactttttagaagtaggaagtggaaatagagcatcaaaagtaatttatgatagagcaaactcagcatttagtaatatgaaagttactgatttagacataaaaaaagctttagaagatgtagatttatttcatttttcaggaataactttagctttatctaaagaactaagagaattaactatgaatatactaaagcattgtaaaaagaacaatatattagtaagttatgactccaattatagagcaaagctttggactatagaagaagcaagacaggctacattagatatattgcctttcgtaaatatactatcagcaggaatattagatgctgaaaatatattaaaaatgaattgtgaacatgaagataagtatgaaaagttaagtcattattataatgaaataaataaaacttatccaaatataaatcatatgttttcatcaataagaactatacagtcagtatcagtaaacactttacaatgtaattactatactgaaggtaagctttatacatctaaagaatatattatagacgatatagtagatagagtaggtggaggagatgccttaactgctggagtaatatattctatattaaataataaagaagctgagtacctagtagagtttgcaacagcagcatcagttttaaaacatagtatatatggagatgcaaacctagttaatatagatgatgtagaaaacttaatgaaaaacggagctgggaaaatcgctagataattattaaaagattgaatgaatctgattctaatcaatttaaaactgaaaatatgaaatataagggtattgataaatgttaaataaaaaagagatattggataattagtctaatatctctttttttatatttaatctaatttttttagtagataacaaaaaagttataagagttatttttataggaggatttttttgatatataaatgaaagttaaatagtatagcaatcataattttataagtataaaaataaggagggaagaaatataatggaaataaaatcaaattacgagattcaagcagaaaaaagtaagttagaatttataaagtgggatcatataaaaattgcaaaaaagtttaacttagaatatgatgaaaattatttatatatttattttttaaagcaaaaatataggctaaataaaactacgggaaatattgaaaaaagctatgatgaagtaaactacattggagcaaaacataatgaagttatgactattttagatttacttagttattcaaaagataatttacaattatcaggcaattggacgaatgttactagcttaaagggaacagttcaaacgggtaatattactaatcacaatgatttattttttccatatgctaataaattttcaggtagaataaatgattttaaaaaagcctgtgaaaagttagatgcaaaagaagttaaaaagggtgatgtgggttatataattgatatctttgaaaatttaccattaatggttattttttatgaaaaagattgtgatttcccagcggaatttaaaattttatgggatgaaaatatcttagattatatgcattatgaaactacattttatgcagttttgcatctctttgacagaattgaagaattaatagtaacttaaataaaacattactattaaataggtgaaaaattaatggttaattctataatatgtattcctaataaaaagccacctaaaaaaggtattatcaaaatttcgataataccttttatctattacttaagtaatgaaacacctttgttgtagtattcatccatcatatctttaggaaccatgcttcctccagttgcccaagctatatgagttatattttgtagtttatcttcaagattattatcttttaagtatttcttaccttcttttgaagtaagtatatttaccatacctggaacaccagcaagagcagatggttctaagaatatgttttcgctatcagccatcttagttaataatctgtacatattttcatcagtaacagagtagcatccactcattaatttttctaatgtcttaccaacaaatccagaagctctaccaactgctaatccatcagcagcagttatattatctattccaaagtcttgaacagataccttatcatgctcaccagtcatacatcctatcatcatacatggagaatgtgttggctcagcaaagaagaagtgtacgttatctttgtataaaagcttaagtccgaaagcaactccaccaggacctccaccaacaccacatggtaagtatacaaatagtggatgatcagcatctacttttacgttcatatcttttaattgcttatctaatcttttagcagcaacagagtatcctaagaataagtttttagagttttcgtcatctacgaagtagctattaggatctgcatcagcttgttttctaccttcttcaacagctttactgtagtcagattcgtattctataacttcaacacctctgcttcttaataagtcctttttccattgtctagcatctgcagacatatgaactgtaactttgaaacctaatttagcactcattatacctatacttaaacctaagtttcctgtagaaccaactactacagaatattgagagaagaaatctctaacttcatcactatctaatttaacatagttatcttctaatgatattatgttgtttgctaaagctaaatcttcagcatgctttaatacttcgtatattccacctctagcttttatagatccagatactttaaggtgactgtcacactttaataataagtttccagcaagttctttaccacatatttcttctaacttagctttcatgttatctattttagctattggagactctattattccgttttcaggttgagtttcagggaatacttgagctatatatggagcaaatctatttaatctttcttgtgcatctagtacatcagattcagaaagagaaacattttccatacccttatcaaaagaagtatgaagtggatttatccatatagattcttttaaatctattatttcttgtaataaaggatattcttcgatccaagttgatatttctttgtttaaaacttttgcattagacataatcataaccatccttatattcttattttcaactcttaaatacaaatgtttatatacatttaatttaaaaaattgaagtttatattaattttatttgttaactttattaataaatacttaattaaattttaaataattaaataacacttaattgatactaacatttttttattatttgcgtcaatagaatttaattatttttataaaaattaaatataatttaattaaattgctaagaataagttatattgatataattatgtaataataattttaaataaatgaatgaggtaattaatgtatgaatgaagtagatatatcaagaaacattactgagtatagaaaaaggaaagagttaactataaaggagttagctaacttaacaggtgtaacaccttctttacttagtcaaatagaaaagggaacatcaaacccatctataaacacactaaagcaaatttcaagtgctttagatataccactatttaattttttcataaatgataatccaactgaagatttagtagttagaaaagatagtcgtaaaaaaataatgtttgctgaggatgatagctttgcatatgaattactgactccaaattcacaaggaagtatagagtttatgcttatgaagataccaaaaggggagtcatcttcaaaggaactttttagtcataagggagaagaagtagcttatgttatgaaaggttgtgtgagtttacatttaatgaacacagttattgaattaaactgtggagatagtgtaaaaataccgccacattcaaatcataagtgggagaataataccaatgaagattgtgaagttatatttgcagtaacgcctccgtcattctagaaaaataacttaataaacattaagaaaactccaatttatttaattggagttttttataaagattaaaatatatcacgaaagactttaatgttaagaaaataagaaaaagtgaaaatagttatatttttaatctattaaaattatagaaataaataatataaaaactataataataagtataaagtcttaaaaaataactttaagataaaggggagatattgttatggtgaatagaatagtattaaatgaaacttcttatcatgggtcaggagcaataaaagaaatagcaaatgaagtaaaaggacgaaatttaaaaaaagcatttgtatgttcagatccagatttaataaaatttaatgtaacaacaaaagtaacaaatgtattagaacaatcaaatcttgattatgaaatatattctgacataaagccaaatccaacaatagaaaatgttcaaaatggagttaacgcttacaaaaaatctaatgcagattatataatagcaataggcggaggctcatctatagatacagctaaagcaattggtataataataaacaatccagaatttgaagacgttagaagtttagagggagtatcaccaactaaaaagaaatgtgtacctataatagctgtaccaacaacagcaggaacagcagcagaagttactataaactatgttataacagatgttgagaaaaatagaaaatttgtatgtgtagatactaatgatataccagttgtagcaatagtagatccagatatgatggaaagtatgccaaaaggattgacagcagctactggaatggatgcattaactcatgcaatagaaggatttataactggtggagcatgggaaatgagtgatatgttccatataaaagcaatagaattaatagcaaaacatttaagaggagcagttgaaaatacaaaagaaggtagagaaggtatggcattaggtcaatacatagcaggtatgggattttctaatgtaggattaggaatagttcactcaatggcacatccactaggggctttatatgatactcctcatggtatagcaaatgcaataatacttccaacagttatggagtataatgcagaagtaactggtgataaatataaatatatagcaaaagctatgggtgtggaaaatgtagataatatgagtgtcaaagagtatagaaaatcagctgtagatgcagttaaaaaactttcaagtgatgtaggcataccatcaaatttaaaagatatagttaaagttgaagatatagaatttttatcaaagtctgcatatgaagatgcatgtagaccaggaaatccaaaagaaacaagcgtagaagatatagctaatttatacaaatcattactataagaatttaaataaaaaatagctactataagaaataaatcttgtagtagctatttttttatatagtattatttaaatgttgttttatgtattgcttaggagtaatacctctatgctttttaaacattttaataaaataacttacatcattaaaaccacaatttaaagcaacttcagttatagaataatttgtagtaagaagttgttcacaagcactttctattctataatagtttaaatattctataggcgttttattagtcatttcagagaaaaatctacaaaaatattttggagtcataccagcagcctttgataaatcatcaagagtaagaggactttgatattcactttctattaaagataaaacatttttaaaatgaagtgttttttcttgtgttattttggtagttttatttttatttttgtataaattaaatcttaggacaagtcctatcaaataatacaaagaaccttgagttaaaaattcatacccagttttcatagatctcattgattcgaataaaatatcacaacaaggctttagaccttcaatatcagtagaaataagaggaccaattattttcttttgatttatgatatcttgaatttgttttgtacaagcatgattttgctttaatagtatttttatatcaaatacaatgcactcataaatacaattatttggagtaccaccatgaaacataccatcatgaataaaaattacatctcccttggttgctaaaatcttttcatcgttaattattaatgaaaattctccttctaaaattcttattatttcacactcagtatgccagtgataaggcatattatatcttggatgtgcaggtgttacatgataaaaggcaataggaaagtcaaaagtaccatgttgcttttgttccttataatcaaaatatttcataaaattatcctcccctgtattttatgaaaaataaaaaagtgaatatcattatatttttagactattatatcacaagaaaacgtttattgtaacgtatataattaaattagaaagacaaagagatacataattaatttgatttgaaagtaaaaataaaaaatttaaataatatttggggaggaataaaaaatggcaaaaagcagattaataggagaatatccagtaataggaataagaccaacaatagatgcaagaagaggagttttagatgtaagaggttctcttgaagaacaaacaatgaatatggcaaaatcagcagctaaattatttgaagaaaatttaaaatactctaatggtgagccagttaaggttgttatagctgatactacaataggtagagttccagaatcagcagcttgccaagataaatttaaaagagaaggagtagatataactcttacagtaactccatgttggtgctatggttcagaaacaatggatatggatccaatgactataaaaggggtatggggatttaatggaacagaaagaccaggagcagtttacttagcatcagttttagcaactcatgcacaaaaaggacttcctgcatttggtatatatggtcatgatgttcaagatgcagatgcaacagaaataccagaagatgttaaagaaaaattattaagatttggtagagcagcagtagcagcagcttctatgagaggaaaatcttatttacaaataggttctatatgtatgggaataggtggatctataatagattctgcatttatggaagaatacttaggtatgagagttgaatcagttgatgaaacagaagtaataagaagaatgactgaggaaatttacgataaagaagaatttgaaagagctttaaaatggactaaagaaaagtgtatagaaggatttgataaaaacccagaacatgttcaaaaatctagagaacaaaaagataaagattgggaatttgttgttaaaatgatgtgtataataaaagacttaatgaatggaaatgaaaacttaccagtaggttttgaagaagaaagattaggtcacaatgcaatagctgcaggttttcagggtcaaagacaatggactgacttttatccaaactgcgattttccagaagcattacttaatacttcatttgactggaatggagcaagagaaccttatatattagcaactgaaaatgacgtattaaatggaataggtatgttatttggaaaattattaactaatactccacaaatattttcagatgttcgtacttactggagtccagaggcagttaaaaaagctactggttatgaattagaaggggtagctaaagagtctgatggatttatacatttaataaactcaggagcatcttgcttagatgcttgtggtcaagcaaaagatgaaaatggcaatggagtaatgaaagcttggtatgatataacacaagaagatcaagatgcaatattaaaagcaactacttggaatgctgctgataatggatattttagaggaggcggatattcttcaagattcttaacagaagctgaaatgcctgtaactatgatgcgtttaaatcttgtaaaaggacttggaccagttgttcaattagtagaaggatatactgtgaaacttcctgatgaagtatctgataagttatggaaaagaactgattatacatggccttgtacttggtttgctccaagacttactggaaaaggtgcatttaaatcagcttatgatgtaatgaacaactggggagctaaccacggagcgataagctatggacatataggagcagacataatcacattatgctcaatgttaagaatacctgtaagtatgcacaatgtagatgaagaaaaagtatttagaccagctgcatggaatgcatttggaatggataaagaaggtcaagattatagagcttgtcaagcttacggaccaatgtataaataataatacagaaggtgatatcatggagatgaataactataaaaagaaagtattagcctttgactttggagcatctagtggaagagcaatgcttggagtatatgatggaactaaaataagtattgaagaaatccatagattttcaaatgatcctgtaattgttgggggaactatgtattgggatgtgcttagacagttctttgaaataaagcaaagtttaatcaagtcaaagccatttgggaaaatagatagtatagggatagatacgtggggagttgactttgcattaattgatgagtatggtcaactacttgaaaaccctattcattatagagatggtagaactagtggaatgatagaaaaaagctttgaaaaaatatcaaaagaagagttctatgatataactggtaatcaatttatggagataaatacagcatttcaattattatcattaaaagaaaaaagatcacatctgcttgaaagagcagatgtgatgctcctaatgcctgacttatttaattatttattaacaggtaaaaaggttacagaaaactctatagcatctacaactcaattatttgatgcaaagaatagaacttggtcaggaaaagtaattgattctttaggaatacctaaaaaattatttacagaaattgttcctagtggaactttaataggaaaaatatcagaagatataagtgaagaattaaaaatagatatgagtgatgttattgcagtagcagggcatgatactcaaagtgcattggtatcagtaccagctatggaagatgactttgtatttttaagttgtggaacttggtcacttcttggaactgaaattgatgagcctataataaatgaaaaatctagttattacaatataactaatgaaggtggatatggaaataaagtttccttcttaaaaaatataataggtctttggttaatacaagaaagtaagagacaatgggaacgagagggaaaaacatatagttttagtgaattagaagagttagctaaaagttcaaagccttttaaatgtttcatagatccggatgacccagtatttgttccagcaggaaatattcctgaaagaattagaacctattgtaaaaagactaaccaagaagttcctaaaacagaaggtgaaatagttagatgtattaatgaaagtttagcacttaagtaccgttattcattagaagaaataaaagattgtacaaagaaagattataaaactatgtatatggttggtggaggtatacaaagtaagcttttatgccaaatgacggctaatgcttgtaatatggatgtatgtgcaggaccaactgaagcaactgtacttggaaatatagctattcaattaatggcaacaaataaaataaaagatttaaaagaagctcgtaaaataattagaaattcacaagaaataaactattattatccaactaatgttaaagcatggaatgaaaaatatgaaagtttcaaagaaataattgaatctaaggggatggtaacatgctaaaaaatatacctcaaatattatcgccacaacttttaaaagtattatgtgaaatgggtcatagtgaccaaatagtaatatctgatggaaactttccagcagaaagtatgggaaaagattctatagtaattcgttgtgatggacatggagtaccagaacttttagatgctatattaacagtttttccattagatacttatgtagataagccagttaatttaatggaagttatgccaggagataatgtagaaactccaatatgggatacttataaagaaattatacaaaagcacgataatcgtggtgaagaaacagtaggaactatagaaagatttaaattttatgatgaagctaaaaaagcatacgcaataatagcaacaggagaaaaagcattgtatgcaaacgttatattacaaaaaggtgtagtagtagaataataaaatcaattttggaggcaattattatggaatgtgtaaaaactttaaaatatatggacgtaagagaacaaatctgtgatgtatgtcacaaaatgtggcaattaggatgggttgcagctaatgatggaaatgtaagcgtaaaattagatgatggtacttttctagcaacaccaacaggtataagcaaaagttttataacaccagaaaaattagttcatatagatgaaaatggagaaattttagatggtccagagggagctaagccgtcatcagaaataaaaatgcacttaagatgctataaagaaagagaagatgtaggagctgtagtacatgctcatccaccaacagcaacaggatatgcagttgctcacttagatatggatagatacactatgatagaaactgttatagcaataggatctataccagtaacaccatatgggacaccatctacttatgaagttccagatgcaatagcaccatacttacaagagcatgatgtattattgcttgaaaatcatggagcacttacagtaggtgcagacttaataactgcatactacagaatggaaactttagagctatatgcaaaaataagtttaacagctcatttattaggtggcgaaaaggaaatatctgaaaaaaatataaatagattaataggaatgagaaaaggatacggagtaacaggaagacatccaggatttaagagatatagaaaataatctactataaaaagaatatatgagggggaaacactatggatggtaagttaagtagttctgtatcaaataagcaggagtcaacacctattgttcctaaaaaatatatagcacattttgttatgcttatatcttgctttgtattatggggattattaaacaatatgacagataatctagtaccagcttttggtagaatatttatgctagaggcagcagatgcttcattaacgcaagttgcattttatggttcatatgcagtattagcacttccagcagcaatacttataaagaaatattcatatagaactggtgtattagtaggtctaggtttatacatagtaggggctatggggtatataccagctgcaatatatcaaaatttcaacttattcttagcatcagtttttgttttagcaggaggattatcaatacttgaaacaacttgtaatccatatgtaatttcattaggatcatcagaaactagtgtacgtagacttaacttagctcaagcttttaatccactaggttcattaacaggtattataatggctaaatatcttatattaagtaatttaaatcctgcaacttatgaagaacgtatagctatgagcccagatacattaagtgcaatacgtagtaatgaattattatgggtatgtgtaccatatgtgggattagtagttatagcattaataatatgggtattctttaagaaaagtaaagattcagaaaaggatacatcaggtgaacttaatatagcacattcagttaagaaattagttagaatacctcgttatgcatttggagttgttgcacagtttttctatgttggagttcaaatatcagtatggacttggactataagctatgtaatgactaaccttggattagatgaagcttcagcttcaggatattacttaatagctataatatcatttatagtatgtagatggatatgcacagctttaatgaagtatattgatccagctataatgatggcaatatttgcagtaggtggtatagtatttagtttaggaactatatatttaccaacaaatcaatcagtatggtgtttagtagcaatatcagcttgtatgtcattaatgttccctacaatttacggtatagcacttaaagatttaggtgaagaagtaaaggttggagcagcaggacttataatggcaatacttggtggagcagttataacacctataatgggtaaaatgatagatacaggaatgttatcatctatagtaccagcatttacaggagtacaagcagcagttcgttcatcattcttaataccagtaatatgttttgcagtagtattagtttattctttatgctttagaactaagaaagaagcttaaatataaaatagataaaaaaataagtagattattttattaaacttgtacaaagttataatgataagtcagatataattaagttagaaatatccactaaaccatattgatgtaaagtcaatatggttttttatattgaaattcattgtaagagattaatgtaaagcaaattttttattaataactctatataaaaatattcgaaaaaataaaaagttagtctataattataagtaataaaaagttattactatgaaataattaaataaatataaaataaagaagtgtatatcatataaaattaatagagggtggaatataagttgggatgaggtgaaattaagtgataaaaatagcaatatgtgaagataaaaaagaacaacaagagttgttaaaaacatatataaatcaaatatttgaggcattatatattaaatataaattggaaatatttaattcaggggaagaattacttgaaaactatcaaaatgatactgacgtacttttattagatatacaaatggggcaaatcaatggaatggatactgccagaaaaattaggtcaatagatgataaagtagaaattatatttattacatcattaatagaatacgcactagaaggttatgaggtaagggcttatagatatttaataaaaccagtaaaatatgagaatttaaaagaaaatataataaactgtataaaagaagtagatataaaaaataaatatattatagtaaaagaacaaggcaatcaaattaaattagatataaatgaaataacttatgtagaagtgcaaaaagaaactataactatacatactttaaatgaggtttataaaacaaatggtacaatgattaatattgaaaaagacatagattgtgatagattttttagatgtcataaaagctttttagttaacttagagcatataaaaagtataaaacaatacacagcaatacttgaaaatagtgaggaagtacctgttagcagatataggtttaaggagacaaaagataaattttttgatttaatagaggagaaattatgttagtaagtatatatattttagctgttttaaacatgctaatgtttatagtttcattttttatgctaatgaataaaaaaagttacgtttatcaatataaatttgagagtagatatatacttacaagtatattcttaatttttacaattataatgggcttaggatttggggaaacatccatacaacagatactacggatgtttttaactatatatttgatttgtaaaactttttacaatattgattcaagaaagtctattattgcttcgctaatctatagtttagtttatattttagtagaatgtagtatatattggtttgtacaaatttcaattataaaaatagattatatacttgaaataactcttataggaagtagtgttatttttttaatgagtattcatttttttaatatactagaaaatatctataaaaataagaaatattatttatatattgcattaactactagttcatcctgagccaggatcaaactctcaaataaaagttgtccatcgctcagctatcattatctgaatatctggcttggttgtttgttgtttaattctttaaaaagaatttttataattaacctactgtttaattttcaaagttcttatttgtgtttcttacaaattatactttaccacttaaactttaactagtcaatacctttttatgtttaattttatttttatttacttaaatttattatataatggaaaacgtaaacattttaattataatatatatcattgataggagtgtttaaatgaataaattagaaaataataatttaattattgaaatcaaaaacaatggagccgaattaaccagaatatattcaaagtctaaaaatatagattttttatggaatgctaacaataaatattggggaaggcactcaccaattctattccctatagtcggtagacttaaagataatgagactattataaataaaaatgtgtatagtatgactcaacatggttttgctcgtgatatgtactttgatttaataagccaagatgaaaattcattaacttataaattagaatctaatgatacgaccaaaagtaaatacccttatgaatttgagttaataatcaaatacacacttaatacttcatctatcaatgtaagttggcaagttaaaaataaaagcaatgaagctatgtacttttctataggcgcgcaccctgcttttaacgttccttttgatgatgataatgatcttagccaatactacttaaaattgctatcaaaaaacactataaattcttatatattagaaggtccatttgtatctaaaaaaactaagataaactgtctaaataatttagatataaaacccgaattgtttaaaaatgatgccattatatatgataatataaatgaagtttctatctgttctaaaattagcaatacttctataaaggttaattttaaagatttcccatttgtaggtatttggtcaccttattatgaagaaacccactcaatagctccatttatttgtatagagccctggtatggtatagctgactcagttgatagcaataaagattttaaaaccaaactcggtataaataaactatctataggcgaagtatttaaagcttcttatgaaatagaaatttgtgtataaataaaaaagcacatgaaacattcaaatgcttcatgtgctttattttatttatttatttgcttatttaaccaatctatagcaacatctaattgcttactttcatctttttcttcgatcttaggtttaataccttttttatttatataatctccatttggagtataatattgagcagttgtaagcttatatcctgttccatcatttaaacctctcacagtttgaactagccctttaccaaaagttgtagttcctatagctatacctttattgttatcaactatagctcctgtaagtatttccgatgcagatgcacttcctccatttattaatactactataggtatatctaattgcttcttgtcatcagatttaagatatttagcgttattactattgtctttaactgatactattgtatctccttgaggtaatatttcatcagctatatcttcacatatattcagtagacctccaggattatctcttaaatctaaaactaatccttttataccttttttatctagattacctagagcctttttaaattcatcgtatgtatgttcatcaaatgatgatatttttatatatcctatatcattatccatcactttagattctacagttttcataactatttcttgtctttttacaggtatatttaaagtttcatttcctctctttacagtaagcttaacatcagttccagccttaccttttatcatactcatagctttatccatatcttttgaacttacatctttcccatttaccttaagtattttatctcctggctttattccacttttctcagcaggagaaccctctataggagatactatcgttattaaatcatcatcctctactggacttatcacaactccaatacctacataagttccagatgtctgttctttaagcttttcaaattcttgcttagtgtagtactgagagtatggatcttttaaactttcaaacataccttttaaagccccagttgccaactcttcatcgtttacatttttataaaaatctttatctattgatttttttagccctataaccttatcaaaatctttatacttataccctacaacttgagatgttattaaagccgttgcaataacaagtattatagagtatataattgctctttttttagatatcattaaatgcatctccttttatacaatatactatattagtatatgttttaatattatttttattactacaagcttttttgttgctatagctcaattttaatactaaactttttagtagataataatataccatattataccatattggataggggtgttttcattgaaaagtgattttagaaaaaaagtcatagagcttagaaaaaacaagtcttatgattttataattaaaaattctaataaaataacaactactcttttatcgttagaagaatttaaaaaagcttctacaattatgttatatttagatttcaataatgaagtaaaaacagattacttagtaaacaccttaataaatttaggtaagaaagtattagtgcctataacaataaaagaaaataaaaccttaataccttctgaaattaaaaatttagactcagaaattaaaataggaacttatggtattagagaacctaaaaaagaatttataagagaaaataacatagaatctatagatattcttatagtacctgccgtagcatttgatattaataaatatagattaggatatggtggaggtttttatgatagatttatagaaaaacttagaagcgataccctaacaataggtttagcatttgaatttcaaatttttgattctataccaaaagaaagtcatgatgctcaattgaactatgtcataacagaaaaaagaataataaaataaaatctaatttatattattaaattttaaaatagagtaaagatttcatttattactctttactctattttatattaatcgttatttttcttttttatcatcatcacttttcctatagatttctagttgctcatttacttttttatcaatttcatcaatagacatacctgttaaaatttctaaaccttcttctatagtcgatattgcatatatactaaattctccttgtttcacagcttctataatctcatcttttagcattaagttcttaacattttgtatcggcatcattaccccttgtttaccatttagacctttgattttacagacatcaaaaaatccttctattttttcatttatgccacctattggttgtatttctcctttttgacttacagaaccagttacagctatatattgttttataggtatttgggctatacttgatattaccgcatataattccgtactagatgcactatctccatcaacacctgaatagttttgttcaaatgttatggatgtcgatatagacagtggtttttccttaccatatctttcacctaaataaccagtaagtattaaaactcctttatcatgaatacttccactttgttttatctctctttcaatatttataattccgcttcttcctttatatgttgatgcagttatttttgatggttttccaaaactgtattccccattacccatgacagctaatccatttatttgtccaactttttctttagttatatctattaacagagtttcatctttaaacatctcatttaatttttcttcatatttactgcttctataatttttctgtactatagctttttctacatcctgcttagttacatattttgaatcatggtcactaagtgtctcagactcatatatcaaatctataattttattaaatcttgcagttaacttagttttatcatcactaagtctagcactatattctaatattctttcaatagcacttttatcaaagtgctttaagttatgctctttacattgattagatattaattttataattttatatacattgtcttcatctttatttatttcaaggtcaaaatcagccattattttaaataaatttctaaaatcttcatcataagaatacattatattgtatatatagttatctccaattaagattactttaatatctaaatctataggctctggttttaaagaagacgtaactaaatatccatattgtttgtttaaagattcaatagttattttattggttttaagagatctttttagataatcccatgaaaatggacttgatattaaatctttagcattaattattataaagcctccattagctttatgtaatgctccaggtttaatctccataaagcttgtagtaagagcgcctatttcatttttataatcaatagatcctgatagattataaaaagtaggattattctcatctattaccatagattctttacagtcactgttatcaatcaaaagatttactccatatcttacaaaaaacttagaatcattcttatttcccataagacctaataaagccattggattttgtgaattttcgtcttctgtaattttaaatttacctatattttttactatatcatcacataaatcacttatataattttttactttttcatattctccatatttatctattaagtatgtctcataaaaacctactaaacttttccctacatatttatctaattcatctagcttttctttgtaagattcttcacaaagttttatttcatttatatattctttgctatcttgatttaattttaatccttcttctcttagtgcttttatttgttgtgctgttaaatttccaagttcatcttccccaaggatacttccatcttcttttataggtatacttattaaccctctttctgtaacttcaaatcgaaaccctctaggttttgcaatttcatttaacttactcactatattttgaatattattttcaagctcagtcattaatagtctattatgatattcatactctttagtactaaatattttaggaacttcagccttaagtttttcaactatttcttctatatcctttttaaaaagctttccttgccccgatttaaatgatagagctattggttcgttttgatttttaaaattatatacataagcccagtctttaatattaatattatttttctttattttgtttataagagtttttgtataactacgtctacctgtcccactacacccagcaacatatatgttatatcctcgttgcttcatatttaacccaaaatctatagcttgaactcctctttcttgacctattatatctctaactggttctatatcttcagttgaattaaattttatatgatctaaattacaagtacattttaaatcactcgcatctagcttaaatttatctaaattaaccattcattcacctcatagtatgtattttactatttagctttacctatataatttaaataatgtattttaaattttaaaaattaaaaaaagatatacattgcaatttatttttaaattagcaatgtatatcttttgagtttacttctctgttttagagttaagttctattctatctggtaactcttttaaattggtttctgcaactatgtatggatgtgattcatccttatttttatgtactacttcaactttcataatatttttatcatcttctttagctatttttatagaatttatttctataccatgttctttatctttacccctagtcacaactacatatatcttattttctattttaacagccaaagctctttcttcatctgtatacttacccatcatatcaagtatcttttcaggtatttcatttttttgtaatataatataatctactggctttgattcatccataaacattttaggtataaaaataaatccccctaatactaatatcaaagctataataccatagattactcctttaatattgaactttactttcaatttatcacctcccatataataaaatatatgaacttattttaaagtatagaagatttttattttaaaattaaaaaaagccataaacattattttctctaacattagatactcataagtttacggctatgtatatcagttttattaaatctatttcttagctatagcttcttttacactattaactatatcttcagcagttaatccatatgcttttaaaagttcttttggagtacctgattgtccaaatacatccttaactccaacttttttaactataacaggaccttcttcagaaacaacttcactaactgcagatccaagtccacctattatattatgctcttcagctgtaactataactttagtttctttagctgcatttaatattaattctttgtctataggttttattgtaggcatatttataactctaacatttataccttcagactttaattgttcatgtgccattatagcttcattaaccattattccacaagctattatagtagcatcatttccttctcttacaactatacctttaccgatttcaaacttatagttttcgtcaaatatagtcggaactgcagatctaccaagtcttacgtatactggtccattgtacttagctacttcaaatataacttgctcagtttcaactccatcagctggaactataaccgtcatattaggtatagctctcattatagctatatcttcaacactttgatgagatgctccatcttcaccaactgttacacctgcatgtgtagcacatacttttacatttaatttagggtagcaagcagagtttcttattatttcgaaagctcttcctgttgcaaacatcgcaaaactacttgcaaaaggtattttccctgctgctgcaaaaccacaagcggcacctattaaattttgttctgctattcccatattaaagaatctatctggaaatgcttttaagaagtcatttgtcttcgtagatttagataaatctgcatctaaaacaaccacattatcatttacttgtcctaatttaactagggcttttccatatgcttctctagttgctatattactcattatccgcacctcctaattcagctaaagctttttctaaatcactatcagttggagctgttccatgccaagaagcattattctccataaatgatacacctttaccttttacagtcttagctattatcatagtaggtttacctactgtttctcttgccatatcaagagctgcaaatatttgatcaaagtcatgaccatctatttctataacgttccatccaaaacttttgaacttatccattataggacctatattcataactttttctacttctccatctatttgtaaaccattataatctaggaacgctactaaattatctaatttgtaatgagaagcactcattgcagcttcccaaactatcccttcttgaacttctccatctccaagtaaagtataaactctccatggtgcattatctagtttagatgccattgccataccgcaagccacagaaaaaccttgtcctaaagaaccagtagacatctcaactccaggagtacctttcatatctggatgcccttgtaacatagctcccatttttcttaatgaatttaactcttttttatcaaagtaacccttttctgctagtgttgcatataaaactggagctgcatggccttttgatagtacaaatctatctctatcctccatttttggacttcttgcatctacgttcatttcatcaaagtaaagtgatgttaatatctcaactgcagataatgatcctccaggatgtccagacttagaaccatgtatcatagtaactatatcttttcttatgttacgtgcaattccatttaatactttatggtctctcatgtaattacctccttatatttatgagtaaaactactgtctctatattatgtactttgcaagtgtaccatactaattccatattattatatcactttttgtattttttttgcttaaatttacaaaaaaaaattatcgatatatctactacatataccaataatttaattaaatttgaaataatcctaaacttatttgtaaactattatttactttttccatcatactttgatctagataacctattttctctcttaatctttttttatctattgttcttatttgctccaagagaataacggaatctttattaagcccgtactcattagaacttatttctatatgagtaggtaatttagccttatttatctgcgatgttatagctgcgacaataacggttggactgtacttgttccctatatcattttgaataattaataccggtcttataccaccttgttcagatccaacaacagggcttaaatcagcataatataaatgtccgcgttttatatctaaattattaaaactcaccttgagctataatcccttcaaggttatcatcagaagatacctcatttgtcattcctagctcggctaaagttaaatttatttgacccatttctttatacccttttatcattgtttcttttaggtcaaattttttcttttgtgtgatgtagaattgaaaagcagcttttgcaaaatcttctctattagtattctctatttgaactatgtgatctacttcggaaataagagaatcaggtaaagtaaacacaattttttctttactcatattgtgcacaaaatcgcctcctagggtatactatcatctttattttaccaaataattatattgttgtacaattacatttccttccatataaacacgttcaactctccttgaaatcatgcatagaatctcataatttattgtccctaagtcatcagctattttttctatacattgattttcgttctctgaaaatattataacctcatcatcgacttttatgtctatatctttatctatttttaccatacattgatccatacaaattcttcctacgacatcaaattcttccccttttatataaaccctaggatttttttgcattcttgtaaatccatcagcatatcctataggtattgtagctattttctctttagaattagttatatacttaattccataacttattcctgaatttttttctagctcttttatatgagctattcttgtttttaatgtcatagctggcttaagcttaattatatctttatttacttcatctgaaggataatgcccataaagtataattccacatctaaccatattgaaatttagatcattgcattccatagtagctgcactatttgagacatgcttaattggaatatctatacctatttcatctaatttcttaattactatattgtatttatttacttgattgagcatataccctttgtctttttcatcagccgtcgcaaaatgagtatatataccttctatatttatattctcaagcttatctatcttagatatttcgtttatagaatcttcatttacctgaaaccctatccttcccattccagtatctatctttatatgaactttagatattttttcatgtttctttgatagttcatctataaataaagctgtctcataagaaaatacagttaagcttatatcatttactacagcttcctctaaagcacattctggtatatatcctaaacacaatataggtatatttatattattttgtctaagttctaagccttcttcaagtcttgataccgctaaataatctaccttttctctttctaatagttttgatatttgtactgctccatgtccatatgcattagccttaactactccacaaatttttgtatcttcttttaatatattttttatattttttaaattatattttatgttatctaggtttatctctgcccatgtaggagctgttatatgtttatccattttgtctctccttgctatttcttgtactcaaaattagaataattaactaaaaatcgtttattcccctcttgatctaatatttctaatttagcaggataattttctttcgagtctacaaaaagcttctgcttgttgaaatatttagtgttaccaggtatcggtacagtaagtactaaatacccacctttcatttcaacctctatttcctccccttgaagatagttttttataaaatcacctacaaataaatgttgattgttctgccctgcattaggtagaattaatttatcttttatgtttggattgcttacaattactttatcccctttatactccattacttttccctttagatgtttaggctctattacttttaatttaaatttatcaggactagtgtattcatgtattaaagaatatttttgtgaatttttatttcctataacttctatatctgccttgcatttataagacttcatcttagaaatttcattttgaaaatccttatatacttcttcctttgtggacttacttttttcacagcctattataactgacataaatataattactataactataattatagcccacttatttttcacaaagcacctcctaattttttaaaatctaattttcatacatagattttattatatcgtatctacagatgattccttgtattttattgttttgatctactactggaactctatttacagatttttttatcattatattagctacatcatcaaaagtatcttcttcatgcacttttataacgtctctagacattaagtcttttacttgtgtagctgctacatcttttatatcgtcttccattttcttaaaatcattaagatatataataccttgtaaaaatgttatgtattctggaggatttacatatttttcttttttcattatatctgtttcagatataattccaactactctattctccttatctactacaggcactccacctattttctctgttataagaatatttgctatatcacttatagtatctgtttctttagctactttgacattagtagtcattatatcttttgcttttttatttttcatctttatcactccttaaccattacaatagcatttgctacagcataatttttactatgagatatagatacttttatttctaaaacattataatctatgcaaatttttcttaaattattataagttttaactattggtttaccctttttatctcgtagtatttctatatctttaaaattaaaatttcttatacctgtacctaaggctttacttatggcttcttttgctgagaaattaccagcaatagtttcagtcttaaggccttttgatttaaaataatcaatttcttcttttgtaaataacttatctaagaactttttatttctttgtaaagctttttctactctttctatctctactatatctataccgatatccaatatattcatagatacctccatcgctattataatactattttgttacgaatacccaaatatattcaattcataccattaaatttatttatatagcttaatataatactactacataatatttttttttggtagttccactattatatatattttcatttattgtggttattaaattgcaaaaataaaaagactagagttaaactctagtctttttttataaccattctgcagattcagttaaaataacagcttgttctttttcaacttgtatgaatcctccagaaacttttgcttctttatatttgccttctttttttatctttaaagtaccatctgataatccagcaactaaaggtctatggttttttaatatacctctatctccttgagttgttctaactattatcatttctgtttgaccttcatagaagactttttcaggagtaacaattttaaccgcaaattcgcttgccattattatctactctccttcgctttttcaactgcctcttctatacttcctacgaataagaaagctgattctggtaagttatcatgcttaccttctagtatttctttgaaacttcttacagtttctttaacaggtacatatttacctggtattcctgtgaattgctcaccaacgaagaatggttgagataagaatctttctatttttcttgctctgttaacagttatcttatcttcatctgataattcgtccataccaagtatagctattatatcttgaagttctttatacttttgaagtatagattgaactgatacagctacctcataatgttctttacctactatagctggatcaagaactctagatgtagactctaatgggtcaacagctgggaatatacctagagaagctttttgtctagataaaactgttttagcatctaagtgagtgaatgttgtagctggtgctgggtcagttaagtcatcggcaggtacatatacagcctgaactgatgttatagaccctttatttgttgatgttattctttcttgtaatctacccatttctgtagctaatgttggttggtatccaactgcagatggagtacgtccaagaagtgcagaaacctcagatcctgcttgagtgaaacggaatatattatctacgaataataaaacgtcttgtccttcttgatctctgaagtattcagccattgtaagaccagttaaagcaactctcattcttgctccaggtggctcattcatttgtccaaatactagagctgttttattgataactcctgtatcactcatttcatggaataagtcattaccttctcttgttctctctccaacacctgcgaatactgatataccaccgtgttgagtagctatattgtttataagctcttgtataagaactgttttaccaactccggctccaccgaatagaccgatcttaccaccttttaagtatggtgctaataagtcaacaacttttataccagtttctagtatttcagcacctgggtttaattcatcaaatgctggtgcttctctatgtattgggtttttaggagcactctttggagcttctttaccatcaactggctcacctaatacattgaatattcttcctaaagtttcttctcctacaggtacacttatagctgctcctgtatcaacaacttccatacctcttacaagtccatcagttgaactcattgatatacatctaactgtatcatcaccaacgtgttgtgcaacctctataactatttttttatctccgtgctttatctctaatgcatttaatagattaggtaagcttttttcatcattgaactttacgtcaactactggcccgataacctgaactattttacctatgtttgccatgtcctaacctccttatttattgagctgaagaagctcctgcaactatctcagatatttcttgagtaactgcagcttgtcttgctctattgtattgtaattctaaattagatatcatttcatttgcattatctgttgctgattccatagctgttcttcttgctgcttgttcagaagcataagattcagctaatccaccatatatcattcctgaaacatacttaggaactataaatccaagcacagcgtctggagaaggtaagtattgaactgccgctccactttttttcttctcttcacctttattagcatctacactaactggtagtaatttaactaatctaggctcttgacttaatgcagaaacgaactctgtatatattaatttaacttcatctatatcacctttttgataagaatccattatagattttgatatattcattatatcttcatagctagcaccttcaacagaatctattgatcctattaattcaaaacttcttttgctaacaaattcttttgcttttttacctatagtaataactttagcattttcagatcctttagtttcagcaactaatgatttaaatacatttgagttgtatcctcctgcaagacctctatctccagcgattactatataacatctatttttaacttctctttctttaagaaattcactttttacgccactcgtatttttagctatattttgtacagcctcttttaaagtgttaaaatatgctttagaactttcagccttttccttagctcttctaaatttagaagaagcaactaattccatagccttagttatttgtttagtattttcaacactggcaatacgagttttgatttctttcattccagctcctgccaattgggttacctccttttttaaaaaggattacgcttctataacaaatttctttttgaaatcgtttatagcgtttgttaattcttgagtgaaatcttcatttgcaagaattttttctcctatttgtgggtaattagcatctatgaattctaataattctgtttcaaatctctttatattatctacaggtatatctgctaataagttgtttgtaactgcaaataccattattacttggtttgaaacttccataggttgatgttctccttgttttagaacctcaactattctttccccttgagcaagtctcttcttagtatcttcatctaagtcagatccgaattgagagaatgcagcaagttctttatattgagaataaagaagctttaatggtccagcaacttttttcattgattttatttgagcagatccaccaacccttgaaactgatataccagggtcaactgcaggtcttattcctgaatagaataattctggtacaaggtatatttgtccgtctgttatagatataacgttagttggtatataagcagaaacgtctccaccttgagtttctattataggtaatgcagttattgatcctgctcctaattcatctgataacttagcagctctttctagtaatcttgagtgtaagtagaatacgtctcctgggtatgcttcacgtcctggtggtctcttaagtaataatgacatttctctgtatgcaacggcatgcttagttaagtcatcatatactattaatacatgctttccattgaacatgaattcttcacccattgcaacacctgcatatggagctaagaattgaagtggtgcagattcagatgcagtagcagaaactactattgtgtaatccattgctccacctttttctaatgtactaacaacttgagaaacagtagaacgcttttgtcctattgcaacatatatacatataacatctttacctttttggttaagtatagtatctacacatatagatgttttacctgtttgtctatcacctattacaagctctctttgtcctttacctattggtatcatggcatcgatagctttgattcctgtttgtaacggctcatgaactgattttctagccattattccagtagcttctgattctactggtctgaatttatctgtatttataggtcctttcccatcaactggttgtcctagtgagtttacaactctacctatcatagcttcaccaactggaacttgaactatattaccagttctttttacgatgtctccttcttttattccagagtcatcacctagtataacagcccctaccatttcttcttcaaggttaagagccattccgtatactttacctgggaactctaataattctccagccatagctttttctagtccgtaaacactagctataccgtccccaacttttaaaacacttcctgtatctgttaactctactttattttcgtagctttttatttgctcttttattatagcacttatttcttctggtcttaaattcatgggttcaccgccctcctaagatattacttgagatagttgttctttcattttatctaaacgatttttaactgttccatctatctcttcgtttccaagtctaactagtactcctcctaatatagacttatctacttcattttgtaaaacaactgttttattgtacttagctgaaagtttagcttgaagttcattaacttcgccttcgttcataggaactgctgttatagcaactccttctaagatattatttttatcatttaataaagctttaaacgcttcttccatattagctaataaatttaatctatctttatctgctaatattttcatgaaatttaacatttcattatctaatgttgatccaaatatattagttattaaagtctttttctcttcttttgatacaatcggagattttaatatatttgaaaattctttatttacattgattatatctactacagcctttagctcattatatagcttttcagttgagtttgattcttctccaacttggaataaggcttcagcgtatctgctagcaattatatttatcattgagcctcgcctacctcttttataaagtcatttattagcttttcatgcttagacttatctaggtcactttctataaccttagatgctgcaagtaaagctattgaagatatatcatctttaacttcgttcataactttttgtctttcttgtgctatatctttactagctttttcttttatgcttgtagcttcgtttttagctgtagatactatttcctctgacttttgttctgctcttaaagtagcttgttttattatttcttgtccttgttctttagcagaacttaacttttcttcgtattcttttttgaattcttcaccctcagctttagttctttctccttgagctaagtttgtttgaatttctttttctcttgcttctattatccctaaaacaggtttaaataaaagtttctttaaaattacaaacactaagaatgtatttattaattggaatataagttcataagatactccaattagtggttttaattcaaacatccttattcctcctttctactaatcgcaattcgtaattaggagatggtttcccacctcctagttataatgacttaactttattatcttataattttcctatgaatggattagcgaatagaagtattatagctacaactaaaccatatattgctgaagactctgcaactgcagctcctagtaacattgtttgagttatttcaccttttgcttctggttggttaccaactgcctcagcagctttacctgcagcgaatccttgtcctattcctgctcctatacctgtcgcaactgcgatacctgctcctatagctgaacctgctaataatatagctgtttccatgattgtttcctccttaaatttaattactttttatattattttttttattaacatatcaattactctgtagcacttgatacaaataccattgtaagcattataaatatgaacgcttgtaataaccctgcaaacatatcaaagtataaatgtagtggcactggtattattaattgtccaaaaggtatgttgattcctgttaatgacgttgatacaaatcctaagaattgatataacaatgccattataacagatccacctaatatgttaccgaatggacggaaacttaatgatataggttttgctaattcacctattatattaagtggtaacatgaatggtattggctccattaattctttaaatgttgccatacccttcttcttaacacctgcataataaatcataaagaatgttattaatgcccatgctaaagtagtgtctaaatctgttgtaggtgatctaaatcctaatagtcctataaggtttgacactgcaaagaataggaataaacttcctaaatatggtaccataaaaggtaattcttttattgcagctggtcccatggtagtttttacaaacttatcaaatccacctactgcgatttctaaaaatacttgtactttactagttggaaccttttttaagtttctagttaataagtaagatgctaaagcaagacctgctagtattaaccaacttactataacagtatcacttagtttaaagttcccaagatatagaataaatctagcttgactcacagctacgcctcctttcttttaagtttgtctattactattgattttcctaatatagcaaacttagtgctcaataagcctatggcagttccaataatatttatatgtggtgattttgcagaaacaaataataccacccctactataaacatccttattatgtacctacttgtagagtagatttgagctttagtaggaggatatgttactgatttttgtaatgatatagctagcaatctaaagtttagcattgctattatacttccaaacaaaagacctgtaagcatttcctttggagaatttgacaaaaaaataattagaatagctgcgattaaatcaattatgaccatacctttaattacccatcttacttgatttgttaaagtattattcatttaatcacttccttttagcatatacaattagagttttgtaaactccactaaaggctccaccaattcctaatactaaaaataccagcaataagaacggacttgtcccaaatttatcatctaagtactttcctataaatgcacagcctaaaataggtattattatcattaaccctacttggctgattaaagaaagcatactaagagcttgcatatattttctagttttatccataaatagtatacctcatcataatggtttgtctttacttcaagtaattatatgtatctaatatttttttgttcgaaacgttgaatattttaattgtaaattatattttaatattatatttcttttaaatatttttatcaatacccaataaagatttttaaatttcagttttttcgtttttgtgtgaaatttgaataaatatttttgaattattcaaaatattcattttatgaaattatataatcctataagttaaaattacaatttcatactaatataatcttcattatattagtatttatgcatattttcgcatacaaaatatatattatattttcattacatacttataaaaattttattttcattgtatacagtatatattaattttataccttttatgaaaatttttctacaaataattacattttttttaaataatttttaatattttttataataaaatttataaaaaaatttataatttaattatcttcctcattttaaattagtattttttaaaatccaaatctttttataaatatttaaaaggtatctatatgttttatagatacctttttacttaattacttagtgccgaataatctatctccagcatcccctaatcctggaactatatatccatgatcatttaatttctcatctatacttgctacgtatatatctacatctggatgatatttatgaacttctgctattccttctggagaggctactagattaactaattttataactttagctccatctctttttaatacatctattgcagcaatagctgatcctccagttgctaacatcgggtcaactactatcatttctctttcatgtatatcttgtgggaatttactataatattctactggttgtaaagtttcaggatctctatataatcctacatgtccaactttcgctgctggaactaagtttacaagcccatctaccattcctagacctgctcttaatataggcactatacctaattttttacctgctataactttagctttagttctaactactggagtttctatctctatctcttctaaaggtaactctcttgttatttcatatcccataagcattgttatctctgttaaaagttctctaaaatctttagatcctgtatttttatccctcattaaagttaacttatgttgtattaatggatgatctgcaactactactttattcattgtataagcctcctaattattttgttctatgtcatttaacatattaactcttcttaaatgtctttcaccttcaaactcagtatttagccatgcatcaactatttctaatgctaaaccttttcctattactctctctcctaaagacagcatgtttgcattgttatgagctttagacatcttagcagaaaatgtatctgaaacaacagcacatctaattccttttactttatttgctgctaatgatattcctataccagttccacagcataatataccataatctacatctttgctaataacagctttagcgactttttcaccatatattggataatctactgaatctactccattttcagttccaaagtctataacttcaatcccttttgatgctaagtgttttttaatttctccttttaaattgtatccaccgtgatcactacctaaacctattttcatggtcctaatacctccaataaattgtatgaatagatttatacttaattttatattatactaaacttttacattttttgcattaattctgtttaattattttatataattttaaatttatacttctattactttataccctgcagatttcatcaatctattcattatagctcgtcctactccagtattagaaaaagcttctgaatatattacatctatatcttttttatccatttctattaatgaattgaataaattacttccgacttcttcaagattatttcctaatcctataacttgacctttatatttatctatatttttatttttacaaattactccacactttagattatttgcttcttgttcttctatcaagctattgattttatttattacattctcttcatctccacttactatatatacatcaccattaggagaataatgcgtatacttcattccaggtgctttagctttctttatatctgccttaccttcaatagatggatcaataagaacttcaccaattaaaacttccatttgttctttagttatacttccaggtcttaaaatcatcggcttttcagacgtcatatctataactgtagactctaatccaaagtcgcagtctccaccaactataattccagaaactcttccattcatttcttcacaaacatgctcgcctttagttggagaaggtctccctgatatattagcagatggagctgctataggaactccagattgtcttataatttctctagcaatagggtgtgatggcattcttatagctactgtatctaaccctccacttgttctttgaggaactatatcttttttcttaaatatcattgttaatggccctggccaaaattcatccattaattttttcgcttgttcacttatatctgttgctagtgaattaatttcattttcattatatatatgtacaattaaaggattatcactaggtcttcccttagcctcatatattttctttacagcttcttcatctaaagcattagcacctaaaccataaactgtttcagtaggaaatattactgtttttccttttgctaataaatcagcatgtttttttatttcttccttatctatattaagttcatctatattacttattaatgtctttatcattagtataccttccttccatattagtttatatatagcttactatcaaaattccaactaaaaaacctattatagaatacatagatttagttgttggaaatatttcttctaaaactacatacatcattgttcctgctgctatagctagaaaaacccctattaaagaagtacacatatcagcaaaatatgcacctaaaaaacttcctattcccataggaatacctgcaattatagttaacaatataactttaacagtactcatcttactcccaactaaacttaatgccatagctaatccctcaggtatattatgtataccaattacaacagctagtgctaatcctaaattctctgtagctataaatgaagaacctatagccaagccttcaggtaaattatgtagcaatatgcttaaaaatattaggtatccagaattaaggtcagatttaacttctaatctgttttttattaacattgtagctatagctccaataaatacaaatataattgtattaaaaacccctacctctgacatagattctttaagaaggtcaaataccactacggctagcattattcctccagaaatacccatacaaaaacttaaatacctattaacattttttctaaaaacagtagatataataccacctatacctgttcctataactccagatataagtcctatcaatgttatttcaagcaacatgactcccccctagtattatttaacttgttttaattttatgtacaacaaattatcattattccaataccagagaataaccatttttacttacaaaaaatccctatcttagtaatagggatttttattattcaaattataaagccatcattttctcagtttgatctacagttattagagcatctatcatttcagttaaatctccatctaaaaatgcatctaatttatataatgttaagtttattctatgatcacttactcttccttgtgggaaattgtaagttcttattctttcagatctatcccctgtaccaacttgactctttctttctgctgatatttctttattttgttcagcaactgctttatcgtataatctagcttttaatatttttaaagcttgttctttattttttaattgagattttccatcttgacaagatacaacttctcctgttggtatatgcgtaacccttactgcagagtcagtagtgttaacactttgtccaccatttcctgaagaacggaaaacatctattcttaagtcatttgggtttatttctacttcaacatcctctacctctggtaatactgcaactgtagcagttgatgtatgtattcttcctcctgattcagtagatggtattctttgaaccctgtgaactcctgattcatatttaagaactgagtatgcacctttaccttttatcatgaaagaaacttctttgtatccaccaacaccagtttcactagcacttaatagttcaactttccatctctttctttctgcatatctacaatacattctaaataaatctccagcaaatagagctgcttcatctcctccagctccacctctgatttcaactataacgtttttatcatcgttagggtccttaggtaataataatatttttaattcagcttctatcggctctactttatcttccatttctgataattccattttagctaattctcttagctcttcatctgattcttcttgtaaaatagattttgattcagctatactattcattacatctttgtactctctgaacttcattattattggttctaattcagcatgttcttttataaacttttgccaaactttttgatcatttattatttccggatcagctattttttcacttaattctttatatttatcttctagtacttctaatttatttagcatacttttcacctctttatttgtaacatatcaatagttgattatatcatagtttaaaacctataacaactctatcaattccttgtaaatctttcttattatatattttctcatagccattagatctcattatgtcagaaacatctttagcttgatcatgaccaacttcaaaagctaatataccttctttctttagataatttacagattgctccgttatagctctgtaaaaatctaatccatcttctccaccttcaagtgctatatacggttcataatctttaacttgtgtatgaagagtttttatatcttcttttcttatatatggaggatttgaaactattatatcaagcattaaacctttatcctttattcctgtaaatatatcagactttataaaatcaattttatcttcaactccattacttatagcattttgtttacctatactcaaagctttatctgatatatctaatgaatatatatgacatccttttatgtattttgctaagctaacacttatagcccctgatccagttcctatatctactattgataaattttccctgttgcctgcaagttctataacctcttctactagtggttctgtatccggtctaggaattagtacaccctcttctacataaaaatctaatcccataaactctctattgttaactatataagctattggccttccattcaatctatcttccatcattttattaaagttagctaactcttcattgttaagttttttatctaaatttaattgtatatataacctatctacatttccaagagctttttgaagtaagatttccgtatctaattttggagtatcacttatatctgatagcttttccatatatttaattaatatttctcttattgtcatatttttctcctttattactctataacagccttcaatgcttctagtgctacttctaattgcttatcatctggttctttagtcgtaaacttttgtaacatcatccctggataagcaacaaatctagtcaatttattattatatttcccaagcaattttataatttcatacgaaattcctgctacaataggaacacatataattctcataattattcttattataggatttggccatccaaaaaacgaaaataatattatagatgtaaacataacaataaataaaaaatttgttccacatctaggatgtaatgtagtaaattttctagcgttttccacagtaagatcaagattattttcataacaataaatagatttgtgttctgcaccatgatattcaaacaccctttgaatatctttattttttgatattaaagctatataaataaataaaatacacagcctagtgataccttctattaaattcagtgctagtttattttctattaattttgaaaataaccctcctataatagtaggagtaattacaaataacaatgtcgccaatgataaacctaaaatcaatgcaattattattaatacatccccagctttatccttaaatattttatttataaatctatcaaaagcaccttcttcaccttcatcatcttctaagaaaaattccgatgaaaaattcatacttttaataccttctatcattgtttctattaatataaaagctcctcttatcaaaggtatcttatctatatttttatcagatatccaactttttattttctttttttctactacaatttcaccatcattttttctaacagctattgctctcttatctttagattgcatcataaccccttctatgacagcttgacctcccacagcttgttttttcatctcctcacctcaatttataatatcatatatataatattactatacagataaagaaaaaacacctaaaaggtgtttactatctaaatattattttttgactacatgacactttctgcatctagcttcatagctttcaacagctccaacttgaattataggctcatcatatttagccggctccccatttataagtctttgagatcttgttgccggttgaccacaaacagaacatatagcttgtattttatctacaaattctgctactgctaataatcttggagttggtccaaaaggttcccctttaaaatccatatctaatcctgctgctataactcttatccctttatcagctaattcaatagccatgtctactatttcatcatcaaaaaattgcacttcatctattccaacaacttgtgtatcttcatttatatatttgttaatctcagatgaatcttttataggaatagcatttatagtgtatccgctatgagatactacatcttccttgctatatctatcatctataacaggtttaaaaacaacaacattttgctttgcaattttagctctttttaaccttcttataagttcttcactttttccactatacataggccctataacaacctctatgtatccatgattaataggtctatacatccttaatcctcctatataaataaaataggagttggcaagccaactccgtatttactattagtcgattttgaatctcttcttgaacttgtcgattcttccaccagcttctatattcttttgctttccagtatagaaaggatggcattctgaacatatctcaacttttatttcatctttagttgatcctgctacgaatgtgttaccacaagcacaacgtacttcaacttcttggtattttggttgtatatctttttgcatatttgtcacctcttctccttacttttcgaaattaattatattaacttttcgtttttcatcattcaactacaccattataacataagattatttagcgttcaagagttttctaattagtttaaagcctcttttatatactttataaacgcatcattatctttagttcttcttagtatttctaagactttatcagtaacttcataaactgaattattactcatttcttttcttagtttccaaagtgcagctttttcttcttctgttaataataaatcttctcttctagtaccagatttatatatatcaacagctgggaataccctcttttcagccagttttctatctagatgaagttccatattacctgttcctttgaattcttcaaatataacatcatccattctagaaccagtttcaactaaagctgtagctaatattgtaagtgagccaccttgtcttatatttctagccgcaccaaagaatttttttggtccatgaagagctcctggatctaaacctccagataacgttcttccagtaggtgatatacttaaattgtaagctctggcaagtctagtaatactatctaataatatcacaacatcttttccatgctcaactaatctttgtgctctatttaaaaccatttctgcaactttaacatgatgactagaaacttggtcaaatgtagaataaattacatcagcatctatagattcttgcatatcagtaacttcttctggtctttcatctataagaagaactataagttctacttcaggatgatttttaactatactatttgctacactttttaaaagtatagttttaccagccttaggtggagcgacaattaatcctctttgccctttacctattggagatattaaatctatcaatcttgtagatatttcattttgatatttttctaatttaagtttttcttctgggtatataggtgtaagagtttcaaacgctcttctttttgtagctgtttcaggatgttcatcatttattctttgtacatataataatgccctaaacttttcaccactttttggatgcctagttatccctttgactttatctcctgttttcatattaaatcttctgatttgggatggagacacatatacatcatgttctgtagataagtaattaggtcctcttaaaaaaccaaatccatctggtaatatttctaatactcccattacttcatcgtctttagacgtattaaactcatctacaatcttagcttcatcaacttcttttacactataagaatttctattaaagctttgattgtgtctttgatttctattttcatagtttttattttctggcttatttacactaggtttttgttcacttttaatttcttcttgtttttctgtttctttattattatctatcatatttttatttttatactcgcttataatttgtattaactcattttttttatacttacttatagacttaatccctagttctttagctaattcttttaattgcactagagtcatatcttttatattctctaaattcatatcttttatattcaaaaaaaccctcctattccataatacaattacagtttttattcggaaattaaaggcgtgcaaatgaaaagtttccagtatttgtactaaataattaactttaatattatcactatttatgcattatggtcaacaaataaaaaaataaaactactcatataaaatagttttatttttatgataattctatatactatatttacccattaaatcagttaatatatcatttttatctactgcgtgtatagcatcaacaaatcttatagttcctgttttagctctcatcacaactgagttagttgttaatctatcatttcctaaactaacaactccttttaataaatctccatccgttataccagtagcagcgaagaaaagttcatctcctttagctaaatcttctaatgataacaccttctctatatcagtgtctgttaatcccatttcatgacatcttactctctctgagtcgcttaaaggatatatctgagcttgcatatctccacccatacattttatagcagctgccgttataactccttcaggtcctccacctattcccataagcatgtctataccagtatcatcaaagcaagttgctattcctgcagcaacatctccatctccaaacatttttattctagtaccaagttttctagccgcttcaaatatatagttatgtctttctctatcttgtactgttatagtcatttctgtagttttcttatttaatgcttttgcgacgttttttatgttttcttcaacacttgcatttaaatctatacaaccttttgccttaggaccaactataatctttttcatatatgtatcaggggctttaagtaaacttccttttttacccatagctattacagatataacattaggcagtccttttgctattaatgtagtaccatctaacggatctactgctatatcaactttcatactgtcttcagttgccataccaactttttcacctatatatagcataggagcttcatctaattcaccttctcctattacaacttcaccatctatcttcacagtttcaaatgctcgtctcatagcttctactgctgcaccatctgcaccgtttttatcacctctacccataaactgtgaagaaactaaagctgctgcttctgtaactctaactaactccaatgccaaatttctgtccataaaattcatctcccctaattcgttaatcttcaataaaattatatatcacatttaataaatagtaaatatttatagacattaaaataaaccattagtatagtatataattctttataactataaaaaagacgataattcgtaaattatcgtctctttattaatttttaggtacactttcccagtcttttaagaatttatctattcctatatcagtcataggatgtcctaacatttgcttgaatactttgtatggtattgttgctatatctgctcctgctttagctgaagttaaaacatgttgaggatgtcttatacttgctgatattatttctgtttctattccatgaacattaaatatttcagcaacctcttctattaacattataccttcttgtcctatatcatctaatcttccaacgaaaggacttacatatgaagctccagctttagctgcaagtaaagcttggtttgctgagaatattaaagttacattagtttttatacctttttttgataaagcagatacagcttttaatccttctgcgcacataggtatttttataactatgtttttatgtatcttgcttaattcttctccttcttttatcattccttcactttccatagaaataacttctgcagatataggtccatctactatatcagttatttcttttactacgttttcaaaaactcttccttcttttgctattaaagatggatttgtagtaacaccttctataactccccatgagtttatttcttttatttcatctacatttgcagtatctataaatagtttcatactattatacctccttaaatttacattcctataaataaacttactacactagcaacactagaaagtactaacgttcctataatagccaaagctataaacctagtagttttcttatcattaacctttgccatgctatcacctcattaataatttacattatatatttttatttgtatattacacagcagatttcaatattaaaagcccttctctgtaagggcctttaatatattctaccactatttataaattccttctattgttaattttctaataatctttctaaatccataactaacttattaaatttatctgtcgttttttctattggcttcttactatataaatttataccactttcttttagtaattctatagggtaatttgaccctccttttttaagaaaagctaagtagttatcagctccattatttaatatatcttgtgaaaatgctatagctgcactacaacctgtagcatatttatagacataaaaactattatagaaatgtggtatctttgaccaacctatctttgacaattggtctacattaaaatcttctccataatatttttttaataaatcaccccatacatcatttaatactaaaacattcacagtttcttttttttctaatttagaatgtatttgattctcaaattctgcatacatagtttgtacaaataatgtattttttattaaatctaaatattgagttatataataagctttttcttcatcattttgggaattttttattaacatctcataaagtagtgactcattcgttatagatgcaacttcatgtgtaaatatactaggttttgaatttaagtaattctggtttttagaactcatatacccataaactgcatgtcctaactcatgtgctagtgtagatactgaatctaagtttccactataatttgttagtatatatggatgattatcatataatgacaagcaatatgctccactaacttttttatcatttgaaaaaacatctatccatctttcattaaacgctttataaatcacatctccatactctttacctaatggatttaaagctgcatatattatgccttgagccttgtcatatgaaatattctcatccacaggatttactataggtgtatacatatcgtatgagtacaccttatctaaatttaacactttttttcttaaactaatgtatttatgcaaagtatctaaatttttattaactgtacttattagctcatcataaactttagcatctatattatcacctgacatgtacatttctcttgagtttttataccctctagtattcgaatagaatatattttttttaacttgacctataaataatcctgataacatatttatattatcattgtataatacagattcactttcaaaagctttttttctagtttctctattttcactttctagtgctagagaatattcagatgggtttaatgatgattttttatccatattcacaaaaagttcataaacatttttgggcaatgtcgtaatatcacttactccatttaataattcctcttcattagctttcaagtaatgttttttatttcttcttatatcatttaaatatattttgtacttacttgatattttactatttcttgtaatatccttaaattccctatctgaaagtttcaatatctctaactctaaatcagaacaaatagagctatatactttatatacttcatctagtttcttctccatattagcaaattcatatgattttttattaacatctttatttaaagatacatatgcatataatttttcaatttttgaatctaaatcttcttttatatttaatgcgtataataaatgcttagaagatttagttacttttcctacataatttttaagttctttagtatctctattaaacctttttaaacttttttcccattcagaattacttttatataaatctcctaaattccaagatgtatatttagtttttttatttacttcttctttagatttttcttctttgctagtatcattcattgtttcggttattttttcattaactatttctatacttttatcaatctcttttttaagagcaacagtcgaaaataatataataacaattacaattgttatgattttataaatatttttccccataaaaagccatcctttcactaagtttgttagtattaggatggctttttgcatacatattattcaattctaccaaaataagtatttattaagttatcaacatacttatcaacatattaacatttatttttttacataaaatttgtatttttcaacatttatataatataattcctcttatttatctatatttttatctaagttatcaacattttaaattaagttattaacattttttcgctttttttatattaaattgttaatattttttaattgctacgaatttattattttaaattttacctattatatacaaatcatttttatacaattttgtcgaatattgtaatttcaacgatttttttcatatttttaatgattttatatccacaacttattcacatttaatccacattttgtgtataagttgtggatttatattttaatgtttataaactttagaaactaatactgtcatatcatcatatatattattattttgtatatctaatgctctatttaaaatttcttttgatatatccttaggattagatgtatccatattctttaagaaatatataagccaattatcccctaaatttttattttttcctgcatctataattccatctgaaaccataattatataatctccatcttttatctttcgagtatctctttctatgttgacatcagataaaatacctacaggtaatgatgctgttgatattaaatctatatctccattacttctttttatataagttgagcatgctcccatttttatagtgtttaatatacctttatttaaatctacaatacctaaatctaaagtagagaacatttcatcagaagatttaagcattaatatattatttatagtatcaatcactatctcttcatctatctttgaatccatcattttttctaatatatctatagttattgatgactcctcataagcctttcttccttttcccattccatcacttatagccatcatgtatttcccttctgatatctccatatatgtataattatctccagatataatatatccgtcttttgacatattagaaacttctgttacaaccttatattcttgttttttatatagctttattttgcaactatctcctaaacatgtgcaacctattttattaacatccagatcttggcctactacactagatacaactccagctattttcctttcacataagttaccgcctttacatgtttctttttctatcaagacttcaaaatcattaaggtccttagatatataatttaatttttttacacttatattatttctatcgagttcaatcaatatattattttccatttccatatcaaatgttatgtctctatctaattccatagccatgcattcaatcgacttggacatatatcttatttgttttgctactaactttctattttctgaaaatttctgctgccaactataatctaaagcaaacattttatagtaacaattagaagtttttacaatactttctggttttatacaatctttcttaaaatcactaggtatattatcaagttgaatttctccactttcttctaggcactctaatattctattcatcattgtatatgtataattaaatcttgtttcccaacatcttcttctcattccacaatttttgcattcatcactatacaccatgtctataatatgcgctatatctttttgatctaatattttttctttttctcttatcctatcaaatgtgttagctaaatctgagtatgttttatacattcctcttaatctattattagttatttctctacttctagataaataatcttctataccgtcacttaatctaccattacccttaatgaacttctctatttttttcataaactcttctggtataagcatcactaatatacttgctatgaatatatctctaatcgccattatattcgaacctgatccagatgtgtaaatatatatcaaactccaacccactatatatcctgctatacttaaatatttattaactttattaaatcctcctgagatcaaacctgcaaatgcataaatgcccatatacatactagaagttatgttatttataaaataaactaaacctattattactccactagaagctcccagggcagctccacctgttatagataatattaatattgtcatagttgctaaaatatttctaatagatattcctattatagatacatctcctatccccattatgctaaaagttataattatggttaaagcaacaatttcttcactagaggtgacttttctagaagctcttttatttataatagaaaccccatatgaaaaaatgtatgtgctaacaaacattaatatacattcaactaatgatatacttaagttatatatataatttccaaatactatagcttgtccaatagatagcggcattattataagcatacctatcatagaaattttatttatagattttatattttttatattatttgctataaaatgcataataattatacacattgaatattttataatattagatgcttgattaaatgaaagtaatgtcccagctaaagtagatacaaaaactggtagcctatatttatctaactttgaaacacataagaaaaatgcaacacctaaaggagctatattatctactaccatagccctactaagtaaaaatccaattaaacataaaattattgtattagaatccgataaatttattttcatagtattttttaaatcaatttttctactactaactaccacacttctttgcataaaaaaacctccccttgttattttcatattgaaattgtaacaaacgggagatatcttttttgtcataatcagtagctagtccataataatattaagacattttttttgctttatgacataataatccttccaaattatcatactcactcactataatattttgtttttctaattttttcattattatatttagtattgttacaccagctgttataatatctgctcttttaggttgtagaccttttaatgtttttttatcacttagtgtcatgttttttaaattttgtaaaataatatctaattctttttgatttatttcacttccatgaattttttccatagagtaagtttctaactcttgatttattgcagaaacagatgtaattgttcccccaattcccacaacagcttttatttctttattctttagtatatttaaagtatcatttatagtgctagatataaattttttcatactttcaaactcttcctcacatataggatcttcatttaaaaatttttctgtcattcttaacgccccaacattttcactctttgaaaattctatgccattattccctcctaaaataaactctgtagatccaccacctatatctataactaatatatcttcattttcttctaatccttgtaaaactcccataaagcctaaattcgactcttcttgcccacttattatttcaacatctatgccaacttcatttttagctaaattaataaactctaatttattattactatctcttaatgcagatgttcctatgcaatataaatgctcacatcctttttcatatgctaactctgaaaattcttttagtgcctttatatttctttttatagcatcttcccttatatatcctttactatctactccctgacctattctagttgtatttataaacttttctctattaaataactttccatctatataatcagctattaataacctcatagaattcgttcctatatctatagcacctatcttcattaaaattatcctcctattaaagctttaatatatttagatataaatagaggaagtatcttaattacttcctctatttatatctaaatatattatttcatttggcttaaccattttcaactttttcctagcaatttcctctatgtatttatcattatctattttctttttagcttctttcaaactttttatttctttctctgtattctttatttcattctttaagcaaattatatcatttttatatttagctgacttaataatttgagtcgcaactccccctataagcgatattccaactaaacataaaaacataccaactacaatatattgccctataaatttttttcttttgttcataatctacccccctatgatttacttttaaccttttttaatttacctgatttaatctgtataaactttaaaatgtttattactaaattaggtatataaaatatagtatcaaataagaaatgtattgagtagattataacgtaatacaaattcaccgaaatcttgcatatgtataccaaaatttgctttatagtatttataataaatcctattgatttatttaaaatctttaaaacaattttacttaatgtattatagtaaataaaaaatcctataaatagagcaataaaatgataatatcttaaatcaaaggattctataacgtttacagttataaaaacaagccctgtgacaattatccaaaatagtatgtcataaaataatgagaaaattttgattgcattaaagtttttcttacaagctctgtatagatcaaataatattcctatgaatatgccaccatatattgtagcaaaaaaagcacctaaatcttgtgtgaatggtatcattatttaaataacttcttaaagaagctttcttgaggatctttggatttactataacataatccatctattgtccctgttatagtaataaccttctcgtctatactaagcttactcatatctaaattttctccatccacaaccatatctccacatgtagttcgtatttctacctttttatcatcaaatgagtatatgtgctctactccagaaatagttaaacttgacctattctttaagtctataatatgctccataatatccctccatattcaatgtttataataatctaatataaatatacgagggatattatgaatttattctattatctcgaacatttctttcgcatcattttttaatacatgctcttttatttctcttatcttaaatttcattagtttctcaccaaattgaatttcaagtaaatctcctacatttacttctgatgatgattttgctacttttccgtttatagttacaatacctttatcacaagcttctttagcaactgttcttctttttatgattcttgaaacttttaagaatttatctaatctcatatttttaatcctccttatacacaaaaagtgtggaatatccacacttttaaatataaataaaattatccatttattatatcttttaatccttttccagctttgaaaactggcgctttagaagctggtatatctataacttcttctgggtttcttgggtttcttccttgtcttgctgctctttctctagtttcgaaagttccaaatcctactaattgaactttttcaccttctactaatgcttcttctacagacttcatgaaagcatttaatgctgcttccgcttccttctttgttaattcacttttttctgccatttttgctactaattcagctttgttcacggttcttacctcctaaaagtttatattatagaattttatactagatattaaataaaattctagatttttaacgaaataccttttatttactgcttatttttggattcattccataaatcatccatttcttctaatgtcatatcttctaaattcttatttaaacttatagcactattttctataaactcaaatctatttatgaatttttcagtagttagattcaatgcttcttctggatttatatctaaaaatctagcaaggttgactattgagaatagtaaatctcctagttcttcctttatgtattttatatttccttgtttgtgttcgtcaagtaattctttatattcttctacaatttttttaaatacatcttctatattatcccagtcaaaccctactaaagctgccttatactgtacttttttagcttttgttaaagctggtaaactaggtggaattcttcttaaaccttctgttattgtagtttcacctttttcttccttttttaaatcttcccattttttgtcatatgtattcatgtctacagtttcatttttaaatacatgaggatgtctaaatactaatttttcacaaactgtttttattacttcctttaaatcaaaatatccttcttctttacctatttgagaatggaacactacgtgtagtaatatatctcctaattcttctatcatctcgtcaatatcatcattgtctatagcttgtgctaattcataagcttcttcaattatatgagctttaagagatttatgagtttgcttttgatcccattcgcatccatctttacctcttaatctctccactatatcttctaaatcttttactttattatacgtaatcttctcagactttggtatatataagctagtaagatagtcaaaatcattttcatttctatctaattcatataacttaacatatttcttactttctagatttttaacacctgctgcttttactatacatacttcttgctcatcatcataatactccataagtgataattttacgtttgaagctataaatctatcataaatttgagttattatcatgctagtattcgtatctatatagctattttcaatctcaaatgcatcaactaatttaaatccttctgacggatcaacttctaagtagttaaacatagcatctacaaagctcatagaagctattgtatctacctctataccctttgtattggcaatgctactaataatacttacagtcttttctgcgaccctaggatgcccaggaactacatacacaagatctcctttattagattcttctatgataaaattagatattttattatagacattctcaaaatcttcatcttcattgtaaaaataatctaatgatgtgtattttatttcatcttttaacttatccattataggatgtttttctgttcttaaaaatattctagaattattttttaaggcatctaaagcacctttacttattaaagaatattctccaggtccaagacctactatagttatttttcccatataaaaagctccttcttgttgtaaaaataaaggaaattaccctatataagtatttcctttatttgcatatatgtatacatatattacttcataatttttaattttctaagaactttatatactttatctcctttaggcatacttaataattcttctttctttataccacctaaagtaaatgtagccaatatataaactatcgctccaattgctatggctagtatagtagataaagtattacctaatattcctattataaatgtaaaacttaacttaaccactataaacatagtaattactattaacaacggctttataaaaaattccatcttcgacaacttcattttcattgccttttttatgtaaattaattcaagcatactagctacaaaataagctgttaaagtccctaatgcagaacctataacatttatttgtggtatagctgtcaatgtataacttataactactttaaataccatacctataaccaaacatatcactggaaccattggttttcccataccttgaagtatcccatttaaactttgtattaatcctaaaaatactatacaaggagcaagaactaataatatagtccctactgtagctggttctccaggatataaaagtttcattataggatgtgctaatgatgctattccaaaggctgctggtaaaacaatcattagcgttatctttatagcactcttagtttcttttattgctttaatcctatttcctactgcataagcttgagatatagtcggaactaagctcatactcatagctacagttataacagatggtaagttgattatagccatagccattccagttaattgtccaaacattacatttgcttgagtttgagtaaatccagcttcaattaaccgtcttataacaataacgttatctatcatatttacaagtggcataacagacgctcctatagttataggaacagctactaccagtaactttttcaatattctagctatactttcttctttaaattttttacttatttttatttctctttttatagtttttaatttaactaaataagcaattattaaatatataattgatgctatagcacctatagtagcacccattatcgctcctgctgcaccttgttctggcccagggtttgcaccccacttatacataagaaagtatgcaagagttatccctaaaactactctaaaaagttgttcacttatttgagaaatagctatttgagtcatttctcttcttccttggaaatatcctctataagaagacatcactggaacaaataaaagagccggtgatattgctagcatagcatatttcgctcccggattttccattatatcatttactataaaatctgctccaaagaaaaatatacaaaatgctataaaaccagttatagctaatacggaataagataccttaaataccttatgtgcccccttataatctcctatagccatcttttccgatactaacttagctaaagctgttggaaatcccgctgttgccaaagttaaaaacaaagtgtacacaggatatgccgcttggtaataacccataccctctgcaccaattaaattccccagaggtatcctaaaaaatgctccaattatcttaacaagtattcctgctaaccccagtatcaaagcccctttcaagaacgaatctttcccattattattacccataaataccccccatatcatgttatataacaaattctaatataacatatatgctattatggattcaatatattaccatataaactttaaaagaccctaacaaatgtgggtcttttaaaaattattgaacttgttttcctaaaaaattagctgctacttttaggattttttcatcactttcatttaattctactttgtctttagatactagacatatagatcctatacaatcacctgaaaaacttattattggcattattatttgagatgtatagttcataggatcatattcacttaaacatactaatttattatctttaacatgaatagattctctttttttcataagagattccaattctttacttatactttttttcttatagtatttattaggtaatttagatacagctattattgaatctaaatctgttactataactccatgaccaagtgtttcccctaaagcttctgcatactcttgtgaaaattcattaagctctcctatttgagaatatttttttaatattacttcaccatcatttgcagtaaaaatttctaaaggatctccttctctaatccttaatgtctttcttacctctttgggaataaccactcttccaagatcatcgattcttctaactatccccgtagctttcatactagatgaatcttttaatttactcataggatctcctccttttaatgtcatgtaatagacaataatatatcatataaactccactaatttcaataatttagagtaattaccaattaatgctaaaaagactcataattccattatgagtccagtttatattattgaacttgcttacctaaaaaattagctgctaccttcaataacttttcatcactttcacttagccctgacgcttctttagctactaagcatatagatcctatacaatcacccgaagaacttattatagggattattatttgtgatttataatccattgaatcatctctgtgtaaagatattaatttattatctttaacatgattagatactctattttctataagctcttctaattctttacttatgcttttctctttataatcttttttaggtaatttagatacagctattattgaatctaaatctgttactataactccatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggtaatttagatacagctattattgaatctaaatctgttactataactccatgtccaagtgtttcacctaatgtttctgcatactcttgtgaaaattcatttaattctcctattggagaatatttttttaatataacttcaccatcttttgcagtaaagatctctaaaggatctccttctctgattcttaatgtctttcttatttcctttggaataacaactcttccaaggtcatctattcttctaactattcctgtagctctcatatcagattaatacctccattagtaactttgagtttatttttaccaatgccaagaaaaatatgcaaaaaaacctataccattccaaatggtataggtttttcttatgcattaatctttaaagcttcttcttcatttttttctattttagcttttttaactaattcattaactttctcagtatattttttatataataagttttgttttatattgtttttcacttcatcaaaagtatattctttgtattttttatcagtaacttttattatatgatatccaaattgagattcaactatatcagatatttcacctttgtccattccaaatgcagctttttcaaattctggaaccatttgaccttttgagaaaaatcctaaatctcctccattaactgcagaacttttatcatcagaatattctttagctaatttagaaaaatcatctccagctttaacctttttatacacttcctctgcttttttcttagcttcttttttcttttcttcagaaaatggcttattagttttttgatctactgttgatattaatatatgagatgctttcacctcatcatctacataattatttttattttcctcataatattttttcatttctgcttcagttattttagtattcttatcaaaattatttttaaaattttgtattgttatatctttagttaactgagcttttaaaaattcatcatcaatatcattatctttaaggaatttttcatagtctttatctttttttatactttcttttaattgcttaaattgtttatctacttctgattgcttagcttctaacttctctttcttagcctcttgataaactacttgttcttgtatcatttgttgtaaaatagcttttttcatttcatccttgtattttacacctttttttatttcttgatcccataaatctttaccatacatttttgaaatagattctttataagtagcaacagttttcttaaagtcatctgcagatatatctactccgtttacaactgccacaggtttttttgatccacaagcagtcatacctattcctaacataattaccattagcaatgatactatttttttcactttaatcaccctttctaattatttttttgatttttactcatacacatttgttcaagtatattttttaactcatctattatcttatacccatttttttccttagttctatatcttgttaaaggaagaagtattacttcatcttttaacatcctaattttttctatacctaactttttgcataaggtcttcatgtatgctatagatattagggcattaacagatttaggtatatctgaaaatctatcttctaattcttcttttatatccttcatatcttcttcattctctatagatgcaatttttttatacatttcaatttttataatttcatcttctatatagctatcaggtatatatgcatttacaggtaaatcaacttccacatctatttctttttctactacctcacctttaacttttcttattgcatcatttagcatttttacgtataaatcatatccaatgactgccatgtgtccatgttgttgaggtcctaaaatgttacccgcacctcttatttctaaatctctcatagctatcttaaatcctgaaccaaattcagtaaattctcttattgcctttaatcttttttctgctatttcacttaatactttatctttttcatacatgaaatatgcataaccttgcctattacttcttccaactcttcctcttaattgataaagttgtgctaatcccattttatctgcatcatatacaatcatagtattagcatttgatatatccatacctgtttctattattgttgtacaaacaagtacattatactctttatttaaaaatcctaatattatattttctagttccttgcctgtcatccttccatgtgctactgctatttttgcatctggaactaatctttgtatcatactagccatttcatctattctttcaactctattgtaaacaaagaatacctgtccacctctagctatttctctttctatctcatcttgtattatactttctttaccttcaacaacataagttataactggatatctctcttgaggaggttcttctataacactcatatctcttattccacttagtgacatatgaagagttctaggtataggtgttgctgataatgttaatacatctactgtagattttatcttctttaaagattctttgtgttttacgccaaatctttgctcctcatcaataactactaatcccaaattaggaagttctatatctttagatataattctatgagtacctattattacatctactaaaccttttctagcatcctctataatttgtttttgctctttaggagttttaaatctacttaaaacttcaactcttattggataattttcaaatcttgatttaaaagtgttataatgttgctgagcaagaatagttgttggaacaagtacagcaacttgtttttgatccatacaagctttaaaaatagctcttatagctacttcagtctttccatatccaacatctccacatataagtctatccattactttatttgattccatatcttttttagtttcttctatagcttttaattgatcatctgtttcttgatatgggaataaagtttcaaattcactttgccataacttatctttagagaatttatatccttttatcttttctcttttagcatatagttctactaaatctttggtcatatcttctatttctttttttactttagcttttgcttttgcccattcgctacttccaagcttatttaattttaccttttcagtgtctgctcctataaacttttgaattttatccatttgatctattggaacatacaggttatctccaccttggtaaacaactctcatatagtcttttttaactccatttacagttaattgatctatacctacatacctaccaacaccactattttcatgaacaacataatctccaacattcaggtctaaaaatgtttctattttttgacctttattaaattttttagatttagatgttttagctcttttattagaacctatcatttctttatctgttataacatcaaattttatagatttatattggaatcctgatgttatattacccacaactataacaacttgagatgagtgtatctctatatctctttttcttgttaaaacactttctatacctagatttaaaagctctttatttaactttttagctctatcataagtatttgtagctaaaacaactttatggccattatatttcaatctatttaattcttctgcaagaatatctaacttcccattaaatgatggaacttctctactttcaaaattaactatagatgccacactaaagtcatttatagatttagttaacaacatatttaaaattaattttttaccatcaattaagtattctaaatcagaataatgatataaaagattaccttgttgctttaatgctaaacctctttctaagtttaatttataattctccttaaactcagatatatagttttcacatctttcctttaatctagaaatatcatttacaaatataattgcatcatcttttaagtaagtaaatatacttttgttttcatccgtatacatataatctatataattttccacaccttcgaaatatgttgaagatgctacattttcaatatttctatgtacatcatcatctgtaaaatcattagtatcttttttaattctttctacagattcatctatactttctggatatatatactctcttgatggagttattgtacatttttttatcttctttatagatttttgagtaaatacatcaaatgttcttatcgattcaatctcatcatcaaataactctatacgaataggagtatcatactctaatgaaaatatatctattattccacctctaatgctaaattgtccaaatccttcaattttagatactctttcatatcctaaattaactagttttttagataaattttctacatcgatgatatcacctattttataagtgaatatactcttttttaaaatttcctttggcacatatttactaagaatagcttcaacagatgtaactataactgtattttctttacttatcatccttagtaatacttttaactttctagcttcttcatttctatcctttgcatctaaatgataaaagtatatatcttgagaacttaaataatcaactttatctttcatataaaaatataaatcttcatatacttttttagcttctaaatcagtattagcaatatataaaacctgtctttttaaatcattaaataaagagtacactatatttggtttttgaggttgtaataaaccatttataagtagtgttcccttaatattttctatgttacttaatatgtctttatattctttagaattttgcaaaggagatataaaaatatcgttcatattctaaccccccttataaactaaccattatatttattcattgataaatctatattttctcttattatacaatctacagacttagctgctttttctaatccatcttgaatatctgatgattcttctttcctaaatctagataaaacaaaatctgctaaatcttgtcctggtctaggttttgataccccaactcttactcttggaaattcattagttcctaggcactttaatatagatctcattccattatgagttccaccactacctttttttcttattcttatttttccgacatctaaatctatatcatcatatatgacaactatattattagagtctactttataataattgtatatatctattagtgtttctccacttaaattcatatatgtctggggctttactagtaaaactttttcatttcctactctaccttcacctataagtgccttatgttttattttcgttacgcttatgccatattcctttgccaaaatatctataacatcaaatccaacgttatgtcttgtatgctcgtattgtttacctggatttcctaatcctactattacgtacattttcattcctccctttacttgttattatttcttataaattaaatttttaaaatttcatatattaaatataaagttttgttgtgatagtattacgaatgttgttgctaaaaatatacaaggtgcaaatggcatatatgaattttttgattttttcttaaataataataagtaaactccataaatacttcctattataaaagatataggtatcatatatacacttttttctatccctatacaaaaacaacacaaagtatagactcctatatctcctgagcctacaccttttgttagtttaaccattatataaggaataataaatccaaatgctaatcctattatatgatatattatattatcctttgtcaataacaatataattccttgaattattataccactaattatagttatatcgtatatatacattgtataatagtctattatagatattaccactaaaaaacacactagtaatgaatatctaaaaaattcttcattaaaacctagtttcacgtataacattaatattattactggagttattatatataatatttctgcaaatttatcttcatttatttttatttctacataaatttttaatttagtcatgtatttttaaggttttagtggcttattcactataataagctattaatttttatatattttaaactttgaatatatatttttacaagtttttaagtgtataaactgaccttagttatataatagtaatataactaaaataagaatcgaggtatttacattgataaaagatttaaaagacatttttaaagattatactccatatataaatggccatgaaaatatgaaaaaagcatctgttttaataccaataattaaactaaaagattctcactttatattatttgaagtacgttctaaaactttaaaatctcaacctagtgaaatatcttttcctggaggaaaaatagaagttaatgaaactccctatgaagcttgtgtacgagaaacctgtgaagaattaggaacaatttctagcaatattgaaattttaagtgaacttgatttatttataagtccttcaaatcttataattcatccatttgttggaattataaaaaatatagatatattaaatataaataaagatgaagtagaccatatatttttagttcctatatctcacttactggaaaatgaacctattaaatatgaaaatgaagttaaggttatcccaaataaaaattttccttatgaattaattcctcataaaaaaaactataagtttcaaggaggatactatgattctttattttatatgtataaaaattatgttatatggggaataaccggtaaaatacttgataattttttaaagttattaaaataaatatttaaaaaatgagtatctctaaatgttaaattgcactttgagatactcatttttatcaactatatattagcattttcagctgttttattttttaaatattcatttatcgcttttgctgcttttctaccagcacccatcgcagatataactgttgctgcacctgtaactgcatctcctccagcaaaaactccatctttagaagttacaccattgtcatcagctactatacattcccatttatttgtatctaaaccttctgtagtagatgttattaatggatttggagatgttccaagagccataataactgtatctacttccataataaactcagagttttctataggtttaggtcttcttcttcctgatgcatcagcttctcctaattccatttttacacataccatacctttaacttctccattttcatcagttaaaatttctactggattagttaaagtatcaaatattactccttcttccttagcatggtgaacttcttcaagtctagcaggaagctctgcttctcctcttctatatactatgtgagtttctgctcctaatctagctgcagttctagcagcatccatagcaacatttcctcctcctattactgcaacacttttaccagctcttactggagtcatataatcttctctatatgctttcattaaatttactcttgttaaaaattcattagcagagcatactccattagcattttctcctgctattcccataaacttaggtagtcctgcccctgaacctataaatacagcttcaaatccttcttcatttaataattcatctatagttatagttcttcctattattatatttgtttctatatgtacacctaaattttttatattttctatttctggcttcacaacaccatctttaggtaatctaaattcaggaattccataagttaaaactccaccaggttcatgcattgcttcaaatatagtaacatcataccctaatttagctaagtcacctgcacaagcaagcccagcaggaccacttcctatgacagcaacttttatattatttggttcttgttttatagctaaatcaaaattatgttctctagaataatctgcaacaaacttttctaattttcctattgctactgcatctgattttattccaagaacacatactccctcacattgattttcctgagggcaaacccttccacatacagcaggaagtgaactatctttagctattactttagcagcaccttcaatgtcaccctcttttaatttaccaataaatcccggtatattaatttcaactggacatccagttacacatcttggttttttacattctaagcatctactagcttcttgtattgcttcttctttattatatcctaaacaaacttcatcgaaatttttaactctaacttcagcttcttggtgtctaactggtactttaactttgctcatgattaattacctccacatccgcatccgccatgttgatgcgtatccccttcttcttgttttagtatggctcttccttcttctgttttatacatagcctgtcttctcatagactcgtcaaaattaactaagtgcccatcaaattcaggcccatctacgcatgcaaattttattttaccaccaacattaactctgcatgctccacacattcctgttccatcaaccattatagggtttaaacttactgtagtaggtatacctaaatctttagttaacatacacataaatttcatcattatcataggtcctataaccactgcatgatcatactttttaccttgattttcaactaaatcttttaagcaatctgtaactcttccattaaatccatatgtaccatcatctgtgcaaatataaagatttccagcgacttctctcatttcatcttctaaaattaataaatcttttgtcctagatccaactataacatcaacatctattccatgttctttaaaccacttaacttgtggatatactggtgcagctccaactcctccagctacaaatatcatttttttattttttaattcatttatgtcttcttcaacaaactcactaggcatgcctaatggtccaacaaaatcagcaacataatccccttcttcaaatgtttcaagttgtttagtactagctccaacagtttggaatactatactaaccgttcccttattagtgtcatagtcagctattgtaagaggtatcctctcacctttttcatcattttttacaataataaattgtcctggcttagaagcttttgcaactcttggagcttctatatccattagataaatactatctgttagttttttctttttaacaattttacttcccataactctatctccattctgccaaataatttatattttaattttagatacatcatatataacatcaacccctaaataataacattttcctagatagttatatacgatttcatgtatataaaattaattaacttatatatcatttacaactatattatacataaaaaaacagcctttgtggctgttttttttaaataattttctaatctaccattattccgtttaatgagaatgtctttgactctgtaattttaacatttacaagagttcctattatatcttctctgtcagattcaaaattaactagtttgttttgtcttgttctaccagtaaatttattgtcatctgttttactttttccttcaactaaaacttcaacagtttttccttcatatgatttacttatttcttcacagattttatttacttcttctaatactttattaaatctttcatgttttatattttcaggtatttgattttccattttagcagcaggtgttccttgtctctttgaatatataaatgtaaatgcagaatcatatctaacttttttaactacatctattgtatcaagtaaatcttcttcagtttctcctgggaaccctatcatcaggtcagtagagaaagctatatctggaacttcttttctagctttttctattatttctaagtaatattctttagtgtaatgtctattcattgctttaagtaatttagtacttccacactgaattggtaaatgtaaaaattcacaaactttatcacaatctcttattgcatatataacttcatcagatatatcttttggatgagaagtcataaatcttactctttctaatccttctatatcatttaccattcttaataattggtcaaatcttattggattttctaatgttttaccgtatgagtcaacattttgtccaagtaatgttacttcttttgttccgtttgcaactaattcttttatctcatttattatatcttctggagttctacttctttctctacctctagtatacggtactatacagtaagtacagaaattattacatccatacattatatttacaaatgcttttaattcaaattttctattacttctaagaccttctacaacttctccatcaacatcccaaacatctattaacgttctttgtgagtccatagaacttgctaataactcagggaatttgtataagttatgtgtaccaaatactagatctacatgtctatatttagtttttatttcatctactacatgactttgttgcatcatacatccacatacagctatttttaaatctggatttttcttctttaaaggttttaattgtcctaaatttccgtaaactttaagctctgcattttctcttactgcacaagtattgtaaattactaattcacactcagctgcagttaatccttgagtataacccatttcctcaagcattgcacataacttttcagagtcatgttcattcatttgacatccaaaagtttgtatcatatatcttggctttcttccatgtatagcataatatctattagtagtttcagctattgcctctataaatctatcttgttcttgtattttttctataggaacgtgtacttgttttcttttagccacaactagccctccttaaattacttcattatatattttgttgtcgattttttgaatttaaaattaattataccaaatttataaattattttaaagatatcatttaatttttaactgtatatattttaaataattacaaataatattatatatctaattcaacgttaaatatataataaaggatggtagtctatgattgttgttttaattagaagtatagttctttatatagcagttttaatatcacttcgtattatgggaaaaggcgaaatagctgaaatgaattcttttgatttagttataactcttttaattgctgaagttgctgctatccctatgcaaaataatgaaattcctatagtttatggaattgcagctattactggtttagtatttatgcaaataataatttcttatttaactttaaaatgtagaagttttagactcttattaaatggaaaacctgctatccttatagataaaggtaaaattaattacaatgctttaaaacttgaaagagtaactatggatgaacttttagaacaacttagaattcaggggtactttaacttaaaagatgtttattatgtaatacttgaaactgatggaaatcttagtatagttcctaatcctggctatgaaaaaattcctaaagaaaactttaatcacttacctattcctttgatattagatggtcgattaataaaatgtaatcttgaaagtataaataaaaatacgaattggcttttatcagaacttaaaaaaaataatatcaactctatttctgatactttaatttgtatattagatgaaaaagacaattttttcatacaaagaaaataattacttaagaggtgatatattgaaatctattatctttactatgatttggactatattacttgttagtttaggcttatttgtatcttttaaagcagaagattttgcagatacctatgtagaatctttaaataagcttgaagtatatgtaaaaaatgaagattggcaagaatgcgataaattaaataacaaaataaagaaaaattttatgaaagactctagacattggtttaaatttttaaatcattctcatttaggagatatcgaactatcttttaatatattatctgatggtatctatttaaaagatataggaagctgtttagaacaaatagaaaatataaaaatatatctacatcgtatgatagaatctgaaaggtataatcttgatcatatactataaaaaagatgtcttaaaatttattataattttaagacatcttttttattatttactcatttctttagatttttctatacagtcacctattgcttttataactgcacttctaaacccttctgcttctaaagttttaactgcttctattgtagttcctcctggagaacacaccatatcttttaattcgcctggatgtttatctgtttcaagaaccatctttgcagaacccataacagcttgagctgcaaatgtataagcttgatttcttggcattccagctaaaacagcagcatctgccatagcttctataaacataaatacatatgctggtgctgaaccactaacacctattacagaatctattaaatattcatttactatttcagctttaccaaatgaattaaaaatttctttgactatatttaattcttcatctgttatatttttatttttgcaaagtgcactcattccttcatttacaagtgctggtgtatttggcatagttcttataacttttttatcattacctataacattttctattgattctatagtttttcctgcagctattgtaactattattttttcattgtctattagttctttaacaccttctaaaactatatcataaacattaggctttacagctactataactatatcactaaatttcactacttctttagagtttgtagttacatttatgccatattcatttttaacattttcaagtactaactcatttaaatcagaagctattacattatttgagtctaccaattttgatttaactattccacctatcatagccttagccatattccctgaacctataaaaccaattttcttatccatatttaaaatctctccttattatatgttataaatttatcattttgattaaacaaatatagggtctgtcttaagaattgtttaagtaaattttatactttatgttaattcttaaaacatacccttttttagctattttagaaagtttgttcagttcttcctattatttcatcttgaagtgctctacttaaattattaaagtgatcactatatcctgcaactctaactattagatctttgtattcatccggatttttttgagctgctaataaaatatttttatcaaatacattaaattgtatatgatgtccatccatattaaaatatgttctaattaaattagccatattatcaagtccttgttcaccttctacaactgcaggtgcaaatctttgattaagtaaagttcctccagtttttaaatgatccatcttagaacaagattttataactgctgttggtccaaatgtatctgctcctttttctggagatatcccttctgataatggtttttgactaagtcttccatttgcactagctcccataacttccccaaaatatacatggcaagttgtaggtaacatatttattctataatcagctcctagtggagattttcttcctgtaacttcattgtaaaatgcatcaaatgtatccttcatcaaatcatctgcatagtcatcatcattaccatatttaggagttttattaactaccatattatatatagcttcatgttctttaaaattatcacttaatgcttttaataactcatccatgctaaattttttcttatcaaatacattgtattttattgcacttaaactgtctgttatagttcctattccaaccccttgtatatatttagtattgtattttgctcctcctgcattatagtctttggcatttttaatacacccttctactataacactcattaaaggagctggcatatgcttttgatatattttttctattacattatttcctttaacctttatattgacaaaatgatgtaattgagctttaaaagcttcaaataattcttcatacgatttaaattctctagcatctccagtttctatacctagcttcttattagtcattggatctataccattatttaaagttatttcaagtattttaggtaaatttaaatatccagtaagtatataagcttctttaccatagcatccagtttcaacacatccgctagttccaccacatctagcatcttctatagtttttcctgcctctaataattcttgcattatagcttctgtattataaaatgctggttgaccccagccttttctagatatttcacaagctctttttaaaaatttacttggagtttttctacttatctgaacatttgaacttggttgtaataacttcatttcatccattacatctagtattatataacttacatcattaactccatctttaccatcttctgttattccaccagtatttatgttggcaaaatcagtataagttccactttcttttagcgtaactcctacttttggaggtgctggttgattattaaatttaacccataaacactctaatatttccttagctttttctctatttaatatattgtcatcaacatctttttcataaaaaggatttaaatgttgatcaaatcttcctggactaaatgcatcccatatgttaagttcggttgtaaccccaacatgcacaaaccaatacatttgtactgcttgatgaaatgtttctggcttattagctggaactacatcacaattttttgctattaataataaatcatctttctttttttcatccttttctttagatgctaattctctagcatattcagcataacgttttccataagatattattgcatcacaagcaatagacataccttctaattgtgattttttatcatatgcattactatcatttataaaatctaattttgatatttcttcttcaatctcatttttaaaatctaagaatccttttttgtatatactccctccacaaacagtatgacctggtgctctttgttccataaactcagtaaatattccagattcatagcaatctaaccattctttttccatagagtttactattttctgtcttatttgtctgtttttccaaaaaggtattatttcttcttcatgaatttttttaacttcatcacttactttaaatgatataatttctcttttatccattatgtctaaatcttccattgtatgacaacataattctggataagtaggtgtactttgtggtgaatcccctttttctccaactataagctctccatcatttatacaaagagttctattttccatataatgcttaaatgctaatgctctaagtactggtatttcaacacttccttcatattttttatatccttcagttataagttttgctctttcaatagttataaatggttgtgtatcaacactttgctttcttaacttcttagttctatcaaaactccctctttccataaagttatcccccaatctttgtattaaaattatttttttcgaataatgcttttatctcttctaatttttcatccgaaggtctgcttaaattttcgccttcgtaattcatataaagctttttatatttatgcatacctatattatggtatggcaataaattaacttttttgatatttaaaaattttatgaaatctattatttttataatttccttattatctctatcaacattaactccttctattaaaggtattcttatatttatatttgcacctttttcacttaatttaactaaattgtctaatattaaatcgttaggcttattagtaaataacttatgtttttcattgtctattagctttatatcatataaaaaagtatctacaaatggtagtatagcttcatagttttcaaattttgcatatccacatgtatctatagctacatttattcctttttctttacataaaataactaaactttttatatattcgatatcttgagtcattacctctcccccagataatgtaactcctccattagattcttcataaaacatcatatcttttgttatttctttgattaaatcttttatctcataagttttacctactatttctctagcattatttaaacaataatctatacaagtttcacaaaatttacaattttctttatctagacatatcaaattttcttttgtatatatagcattattaggacattttttaatacaagtttcacatcttaaacacttttcttcattatataaaacttctttattatattcttggctttctgggttatgacaccatatacattctagtggacatcccttaaaaaatatagtagttctaataccatctccatcatgtaaactatatttttgtatatttattattaatggttttttcatctaatcacctgcaaatattattttttcttattattaaaagggtttggtgttgcaacaactactattctaaccattttatttgtgtaatttgcccagttgtgatttcgtgaagaattatagtgtatgctatctccagggtaaagttcatgttgttctccatctaaaaataaagtcaaagttccttctagtacatatataaattcttctccttcgtgcatatatgattgtatatcttcatcagtattattaggaagtatatcaacaagtctaggtagcatttttttttcatttaagtcatttgacaaattatattgaatgcatcctgatgtacatatattaaatacttctttttcataacttctaattattgcttttttctttgttcttggctttaaaaagaaataagatagttcaacttcaaatacatcagctatagttcctaaagtatctgttgctatacttgttaatcctctttctagttgtgacaaaaaacctatagataaattagttttttcacttaaatcttttaaagtcatttttcgttgtgttcttaaatgttttattttagctcctatatgttcgttcattctatccctctctttttgtaaacattttccttaacttaaatatactatattgttataaaattgtctatgtaattttgttatattatgaaatttttttagtaatagttaatttattaaaattcaacttttatatcttccttaatttttatatatagtaaaaaaactataggttaaaattaacctatagttttatttcatcagatttttctttttttaacatacaaactataaatcctataaatgttatagcaattgacattatatataatatcttaagtccgaacacatcaataccaagtcctactggtaactttataatagatgatgatattcctatagccattgatgttattgttaaagctgttgcttgtatttcacttgagaatttttcttttatgtaacctatatatgctactagcataattgaaaatgcaagtgctgtaagtggtgctgtaattataaacattgttggtgaacttgcaaataagcaagttatccatctaagtaagaatgttaatatacctattttaaatacattcttatatccatattttaatactaacttattaatttttgccataaagaatatttcaggtaaagcagtaaatattactaatgttcctatatctccttgacttgcacctagttctattaaatatagaccttgatatgcattagtaacttcactaatacttatagtacttattactataagtaataaccataaatatgacttatctttcaataactcttttaaatctttctttaaagtagatgtttccattttttcttcttcatcatactttttagaatttaaaaaaggaagtactaataaagatactataaatagtgttatatatactaaaaatattattctagaatttgaagttacttttataagttgtccagttaaaaaacttattaaagcaaatcctacagatccaccacttcttattattccatagtttacattattatgtttacagtaatctgtagctatattatcagctaaaggagatattgcatatctaaaagcttcagctaaagtcgctactaaaagtaatattgggaacatcttaacactagaatacatacccattattacacagtttatagctacacatattccaagtatttttttatcttgtttagttacatccgttataattccccataatggtactactaatatacctattatagatgggacagatgttattattcctatttgcgatgcagatagatttagtgctccatctaaatatggaactatatatggtataaaagcacctaatcctccatatataagcacataatataaataatatttcttcatgtcttgcccccttcggtcagttaaatacactctattatatcataatttcgtttatgtatgataaaaaaagaaaggatttcattcttttttatttgtttattttttatatttttaaccaaaaatgatatttttatttttaaatttctacttaatttttcaatttccattgattaagttacttttcatattgcaaaaaatgctataatatatatagtatattacaagttcacatacttaagttatattaattgtaaatatgaaaggtcgtattttatggatataagtaaagaaaatatagataaggttggatatttaaacgaaaattttaaaattttccatataaaagatatgaaggatattaaatttgattaccatcatcatgaatttaataaaattacaattttaatctctggagatgtggattatttggttgaaggaaaatcttataaattaaaaccttgggatattttatttgtaagtaatacagaaatccataaaccaattataaatcctgaaaaattttatgaaagaatagttatttggattaatcctaaatatatagaaagccacaattacggtgatgatttatttacttgctttaatatatctagcaaaaataaatctaatttacttagacttaatcaaactgacttagataatataaaaaatttattatttagtattaaagctgctgataattctagtgattttggtcatgttatacttaaaaactctttatttatgcaatttttagtgctaattaatagattgtctcttaaaaatgataatacttcagatgatgttgaatatgatgaaactattcagcaaatatttaattatataaatgaaaatttaaataaagatttatcaatagatacaatagctaataaattttttatgagtaaatattatttaatgagaaaattcaaatctcaaactggcagttcactacatagctatatagttcagaaacgacttatatatgctaagtcattaataaaaaaaggttatcttatgagtgatgcatgtattgagtgtggttttaaagattactccagttttgttagagcttttaaaaaatcttatggcgtttcacctaaacattatttagatagaataaatgagtttgaaaaaaatccttttgaaatagaataaaaaatgcttaaataaaatatttaagcattttttgtcttatctcataaataaaaaactattcatactattaactattataaatttatattttgtcctatacctttttcaatagcttttttatatattttattagctactaccatatcaaataaacccatacctactgatttatataatgtcgttttattatttacatcaaattctttattgtccctaatgaaatcccccatattttctatatcttcagattttataagattattttttataggtaagtataaatctccactttcttctttcgcaaaatcagtatcaactataactttatctacaacttcaaacaaagcatctggtaactctctcatatcaggtttatacgatcctatagctattatatgttttccttttagtaactctttttggttatctataactggttggtatgaagttgtagcagttattataacttcactattttttaataattctaaagagctattaactacaattacatctacgttttctaattctttttttagttcttcttgtaacttaatagccttctcctttgttctattatatagatatacagtctttatatttctcgctttacatgcatataaaacttgataaaaaccttgtactcctgtcccaattaatcctagagtttttacatcttcacttgtagtatatctaactcctactcctcctacagctccagttctagctgctgtaagtgttttcccatccatcatacaaaccatctcaccagtttctatatcatttactaacataaccccatctataactggcttgtttattttagcattattaggggcaacagtaagtatttttgtcccaaacgctttttttgtaaagcatggcatataaagtgttgttaaatcatcattttctacttgtattctatcaggcatattaaatgatttatctgcatatattttataagcttcttctactgcatccataaattcatctaatgttattgattttagtatatcttccttgtttaagtatatcatgttaaactcctttcaggatttttatatgtatatttgttattattataacatttaaaactaatatataaaatatacaaatcaggagtatataaaattcaaaataagttatattttatatactcctttaaaataaatctatcctatttttatgtaatctcctgatacgtatccgtatcctccattatattttatcttatgccatccatttttactttctactatctctaccttagtaccatcttttaacgaacctattatagttttattagatccatagccatttcttatatttaaactcgttgccgttactgttccagacttagatattgttaaagattcattaattgcactacttgatgtttttatatattgccctgttatgtatccatatcctccattatattttatcttataccatccattttggcttcctataatctctactgttgctccatttgataaagatcctattacaggataatttgtcccatatccacttctcacattaagcctagtagctgttactattcctgtattttttactattggcttgttttgttcttcattagctggtggtgctactacagaaccatctatttttatataatctcctgatatgtatccatatcctccattatattttattttatgccatccatttttactttctactatttctactttttctccgttttttaatgaccctatcttagcataacttgctccatatccatttcttacatttaagctattagctgttactgttcctgtattttttaccgttggcttattttgttcttcattagttggtggtgctactatagaaccatctatttttatataatctcctgatacgtatccatatcctccattatattttattttatgccatccatttttactttctactatttctactttttctccgttttttaatgaccctatcttagcataacttgctccatatccatttcttacatttaagctattagctgttactgttcctgtattttttaccgttggcttattttgttcttcattagttggtggtgctactatagaaccatctatttttatataatctcctgatacgtatccatatcctccattatattttattttatgccatccattctgactttctactatttctactttttctccattttttaatgaccctattttagaataatttgctccagatccacttcttacatttaaacttgttgctgttactattcctgtatctataacttgattattttgatctggattttcaggagtctctggttcaataggtttatttacatctccattaagtgttatgttttcttttaagtatttttctattccattagctataccagtagctaacttatcttgatatgcaggatctgataaatttgctgattcagttggattagttataaatccactctcaaataatgcagctggcatattagtttctcttaaaactgcaaagtttgctcttttaatacctctacttctaacgcctgtttcatttatagcattagtttgtatatcttgtgcataaggtctatgatctcccttatttgtatgatagtaagtttctataccattagcactagttgaatctgatgaattttggtgtatagatataaatacatctggtgcatactgatttgccatattagctctttcacttaaagatataaagttatcacttattctgctcattttaacttcaatacccttagctattagtttctgcgctacttttttagcaacttccagattaagttcatcttcatagtgcccatttccaacagctccactatcttgtcctccatgacctggatcaacaaacactttataatagtttctatttacttttggactagatgcaaaattatatgatcttattgtatttttagatacatgaacttctattatatgtactttatctcctattttttgacttaaaaatactgtacctggatttataggtgttacgataccattttcactaatctgtacggtattattgtttgatacttcccaatttggattagctgataaatcaagtttttctccttgtcttagtgatatcccatcttccatttctatattttctgatttatatttatccatcacagatgtaagttctgattctaaatttccattagcacttactggaatcacgctacctacagtagttgctgctgatattattccaaaagtgacgatacccttagtaaatttattaagttgtttgctcacttttacaatctcctctatgcattaatattttttcaatatttttctatactactatattttaacatatatcatctagctctttcaaattaatgcaattatttggtattgtcgtcattttgttaaataataaaaaagataagcaaaaatgttttattttgcttatctctttgaaactaattatttaatatattaacaagtttaatcaatttttcctcatcaatttccccaaaaggacttttatctactctaactgctgttccaaaatgaaaatctgtattttgagttagctcttttatatttcttatattatcaaaatttaagcctcctcctaataaaacttttatgtgcttagagttttttttcatctgatttattttatctatattatcagctatatttccttttcctgctgacgttaatacattagttattccattatatttatttaatatattaatagacttaatcacatcagtttcatctatagctctatgatatgtaacatctaatcctttagctgcttctagtaatgttataagttgatcctctcttatgttattgttactatctagcattccaaatacaacaccattagcacctatttcttttactttttctatatcccttaccattatacttatatcttcatcactataaacaaaactcttagcatgatgtcttatcataacattaacaggtatatttaccttgttaactacagcttctataagtccaaaacttggtgttaatccaccttctgttaatgcacttacaagttcaattctatctgctccacatttttctatagctattgcatcctctacactcatccctataatttctaacatttgtcctccttagctaactcataaatagcatttgcaaatattttagcatttaatattatatcatctatatccatatattcatcatgattatgtgctatacccttttgcccaggaaatgaaggaccaaaaggaactatattcggcataactttagcataagttccaccacttgtagtcgttggcgttccatctaatcctgtaactctttcatatgcaagttgtaaacttttaactaaatgtgaatctttatcaaagtttactggattaaagtttctctctatatttaaaactatattaaagtctaatactttttttatagcatctgttatataatctatcttgcaagtcatagggtatctaaccccaaagctaaaagttatttcttcattattgcattttaactcataaggagctaaatataactttccagttaatttatcttcaaaatttatacctaatttttctccataatactcattgtagaagtatttatctataaatttgaagaaattatttaattcttcatcatttataaagttctcttctaataaatatttaataacattagttatagcattttctccaacttgcggtgcattagctggagcttgcttcccataagcgcttatagttatagtttcactatttatttttatatctattttgtcgcttatctttatagtatcattttctatactagttctatcttctaaatagcatataatatcttcatgtatatatatctttggtatatctatattacaattatctggtatcacgttagccctaaaatcgccatacacgtttataccagataaattaattttcttttttatatttaatcttcctatacctctttcaccatacactacagggtatttacaatctggagtaaatcccattataggtggtttttctttacttaagtaatatggtatatcattaaatcctgtttcttcattagttccaaaaattattctaacttttttatctagcttaatattagaattagctattgcttttaatccatacaaagcacttattataggtcctttattgtctaatacacctctaccataaatttttccgttgtctatttctcccccatatggctcatacttccaaccactaccttctggtactacatctagatgtccaactactgctacgtaatcttcaccttctccaaattcagcatatcccatgtatccatcaatatttttagttttaaatcctagtttttgtgatatttcaagtgctttgtctaatgcttttccaacattttttccaaaagggaaaccatctagcggttccccttcaacactaggtatttttaccatatctacaatatcatttaacaagtcattttttaattcatctatttgattatttaagatatccataaaatttccccaattcttatttattctataggtgctataattctagcagcatatgcatctaaccactcttttgatgctacttcgtgcacactcttaccatctattctattacttacataaactgtaggttcatgatcttttgtagctactgaaaaactaaagtttggtatattagtagctactccccattcacctttattattcattgcaactagtgataaatctcctgctttacctcttctttttataagaagttcatccaattcgttaacagctttatcgcaagcttgttgcggagttaacccttctttcataagcctaactatttcatatgatatacaacctttcataagatcttccccaagacctgtagcagttgctccacctatctcactatcaacgtaaaatccagaacctgataatggagaatctcctactctaccactttttttcataaataatccactagtagaagttgctgcacacattttaccattaccatctaatgtaaccatacctacagtatcatgccctacatatggacttagtccttgttctaaagtttctttttttcttttattgtagtgttgtttagctctatcagttaacatattttttctttcaaatccatttttatgagcatattcctctgctccagttcctactaaaaaacaatttactttttcatcacttaattttctagctattgatataggatttgcaaaatctcttatcccagctactgcacctattgaaagagtatctccatccatgtatgcagcatctaattctacttcacagttttcattaggaagcccaccatagcctacagacttataaaacggaaaatcttctactcttttaatagcaagttctatagcatctcctgcttccattccttcatttaatttttctgagctttctgttattccttctattgccattctccaagtagctattattccccacatatatctttcctccatattttacttatattttaatttttattttaatttttgttttaatacttatttttaataaaagccttggtttcccaaggctttatttttagaagcaaacttcttgtcttaatgtagatatatcttcattctcagcaagttttttcgccatttggcaaatattttttaaggattcattaagtcctataccaccttttttaggtgtcttaactattaatatttcatctttatatttttctaaaatttcagtattttcaacagacattgcagcaaaagcttttatatcagtattatcatttatacttttagctactatagctgacattttagcaaagttttcatagttaaatgctggtccacaaactactacatctggatttattttttttaccatggcaaccattttagaagttacttcttcttggttatttataaaatattcatccccacaataaagacttgctacaacttttgaatcaacttcttttagataagattccatcattactcctggtcctaatggagtctttttcccacctggtggtatatttgctttttctttaccaccagcaccagcttgtatttgatctaatataagaactattttagtcatattagttatctcctaaattaaaattctaaatcttcaaatgataaatcatcttcttcttcaacattattttgttcttcagataaatattgtttatctaacatttttataaatggcatatacataaaacatcccactattaaaagcaatacttgaagtactgatgcttgccatccacttactaagaatccgctaaatattattggagttgtccaaggtatttgaacaccattagttaatggtaccaatccattatccatacagaagtaagtaactatctggttaaacataggaacaaacataaatggtattaataatattggatttaacattataggtaaaccaaatattataggttcatttataccaaatactccaggtaagaaagataacttagctaattcttttatacgcttacttttacatacaagtagcattacaattaataaagaaagtgtacttcctccacctccaaaagttgcaaacatatcttggaactgtccagttattatgttaggtatttcttttccagcttggaaagcctctaagttttcagctgataataactttaatattggattataaactgcaccaacaacacttgatccatttattccaaagaaccagaataagtgtaagaatatgtaagatattactgtagccgttaaagtatttcctaactttaacaatggcatttgtaaaaacttatatataaattcatgtatatttccatatggagttaactcgaatccagtttttattgaaaagaatattatcattattatagcacttggtattaatgcagcgaatgacttagaaacagttggaggaactccctctggcatttttatagtccaacccctattaactacccattggaatatagcaactgatacgaaagaagttatcattccaacaaacatacccttagatcccatccatcctaatggtattccacctacttcatatacaacgtccataccttctggagtataaggtattttaaatggtgttattatgaaaaatgcaactaatgcaactgcagctgcttgtatagcatctgctttaatttgtttagcaaacgaaaaagctattcctataattgcaagaatagtcattacatcaaatgtagatgctgttacatgagctaatccacttgcccaattttctccgaaaaactttgcccaaaactcattccatcctggtattggaaagtttgctattagtaagaaaaacgaccctactattagtagtggagatgacactaaaaatccatctcttattgctactagatacttattcttaccgattttttcggccataggcataagcatcttttctaaagttgacataaacttattcatgtttaccccctaatgtaatatgtaattttatataaaagaagctaataaataataattaatttaaattagcttctttaatatcaactttgattttgccccttaaactcccttagtcataaaatattaaaacctattacttagcttgacgagcttttatcatttttatagccgtttttaaaaccttttccccattcatagaaccataatctacactatttataacatctaccggagttttttcgttaaatttagcttgaacttcttttaacataaatttaacttgtggtccaagtaatatgcaatctggatttttttgttctactattttatctatttcagaatatggaaatgcttctacctctattggtaaattatgttgatttgcaacattttgcattttactcgctaataagcttgttgacatacctgcactacagaataaatatatttttttgttcattttaatttcctcctaaaaacctatatattttaattattttttaagcctatttcttttcttaaatctataatttcttttactaaatttctttcacttaaacaagtcattaaatgatcttgagaatgtattaaaagtatacttatctctatatttttcccctctgaatctttattgattaaactcgtttgtattttttgtgctgctaatatttcttcatttgcactttccatgtattcatcacattttttaaaatcattctttttagcataatgtaatgcttcatatatatgtgatttagcatttccagcatgaattataacctttagtattttatcttgataatccatattttcaccccttacttaaggttttattttgttaacgttttctttaactatattttacattatatttttaaaaaaagaaacagtaaattgtatttttttaaaaatttttacaatttattttaattttatgttttattttatttattatagttttttcaatgttcatatgacttatttttacattagagggctacgattatatatataataacttattttatgcttatgttttaaataatttaattattcatatatatttttaaaattagtttcaaataaaatgcaaattgcatatatgtataatgataggataagactattaaataaattaatatggagtgttttaaatgcataaaaattgtgactgtaattattgtaaacctagtaaatgtaaatctaagtactattatttagattattgtaatgaagatgagtatacaaaaccttctaaacctatgtatacttattatccatgtgaactagatttgtataaaaatttagtaaattgcatcggaagaacacttggttttaaattatcatgtagtgattgtatattaagacttaaaataatgaaaataacaccttgtagtgtatatggaatgacttcttctggtaaaggtcctatatgcgtaaaattatcagctatagattacgttgattttggtaaagaagtatatattaatccattatgtaatataaatactttagaaatattaacgttacctggagctcaaggtcctaaaggtgaaaaaggcgaagctggtcctcaaggtcctaaaggcgaaaaaggcgaagctggtcctcaaggtcctaaaggcgaaaaaggtgaagctggttccaaaggtcctaaaggtgaaaaaggcgaagctggttctcaaggtcctaaaggcgaaaaaggcgaaactggttctcaaggtcctaaaggcgaaaaaggtgaagctggttctcaaggccctaaaggtgaaaaaggcgaagctggttccaaaggccctaaaggcgaaaaaggcgaagctggttccaaaggtcctaaaggtgaaaaaggcgaagctggttccaaaggtgaaaaaggtgaagctggctccaaaggccctaaaggtgaaatgggagtagctcctagtaaagtaaagcctgttccttatgctcctggtaaaaaaacaccttataataaataaaaaataagagcgctagtattagcgctcttattttttatttattaacctaattttttagatataaattcatacatatctacaaactctttagctaattgtaaaaagttcatagttgtcattaaatgatcttgagaatgaactaaaacaacccccatttcagttttttctccagtagcttcagcttgtattaactctgtttggaatctatgtgccttatttaaagtttcactagcctcttttaaaagttctctagccttttcaaaattaccttctttagcttcggctaatgcttcatgtgcagtgctctttgcatctcctgcatgacctattattccaaatgatatttcaaatattttttcattcatattttactaccttcactttcccctatatttctataattagttatttttatatcattactttcaaaaaactttttaagctcctctgaagttaaaatctcatgctctttagttctctcaattgagtaagaagttgattttgataaaaatgcatctacaaatgctggatgactcataacatctacaactttatattgtttaatttcatcgatatgtttttcaaagtaatcggcttctacatttttactataaaaacttcctaacataggaactattttgtcatatttaagctcatactcaaatccacctcttataggtaaatcatatttttttaatatcttctctattactggtctaaactcttctaatgtatgtacatggtgatgactatctaaatgagttatttttattcctgcatttatagccttatctatttgtgcacaaaattcattatatagttcatctaaatcaaattcattagctttttctttagttatccttttaaagaaaaatccattttcatccactaaagtcttatgagtatttaaaacaggtttataacaacttaaagtcatatgtactccacatccaagctctttattttcctttaaaagttctactgcttgattaaaccctggcatccctgccattattgtacaagaatttataaccccatttttatgtgcagatattataccttgatttacaccttcgcaatatccaaagtcatctgcatttattattaatttagtcattagctgcacctgcctttagttgttctattttttcttcaaattgaggcaaatatctttcatgtgctattaacatttcattcataatagtctcagctaattcatcgcttgtaacaagtggatttatagaaagagcttgtattgaaatatcataatcccctaaaacagcagctttagctgttaaaatttcaaatgattttatttgatttaaaagcccaatagttcctactggcatttcccctatagctaatggcataggaccttctttagttataactgaacttatttctactgcatgattataacctatattttttatagcacctttatttaaagtatttacaacttgtatatcttttttatcgttgtatatagaatttattaaattacaagctgcgtcactgtagtatgctccacctcttttttctagttgtggtggctttatatctaagttttcatctttgtataattcaaacaaatcttcctctaatgctttaacaacttctgcacgagtttgacctttagcaaattcatttaattcgtgttctagcatatccttagtcttatagtaatatctatgatatggacaaggtatagctcctagtgattttataaatcttggattaaaaggtgctgttgattttatatttctcatactcatttcagaatttgcaaatttttctatagcttcttcagttatatctactccatttaaacaagccttaactccatataccatatgattaagtcctgcaaatgtaacatctaaatcttctttttcaactcctaaagcttctgcaactcctgcttttacccctataggtacattacaaagccctataaatcttttgaagttagtatgagtaaataccatctcagttattattcctgctgggtttgtaaagtttattaaccaagcatttggacaaagttcttctatatcttttattatatctaatattactggaactgttcttaaagctttaaaaaatcctccaggaccattagtttcttgccctataattccatgtgatagtggtattctttcatctttaattctagcatctagtagtcctactcttaactgagtagttacaaaatctgcatctactaaagcttttcttctatctaacgttgtatgtatagtcatatctatgccagctttttttaccattctttttgctagatttccgactatctctaatttttcttccccatctttaatatcgactagccataattcctttacaggtaactcattatgtctttttataaaaccttcaacaagctctggtgtatagctagatcctccaccaattgtaacaatctttaatcctttttccattatatccataggtgtaaaatacaccttccccctctccctaagttaagtaaaacgtttacatacttaaaatatcatttttcgccatagaaagcaatatatattttaaattttatttttaattttattttatatttcatttatataatttaactttaagccaagtaaaatttatatcaattttcgctttcttattttcctaatacatacttatctttatcgatacaatatttttcgtataaaagattaggattttctataattttagttttatttattctagttaatttttttaaaaagcattctagtttcatagcttcacttttagttttacttgtccaatatatctctaattttttaaatccattagctctagtatatttagaatttataccctttttatgttcttccattcttctttttatatcacttgtgtaccctatataatatgtttcatttttacaagttattatatatgtgtaatacataaaatcctccaaaaaataaatcaggcagctaaaagctgcctaattttaatatttaacagaatataaatataatcctttagctggtgcagtgtctgaagctttacttctatccttagcttctaacataactttaatatcttcgggtgtttttttatgtaaacctacatctattaatgcacctactattattctaaccatgttgtataaaaaaccattaccttctacatatatatctattacatctttatttttattaatagttatactgtgaatattacgtacatttgattttttctttgactttgaagatgcaaaactagtaaaatcatgttctcctattaggcactcactagcttttttcattaactctatatctaattgcttgtctatgtgagtactgtatttcctaagaaatacgtcatgatgtttagcattatttattttatataaatatactttttgtttagcattatatctagaatgaaacctgtcactaacttctttaacttcttttacaacaatatcttctggcaagtatttatataagtaatcacttattttttctactgagatagtagaactagttttaaaattagccacttgattgtaagcatgaactcccatatcagttcttcctgaacctattatctctatatgttcatcaagcattttgctaagcacagattctatttttccttgtatagtgttttcattatccttaagtctttgaaatcctttatatcttgaaccatcatattctatgattagttttatatttctcatattaatcctctttctacacagactctactagtatatttttaagtgtaaatgtaatacatgtaccttcaccttttttactttctatattcatttctccatcatgaagttttactatttcattacttatagcaagtcctaatccgcttcctgctttgttataattttcttggaaaaatttatctaatactttttctaagttatgttcttctattccttctccattgtctataacttgtataattgtatattcttcattttgatctacaataacttttacataaccttgcatatcagtaaactttaaagagttttgaactaagtttataagaacttgtcttaatctatttttatctccttgtatcattttcatattattatttgcaaattcgtaagttaaagatatattttgttcatttgctttaactttaagttgattaacaacactattagctaatgaacatacatctaccatatctatttgtaacttaattctatctgatgataatcttgagaaatctaaaagttcttcaacaagttttataagcctttctgtttcatcttgtataatacctagacctaaatccaattcttcttttccaataccttcatatcccaatgtttcactccatccctttatagatgttaaaggtgttctaagttcatgagaaattgaagatataaactcctcttttaacttttcacttttatcaatttcctttgccatatgctcaaaagtttctgctagctcaccaatttcatcatcaattatagctcttggttttaattttatattatagttaccatgtgctaattcattagcaaattttttaagctcacttaaaggatctattaatgtatatgcaaattttaaacttatagagatggctattaatagtataaatatacctgctaatataagccctaaaattattttaaatatagtattatctatctcattaagtgatacagtatatcttactattccttctatttgattgttaaactttaaaggaacagatatgctcattacatgttctccagtactttttgttctataagtagctgttgttatattatttttaagtgcttgatccacatcttcataatgagctttttgattgcttctaaatccatattgatctattattatatttttatctttatttattatctctacagccatttctgagtttgtatttatatcttttttctcaaatatattatttattttttgctcaaaggaaatatcacccatatagtatctactatataaatcttcaatagttttagcttgatgcctaagagtttgtcttacagaatcatagtaataattttgagcataaaatataaataacccttcaaataaagttactgtaattattattattataaagtaattttttattatctttttcctaagtccttcaaagtgtatcactactcattttcctttctccagcagtaaccatatccccaaacagtttgtataaatttaggttttgatggatcatcttctattttgtttcttattcttcttatatttacatcaactattttaaaatcatataaatagttagttccccatacttcatctagtatttgatctctacttagagattgcttttcattagttattaaaaatttcactatagaaaattctgttggagttaattctatctctacattatttttaatcaactttcttttttctaaatctaatacaaatggtccactttccattacacttttgtttttactatttgcttctctatttattcttcttgaaagtgcacttactctcataagtaattcttttatactaaaaggcttaaccatgtaatcatcagccccagatataaatccttctattttatcttcttcttgagatttagctgtaagcattattataccaactgaatcaaaattagttcttatatatttacatacttctattccgctcatatcaggcaacattacatcaagtaaagctatagatatatttttttcattagatattttatctatggcttcttgtccagttcctgcttctattacttcatatccttctctttttaagttaatacttacaaaacttcttatacctatttcatcttctaaaactaatattttttcactcataatacttcctccctctaaattaataaatttctaagaaatatgattttaaagcatcattagatatatctaatttatctaaaatcccttgattattaactaataacataaatgattcattttcattttcacgtattataaatccagtattatttgtgtttgtatttgtacttgaatggctattgttatctattttattttttactactttaactatagtaaataattttataggttctttttgtttttcatcataataaagaaattcaaagtaagttttattatctttgatattttcttctacatatactttatctgctaaactatttggtaaaaataacttaaaattatttacataattgtaataaatttgacttataaatataagttttgaattttcttttgattttccattccaatcgtaccaactaacattagctgacaattttttattatatccttttgtattattgtttattattggtatatcaactattccatcatcatttatatcttgtacaggcatataatatggatttttagtttttatatctttttcatcaaaagcttttaatagtttattatcatctaaatataatatttgagtgatatatgaatcatttcctgtaaatggttttgtgcttacaacaattccttttttatctttactaactttttttatatctatataggtattatctaaactcttaacatcattaattaaagcaaaatctttaagttttatatatttatcaaaatacgttacactaactgccatctcatgtgtttgtggattaaaacttgttattattatgtatggttttttgtcattatctaaatcttttacttttattttcatctcactgtattcattgtaattttttatccaacttggatcaaacgtacttaatctagtgattttattatttttaaacctacatatttccaatttagttttattcccttttttagtaaataaaattatttctttataaccatcattatctaaatcatagaaattagcatactctatactatcaccattaactaaatattcatcagtttttgagtaactactattttgactatcgtttaaaatatcaaatccaactttattatttccttcatctacatcttcatattttttaaatacaactaattcttttgaaccattattatctaagtcaacactatttataattgatacttcagaagaatttttaggtagtaaagtagttgcatctttttccaattcagcatttattttatcatataattttttttgttgctcatcatatataggcttttttattaactgttctggagattctgtactagtacatcctacattaaataatccagcacacaaaactactacaattaatttaaataacttcatttatttcccctctctgtttctcaaataagctttaaacctctctatgttttcaagttccttagcctcaacttctttggttatattgcctctacccaatctatcagctgttgataaaattgctatttctttgtaatctgtatctcttatcatatctttataactaaaaaatggtaaatttttatcaaaaaataatggctgcatatgatacctaactaatttagataccttatatttaaaatcttcatcatcagttaacttgtccaatattaactttgaagctttttcaccttcaacatcatgattataagaagtaattcttccttttctaatccttgtagttgtaagttttccaatatcatgaagtaatgctccccacataagtacaagcttatcactagaattctttttaagttttgaagcattatcaactaccattaaaacatgatttaatacatttccttcagggtgatattttggattttgatctatattttcaagcattgatagcttgtctataagctcaatatcataaattttatttgatattatgttttttatatatatagatggtttttcatcttctattaaatgactactaatttctttaaaaattaattctttgttcattaaatccacatccttaaatttaataagcttttaaaataagggcttaggtataactaagcccttattttaatttattcttcagagttatttatttcttccaaagtttcttcttctttaatatttgctatttgctcacttcttataacatcattatctttatgatttttagaagaattagtggacttttttgattttgggaataaattcatattcaattttattccaccttttttagtcttatttttagaattttttttcattccatagttttctttttctctttcaggaactaaatcatttaatacaatttcaacctctttatcttctttatctataatttcatttaatataacatcttcgtttggtataatttcttcgttagaagtttcttttattttatttttgcttttagttttattaactctttttctaggttgaacctttttacttttttttgatgatattctcatatatatctccccctaaaatttatttatacattatatgtatatttcagagggcttgtaattatttgttattatttatatattttggtggcttaggtcctatatattggtatatataagtttttaatctaccattatatagttttcttttcttattagcttttttattaaaagcattttcaaagtcttcatatgaagttaccatataataagaccaagttttaagttctttaaatgcatatcctaaatctttatataactttttaacagtttgtttatcttcaagtctttctccataaggagggttagttattataaatccaaacttttcttcactttcaaagtttttagcattaaacaccttaaactctacataatcttcaactccagcaagctctgcattttttcttgctatcattacagcttctttgtctatatcataaccatagattttaaagtctgtatctgtgttcattttatcaaaggcttcttttcttacatcccaccatatctttttatccatagtagtccacttttcagctataaactcacgatttaaccctggtgccatattaagtccaagcatagcagcttctataactatagttccagaaccacacatagggtctactaatattctacctggttgccatggtgttaattgtaccatagctgatgccatagtctctcttaatggtgctttagttgatacttctctataacctcttttatgaagagccattccactagtatctattgctaatgttactatatctttgtgaataaatacttgtattggatatttttctttagtttctggcagcataccatcttcttgataacttatttttaaactttcaaccacagcctttttaactattgcttgtatatctggtgtagaaaaaagtttagattttattgatgacgctttagatacaggaaattctccaccatatggaatatattttgaccaatttatagctttagtattttcaaataagtcattgaaagtcttagcttcaaactcagcaacttttaaaagtactctctcagctgttcttaaccatgtgttagacatagctatacctttttcatcagttttgtatgttattctaccatcttctgtttttattatttcatatcctaaatttgttatctcatttttaagtattttttctatcccgaaaaaacacggtgttattaatgtataatttttcatgcttcctcctaatgcttgattcattcatgctacccatacgatagcctaataagtctaaggatacatatttaaatcctatctcttttaacttattatgtgtattttttagtaactctttatcaaaaaatttatgtatctcattttcttcaacttctattcttgctagatcattatgtgttcttaccctgaactgtttaaaacctaaatcttgtaaatattcttcgcttttttctatcattctaagcttatcatttgttatagtttctccataaggtattctagtggctaaacatgcaaatgcaggcttattaaatgtaggtacatttaattcttttgataggcttcttatatcttctttagttaataagctatcctttaaaagactttttatatctaattcttctaaagccttaagtcctggtctatagtctcctagatcatctaaattagttccatctaaaacgtaatttatattactctcttttgctatattttttatatttgtaaaaatagcttttttacagtaatagcatctcttttcatcattatctataaactctttaatatcaaaattatcaatttctaaaactatatgtttaacacccaaagcttttgtataagccttagcttcttctatttctctatttgaatgcatcatagcatgtattgttacagctatacatttatctcctagtgtatcatgtgctacttttaataaaaaagtactatctactcctcctgaaaatgcaattataacactttcaagttctttaagtttattttttaatacctctagcttgtttgaagtattcattcccatacactctcccattttatagtacctttaattatatacaatatatactttttaatcaaatattttagaagatgtgtcgatattgtaataatttgtttttatttgagttttttactatcatgttatattataaatttattaggggggataatatgactattaagttaaaacatttagaaaatttacttaggtgtaataaaaacattaaaattgggtttatagaaggtactaatattttagaaattaagaatttatcttcggttattttaaatctagaactttctaataatagtttagaagataatgcaaaaattatttacgattctattactaatttagaaggcattactttgtacataccgaaaatttatataccttaaatacacttattgtcaacatattttataaagtaattcatattataatttttcataaaacataaaaaaagaactctattatagagttctttttttatagttatttatttaaaagtttttctttccattcttcttctttaaatcctataagtacatttttcccatcaaatgctataggtctttttataagcattccatcacttgatagtatttctaaaagcttatcatcactttcagacttaactacatctttaagacctaactctctatattttactccacttgtattaaagaatttttttagttcatatgtaccagctttgtacatagtttctaattcttctttacttggaggattttttacaatttctatttcctcaaagtctatattattttcattaagccaagccttggcctttctaactgttgatcatctagaatatccataaaattttagcatatttaccactttcctttactgtcttttttatattattacacatatttagaaagtttaaaacattttttaaataaatctaattttattcattccaaggcactacctcaacttcaccataccatctttcttttaatcgatttgaatactcacccttatagttaattatgtacaatactgctagttctacatatcttgttcctatttgaagtatattccacatatcttcaaccgttaagttagctcttttcgtttttctagtaggatgaactattttatttctaaaatatgtaaatatatctattccatcatcaaatttatttttaatatagtcattaaattcatttaattcttcttttccattatatatattacatatttttagtaataatcttatattatctgatgcagtattttgttcaaactctatgtcacttaaaacttttgatttttcaacaactacaacataagaaagtgtttcaagtgctatttgtattgaaacaacattgttttctatactaatattatctagagattctatataccagtctataacatgtttaagtgctggtccatagtaagaatcatataattttctacacattaaatttatatatttttctatattatgatgattagctattgtatcagcccaagttggaacatatttaaatggagttactatagattctttccataatctaaaattgttctttccatctttatatcctctaactaaacatatacctacgtatctgccagctaaaaagctaagtgcatcagttatttcatctaataatttaaatatatatgttgatttaaatggcttattgtcttttctctttattcttccaatatgagttattatacttccatttttaaaccttaattcttcgtataattcctttctatagtcatatcgtttatctatagttatttcatatccactaacttcaaattctattcttccagcaaataacttatctaaagactttattaatttcccttgtttcttatcaaaatttacaatatgaaaatctacataatctacatatctatttttggattttattaaaccactacttacatatccatctatataatttttatttatactatttatagttacatgaataggttgatatccatgtacttctaaaattccttctaaaaattcatctttgaaaggttctaaatctttgcttttataatctagtattttagcttcaaaatttatacatacgggagaactaattttatagtagatccggcccttacatttatatagcttgtctaggtaaatgcaaaaatttccttcatgaataactatatcctcatcaataccataatctaggtacggtgaggatatagcttctcttactaccttcatttttagcccacctttatttaaacatagttgtcttaatattataacatatatgacaaataaaaaacatttataaatacgataatctttttagtcttctacattttcataaataagtttatcattttctaaaattgaatataattttaaatcaataaaatttcccttatataatttatcactcctaagtattccatctaatttcataccacttttaatcattactttttcagatgctatattatccgatacacatctagcttcaattttttttaaattcatattgttaaatccaaaatctataactttttgtaatgcttctgtagttattcccatattccaataatcaaaatttagtatataccctacctctgcttttttatttttttcatcatatttagaaaatccacagattcctattaactcattattttcttttaatgctactgcccatggggtaggtttatcatttttgtatccatctagaattgaatttaaaaatttatgagttgaatcaatatttttatcaaaatcgacaagcatatgtttgcttacatattcattagataaacatataaataatgtatttaaatcgtatatatctacctttcttaaaattaatctatctgtctgtaaagttggaagttttttaaacaaatttttcaaatttttacctccttgctcttataactactatactataaatttattgcacactcaaaggctaatcccaaatcacccataattaaattttgtcatatattgaaatatctatttatattaaatcgcttatatatactattcttcaaataaacttcatatcctatcttttataatggttaatataataaatgtaatttaatgcaaatactcaattccgaacttttttattcatttacattaaaatgtacatatattataatgactattgtaagtttttataactttaaacataattaggagggttttatgatgaaaatatataaggggaatataattttcacgaaaaataaaaataaatttgaaataatagaaaatggatttatagtagttaatagaggtaaagttgtaaacgtttttaataaacttccaaaagaatatataaataacgaaattatagattataaggataagttaataatccctggtatgaacgatctacactgtcatgcacctcaatttagaaatttaggtatggctatggataaagagttaattccttggcttaatgactatacttttcctgaagaatctaaatatgctgatatagaatatgctgataaaatgtataaaagatttgtaaaagaagtttggaaaaaaggaactactagaattgctgtatttgcaacagtacataaagaagcttctataagacttatggatatttttaaagcctctggtcttggagctttcgttggtaaagttaatatgaatattaactgtccagattcacttttagaaaatactaaaaaatctattgaggatactaaagatatattaaatatgaatcttagtaaagattctttagtaaaaccaattataacacctagatttatccctagctgtgatagtaaacttttaagagaattaggaaaccttgcacttgaatacaacgtagaaactcaatctcatttatctgaaaatcttggagaaattgagtgggttaaaaatcttcaacctgattctagattttatggtgatgcttatgataaatttaatttatttggtcaaactaaaactctaatggctcattgtgtttattctagtgatgaagaattaaatcttatgaaaaacaataatgtaatggctgttcactgtcctacatcaaacttaaatgtaggtagtggtgttatgcctataagaaaatttttagataaaaatatacctctatctcttggttctgatgttagtggaggacatgatttatctatttttaaaatgatagtttatgctatacagtgttctaagctttgctgggtaaattctaataaagaacttgattttttaagcctttcagaagctttttacatagctactaaaggtggtggaagtttctttggtaaggttggaagttttgaaaaagattacgaatttgatgctttaataatagatgatagtgaattaaaccatgataattataacttaatcgaaagattggaaagatttatatatattggagatgatagacatatacttcatagatatgttcgcggtaataaaatagatgaacctacgttttaacttaataaagtttttttagattatattcttttggtatatattttccactattaaaaaactttttatagtaaatactatttttagataacttattaaattatctaattttcattaaaaaggagttttaatatgtctaaatttactggtgtagttaaatggtttgacaatgatagaggatatggatttatatctgccaatgatggaaatgatgttttcgtccatcattctaatgtaaaagaaaacggacattgtaaagatttgcatgaaggtgaagaagttagttttgatgttatagatgcaccaaaaggtccatctgctataaatgttcataaaatgcaagtttaataaaattaaaaagagagtataaaattatattttatactctctttttgcaaaatctaaatttttatgttaactataatttaatttttagttttcacctaacatatctttaactaatttagctttgtctaaagcttcattttttatattactaattttatctttattattagttactttatctttaacttctaaaactttatctttagcctcatttactttactttttacttcttgccctttatttaatgcatcatttgttgcattatctattttgttctttccatcatttattttgtcttttttattttctaaatttttatctatttcttttaatttatcactagctttatcaactgtatcttttatttcatttccttttttataagcatcatttgctttattttctattttatttaatttgttattaacgttctgttttgctgagtttacactattttcagcattatctattttattatttgcactattaagttttgaacctatagattctcctaaaccacttgctgaatccaatgctttatttgcatcttttaatgtattttttgctgaatctaccttatcagaaaaaccatgagcaaaatcaactaatgaacttacatatgagtctgtatctatttcatcaaatttttctcttatttttttgcccacatcagtgtttatacttgctttttctgattctgtcttttcttttttctttatgtcattacttgaacatcctgttaaaatcatagttgatattaatgttgttattataagtatttttttattcatgactgcctccagtttttaattagaaatctaacctttttattgttttattattttactatatttttatgattttgtatatacaaaaaataaaatttatcaaaaataatgcctcaaaataatttatataaattattttgaggcattatttacattttttatttaattaatagattttacctggatttaaaatatttttatggtcaaatgccatttttatattttttattaaatccatatatgcttgactttgagattcatgcaaatattcttttttagcatagcctataccatgttctccagaaacttgcccattaagttctctagatttttcatacattttttcaaaagtttttgttaatttcttatcccattcatttttttctaaatcatctcttaatatatatatgtgaaggtttccatctccggcatggccaaagctttttattcttatattaaatttttcttgaagttcatttgtaaatcttataaattctgcaactttgtctcttggaacaacaacgtcacattcatccatttcagttgtagttgcttttattgcttcaagaaatgctcctcttgctgaccatatagattcatttctttcttgagtatctgatataaatacatcatatgctccacattctaaacaaagtttagctactttatcatattctttttcaatgtcttccttactatttccatcaaattttaataataaatatgcatctgaagtattgtctgggaatttttttcctaagaactcttcagcagcaagtattacctctctttccataaattctatggcagttggtatagacttagattttataatttttggaacagtttctatagctgtagctaaatctggaaatggtacaagtaaacttatatcttttttaggtaatggtaatagttttaatatagctttagttactattcctaaagtaccttctgaacctaccattaaatcttttatactatatcctgaactgtttttaacaactttgccaccaacatttataacttctccatttggaagtactacttctagtcctcttacataatctcttgtaactccatacttaacagctctcattccacctgcattagtatttatattacctcctattgtagcacttttttctcctggatctggcgggtagaataaatctttttcagttacatattgccctatagtcataagtaatacacctggttctactgttagagttaagttttcttcatctaattctagtattttattcatttgacttaagttaatcattataccaccataaattgcaactgctgctccaactaatcctgttccttgacctcttggagttacaggtatattgttttcatatgcatatttcattattttagaaacttcttctgtactatgaacatttactagtacttctggatacttttcaactcctcctaattcatcatgagagtaatcttcatttatattttctccaactaaaacattttcatctccacataaattttttaaaaattcaatatctttttcatctatttttttatacatcatgatttcccccaatccttattctactgaaactgcagcttgatcattatttgattgttctaattctatatcttcaataagtttaggtattacatcgtaaatatctcctactatggcataatgagctgtatcaaatataggagctttttcatctttgttaatagatattatacaatcagaaccattcataccagctacaaattgtatagcacctgatactccacaagttattataagtttaggttttacagttctaccacttaatcctatttgctttttagcatctatccatccagcttctactaaaggtctagttcctgctacttggccatctaataaatctgctagtttataaagcatatccatatcttcttttttctttatagctctacttccaactattataacttctgcatcttctattcctacttctttatttttattattaacctttaaaacatctatcttagaatttaatttattttcatctatatcacatagtgtaacttttccagttggattttcaactttttttggagctgtaaatattttgtatctaactgttgcaaattgaggtctatgatttggtgtatgtatgtgtgccattatatttccaccaaaagctggtctgatttggtcaagatcagtattttcttgtacatcaagtattgtacaatctgctgttaaacctgttttaaatctagcagcaagtcttggtgctaaacttcttccaagtgtagttccaccaaataataatatagttggcttaactttatttataaaatctcctacacatgcagtgtatggttctattctaaaatcttttaaatttttattatcatatacaaatacttcatctactccataagaaagtaatatatctgttttatcttttatattgtttccaacaaatacacagtaaactggttgattaatttttttagccatttcttttgcttttcctattaactcaaatgttactggatgtatgtctccttcatgatggtcaacgtatactgctatacctttccattcatctttatttatttttacaacttcatcttctataaattcaaatacaccttcaggtcctgttcttacacataatttacacatcttacatccagtacctatttctaacttgccattgtttaactctatagccccaaaaggacatatgtctaatactttttgaatatctttaactttatcttgatttataactatttttgccactttaaatcccccctataataactttaactcttttattttgttaagtaatttagatgctatttcatcaccatcacctgtccatacttctttttctatgtctgatgttggtgggaatatttttaaaacttgagttggagaaccattaagtccataatgtttttcatctttatcatcaaaatctttaagactaatcataggtatctctttatctttagttttcatttttaatttaaaagaaggtaatcttggttggaaaatttctttttctacagttattaagcaaggaaatttgacttcacaaatttcactagtattaggcatatctacttctactactatactattttcttttgtttctattaatttcgttacattagtaacatgaggtatatttaaaaactctgctatttctggtccaacttgtgctgtatctccatctgtagtttgttttccacaaattattaaatcaatatctccaaattttttaataccttgtgaaattgtatatgaagttgcaagtacatcagcaccagcaaattttctatcacttactaaagcaccttcatctgcacccatcatgaaagcttcatgaattacttgttttgcttgaggaggtcccatactcaaaactttaaccttggcaccgttttcttttttgattcttaaagctgtctctaaagcatataaatcatatggattcattttagaatctactccatctctttttaagactcctgttttctcatctacttctacttctgatgttcctggaacttgttttatacatactaagatttccatattgtttccccctttactttactattactgataccccatcaggtattaaagctactttagcatttttaccttttatgtcaaaagccattttaagggctttgtcaaagctacttgcgtgtttcatatgcatacttttaatcatatttggatcacataaatcagttaccataattacagtaaatttttctaagattcttgctagtatttgaaattcccattgatctggtattgttttatcctttggaatctttcttactttttcaagtatttcagtaggtgaagatgcatttgctacactatcataaaaagactgtcctccatgtccatcattacaagcagatatcataattattactccaccttccttgcatgtagcttctgctgctgtcattccttttactgtttgatatatgttttggtctaaaggatatcctccatttgtactaattacaatatctgcatctactgcatctactttagataatttagttacaaaatcacatccacttttatgtgccttttctacatctcctgcaaatgcccctataacttttttatctttatctataactacatttaatataaatgctaaattaacacttttagcagcatatagcatatctttatgaattggattattttcaagattacctgttctagcataaggactatctataaattcagaacagtggttatacattattgttttagccgatgctactcctggaagtacactttttcgtcctccagaaaatccagcaaagaaatgtggttctataaagccctctgctactaataaatcagtttcaactatagctttatttacaattaagtctccacctgaaggaagagcacctaccttaatcatagatttttcatctgttgcaaaatgcattattatttgttcattatctactatttcttctcccattttatatacaagttcttctcttgtacttggtctgtgacaacctgttgatattattatttttatatctatatcaggatttgaacttcttattttttttaacattataggtaatgttactttacttggtactggtcttgtatggtcactagtaattataaccatactttttttgccttttactagttcctctaacttatcacttcctattggtttttctaaagctttttttacaatttcatcttgactaagcgttgttttaaaatcatgagctttagactgcaaaacttttagcatgttttcatctggtatatttatattcataccagactttgagtaaggtacttttatctccatttctttccctcctattgaaatataaatcctcaagatatactatcttccaatattttaaaatcgttttcccgaaggttgttaaattataaagtttaatgtttttaatgaattgatatatacattttaacttaaattttattggtattatggtcttaccagtttgtacttttatgatagtaaacttcataataatttacaagtattgtttatgtattaacaaaatatatagtattatttaattttttatttactttcaatttttagcttatattttttaaattttttataaaaaaatatagattccaaatttttttgaaatctatattttatccatagtaatttttattaaatctaaatgttctttcatgtacttataagcattttcagggtctctagctattattgcatcacatatttttttatgttgattatttaaaatttcttcttcattatagtaatctactattttttgtcttgagtttactatgaaatcttcaagtaaatttagtgatattttatatagacttttaattaaaaagttcttgctcatacaagctattttgtagtgaatctttttatcaatgtcttctttatcacaattcttgtcattatttgttaaattttgcgaaatcattttcaactcttcaaattcttcttctgttccccttatagcagctaatttaacagcttcaagctctatcatatttcttagctctaatatctcctcataacttccgttatttaatataaacatcatcgaaataggttgtataagagatgattctatattgttgcaaataaagttaccttctccttgcctactttctattattcccatagtttctaaaactcttaaagcttctcttatcgatgttctactaactcccattgtttcagacaattcacgttctgacataagtttgtcccctttttttagttttccagttaatatcatatcttgtatttgatttattacttgttggtatatttttttattagttatattactaaacaaagttttttccccctttacatttaaatatttattagtatattatactataaatattgttaagcaataaaaaatactatttaaaacaatttatatttgcctcaaatagtatttttatattttattttttatctttatttaattctggtaaagatacttcactcattgatcctcccatattaaaatcaggtcttattgtaatatatcctccatctgtaaatggtaaatcaactacaaattggccctctatatcatatacaattgaatctagtgaaaaataatcatcatctaagtgtaatccctttggtattgtatattccacatatgcataactattaggttttatccctttagtaattatttgccagtttatatcactttcttcaaatgaatttttcatatcaatctttagtggtgaatttgtcatcatctctttatttttatctttatacatatcaaaagttatataagattcttctaatctaaatgtatatttagttggattttctatcttaaatcttaatttaagaccatttttagtttcatacttcttatttaattttatatcaatttcaaaatcattttttattaaataatcattttcatgtattaaattcttaaatataaatttgtttcctaaaacaaataatgtagatattataattataataaatgatagctttatggatatgtcggaatttctaaataaattttaacttttaatttttttattttttttaaaaagagaataaataacatgtctgataatgcatatctcatatatataatatctatattatattctctaattatatctataatttttttattgtacatacgtaatcttttatctagtcttcctttaaacttgcatatttctttcttattccctaaattatcaaccatattaaagatattattttcgcaaaaagtatacattacatcatttccattttctttgatacctttaatttgacctcttatttttttttctacccctatagactcttcatcttttatatccacaaacgtaatatacaatatattcataattaacagttactcctatacataaattctaaatttttatatataataaaatgctatattaataatggctctacaatttttacacattgtctttccaactccacttgatacatttttcgctattgaaactatctacttaaaactagaaaaatattaaatattaaaattctaagacccttatctacttatttagtttttataaaaacaatttattcaaagatctatttatttcttaattaatatatctaacttaatatatacatatttatattttaaattgcctatatacttttattccttctataatacagtattgataattatcaatttgattaattttttttattacaaatgcaatatacattaataagcctaagttggaaccaaatagtcgtttaaataaaggggctttatcctttatatagtctttatctagttttttatttttcattttattaggatgatatgatattatcttaggataatattctatattataattcttattatataaatccattagatatatattttcttctccagatttatatatccctccaactccaaatctttcatcaaatcctatctgaaaatccttaactaattttgtatctaaaaatatatctatagatgatttccttaatatatctcttttcgaaattttttttatatatgtattctgatattgctttggatattgttgctgttctaaatcataatgttgaaatgtagcaatttgacacttatttttttcaaagtatatttttataaattcaaatgcatcttgtgcataccagcaatcatcatctgaaaatgtaagtatatttccatttacatattttaaaccttcattcctagctattgataatccttttttattgatttttacatgtctatagttgaaaactctgccttctaagtattcctctactttatcatggttatcctgtgaaacaattataacttcaaaatctttattttcctggctttctaaactattaaataatctttttatttctttttctcttgttcctagtgttggtaatattaagcttatcatttgtaactcctttgttattaaactgataaaatataactaatccaatattcatccaaaataatggttctctccaataactatcactgaacattaatcttgtaaaactgtatataaacatagtagcaacacaaactttaaataattcatcctgtttataatacgtaatatactttttaagcaatactaggaatagtataattaaacctattactccaaatataccgaaatctaaacatacctctataaataaattatgtgggtatatataacctgttgaatattcaaaatatcctactccatgtggcataaacccagaatttactattatattttttgcaagtatatatatgtcatctcttcctgatgattgagttattattcctttaagtccatcctgaagagttaatacatatttggttaatgaatatgaatatatcccaatcttattcatctgatcaatcaagtttattaatatatttttcaaatttaatagtacataaataatactcataaaacctattgtcaatttactaatgcttatcaaaatatttgttttatttaaacttagtaactcatagtaaacaagtataaataagcatatcatcatagaagatctatttcctaaaattgtaatttctataaaactaataagcatcaatatcattgaaataaatctacagttgcctttaattgcataataatacattgaaaatcctataaatgaataagtaagatttatacctagattcatatatccatttgtatcttcataatatcctaaatagatatttgatattaaaaacccaattactcctatatggttccaatatttcattaaactttcataatctctaatcatcattgcaaaataaatccctaaaatcccatatctaataaatatcatatacagacctaaaaccttaacagtatatggtacacatattgcatttaatatgaaaataatgcttaaaatcaaacaaatgagtataaatttagtattaattcgtctatttatatatatagaatatataaataaacttgctataaaaagccaaaaaaacactgtacttcccataatttgcactattggcatcgtaattatttgcgcaaagatgaacaatacaaatattaaagaatttttacaatctaagttgacatttttttgtttttccatcatattattcacctactaaaattaattttacataatttttaatttatgcatatttataattcagatatatgtaaattaattattttttatttgtaaataaagcttctattatttttattatttttttcatgcatgtcatatccattttagtatctgatggtaaacaaattcccctagcaaataaatcacttgaaatatctgatctctctaatttagaaaaaaatttgtatttcccaaagaatggttgcatatgcataggcttccatacgggtctactttctatattttcattttctaaagctatcattatatctataggtttaactctagagttttcttttatagtagccacagatagccaataattaggctctccaaatccgcatatattcatcatttctatttcatctatatctttaaacccatctttataagtttcataaatttccttttttttagaaattctatcatctagaactttcatttgtcctcttcctataccagctacaatattgctcattctataattaaatcctaattctttatgttcataatgtctttctgcttctcttgattgagttgcccaaaaaagagcttttttcgtatactcttcattattagaaaccatcattcctccaccagaagtagttattattttatttccattgaatgagtatatgcctatatctccaatagttcctgtttgtttacctttatatgtagctcctaaagactcagctgcatcttctataattggtacattatatttatcacatattgattttaacttatcatagtcagcactttgcccatataagtttacaactataactgcttttggcattctgttgcatttttcagcatcatcaaacgccttttgtaaagctattgggcacatattccaagattcatactctgagtctataaatacaggttctgcaccttgatatattatcggatttgcacttgctgaaaatgtcaatgttgaacaaaaaactacatcaccttgctctactcctaaacatttaagtgctaaatgaatagcacttgttccactaactaaagctgttgatgcttttgctcctgtgtactcacgaatgtctttttcaaaattattaacattaggtcctagtggagcaacccaatttgtatcaaatgcttcatttatatagttctgttctgcccctcccatatgaggtgaagaaagatatattctttttttcatattcttttccccttatttaaaaactgtttgtaatatatattgaatatcttttataaaactataatctcttatataatcaatgtttatttctaccttatttggaaatataacttcatcattatacctttgagaatcttctactgttgctaatatttcttcttcatttctatactttattgttgcaggccctgttattcctggcctgatagataaaaatatttctctttcctcctctggaatactatctataagctcttttacatcaggtctaggtcctacaaaactcatatcaccttttaatacatttataagctgtggtagctcatctatcttggtttttctaaatatccttcctaaaggtgttattcttggatcatttttagttgtaacatttgtcttaaaatcaactttagatgacattgtcttaatttttataatattgaatatttttccacctcttcctacccttctttgagtgaaaaatccactttccttatattttatttttataagtaatgcagatattattattataggaagggtaaacaacaatcctataaacgatacaataatatcaaaagatcgttttaaaaatctatttagtatgcttatctgttttggtaattctttcacattatccatatatcaaccctacttatctttagtgttaaactctttttaatattgcatttatagagtagtttgaaaatacatatatactttttactattgataaattttctatatttctatatacattccatacactcttagcagctttaaatttattattagatatagatccatttacaagcctatattgagctaaacattcattcaatccatatgctttacattttctatctctaagtatgtataaccacgttgccatatcttgattagctcttatatttggcatttcaaaatatcctattttatctttatctataactacacttaagcatcctattatagtattttttagatatccatcgtaatctataacttttggaacctttataactttatttagcaatgttccatcttctgtcataagctcatatccggtaaaggaaaatgctatatcttcatcttgcataaattttatttgcttttctagtttgctcttattccatatatcatcactatctaaaaacgctatatatctgccttttgcattttttattgctgtgtttctagcaactgctgctccactattttgctctaattttatatatctaattctactgtcatcttctacaaatttgcttattatttcacacgaattatctttagaacagtcatctaccaatatcatttcccaattttcataggtttgagcctgaactgactgtatagtttcttttataaagctactagcattatatactggagttattattgaaaccaattttttatccatacaatacctccttgcttttatttgcttcttcaggtctaatataagtagtaaccaattctctcataacattatcaattagttctacttcttcttggtcaactatatcttttaatacttctaaatgttttttagttctatcaacatcaaactctatcggttttccaataaatatcttcttatgctcagtatccattaatccttcctcagacataagtaactcttcatataatttctctcctggtctgagcccagtaaacttaatatctatatctacatttggttcaaatccacttagtctaattaagttatttgctaaatcaacaatctttaccggatctcccatatcaagtacaaatatctctccaccctttgccatagctcctgcttgtataacaagttgtacagcttctggtatagtcataaaatacctaataatctctgggtgagttatagttactggcccaccttcttcaatttgtttcttaaaaagtggtataacgctaccattgcttccaagtacatttccaaacctaacagctacaaactctgtttcactacttttgttcataacctgaattatcatctcggcagctcttttagtagctcccattatattagttggattaactgccttgtcggtagatataagtacaaatcttttaactttatacttatctgcaagtgtagctacatttttcgttccaaatatattgttttttatagcttcacttgggctattttccataagaggaacatgtttatgtgctgctgcatgaaaaactatatctggtttatatttattaaatatttcatctaatcgttttccttctcttatagatgctataactgtttttaagtttaatttattttgatactttcttataagctcctgttgtattgcatatgcattgttttcatagttatcaagtattacaagttgttttggattaaaacttgcaacttgtctacataactcacttccgatacttcctcccccgcctgtaacaagtacaaccttattttgtaaatactcactcatctcttctaaattaactttcacaggttctctacctaataagtcttctatctcaacatccctaattttttttatatcaacttttccatctattatttcaaatatacctggtatagttctaagtttacattttgtatctttgcaaacttctataatttcttttttctcctgtttagttatattagctattgcgattataatttcgtctatatcatttctttcaactacattttttatgtggtttgttgttcctagtattggtatattatgaattcttcttcccattttatttatgtcatcatctataattcctactggcttttttaaaagttgcgggttattttttaattcttgaattaccatatctcccgcacttccagcccctactattagaactttgctagctttatcttttaagttatctctaatagctattcttcttgccgttctgtatattagtctaattccacccgttagtgatattgttaatatcaaatttaataaataaaaaattattgaaagttgtccccctacaagcttatgtattaaatatgatggcattactgctattgaacaagctaatactatagatagtagttcttcttctcctgcgtatctccatagactgtgataacacttaaatacagtaagtaatgatatatttattactatatatattactgatagtaatatcatttcatgttctaatggtttaatttcgtgaactaaccatactgatactataaatgaaattaatatacatactatatctgctaattttaatattagttgccttgttttatatttacttaaagctttatctaataacttttcttctcttggagatctgatttgcgcatccatttaaattttacaccccctttaaattaaaaatgtgctaactttttagctttctttttgtgtttagcttttctactactatcatttttttcatagcaataactatagtatccataagcattgtcttcccctgtatatttatttaaaataactcctatgatatttgcttttactttttctaatttttcttttgttatttttgccatttctatatctgtttctccagatcctacaactaatattgtcgcatctgaataattagctatggctcctgcatccgttataactcctataggtggagtatctataaatatgtagtcataactttcttctagtgtttttataaattctttcatttttttagatattagcatttctgatggattcggtggcatcttcccagctgctattatctgtaagttattaatttctgtattttgtactacttgtttaaaattcttttgtccacttaatatttctgttagcccatatgtatttgtaaggctaaactttctgtgtacactagggtttctaagatctgcatctattattagaacttttttttcttctaacgctgcaaagctcactgccatgtttgaaataactgttgattttccttcatcttgtttactactagtaactaatattgtttttatttttttgtctatgctagaaaactgtatattagttcttatacttctgtaagcttctgatactggtgattttggttctttgaatgttattaagcttatcattttttattttcacctctcttacctttgctctcatgtggaactactcctaataaaggcagttctaagtatttttgtatatcttgtggtgactttattttattatccatatactcaagtaaaaatattacaaataatgaaatcataactcctaaaacacctgctattgctatgttcataactttgttaggctttactggaattttaggaactatagctttgtctattacttctacattgctagcctttgttattctttttacttcttttgtaaatacttttggcattgcatttgctatatctgctgctcttttaggattatgatcttgtacagaaacttctaatatttgtgtatctgttactggtgatacacttaattttttttcaatttctgagtatccacctttaatttttaattcttttgctacttcatcaagtactacttttgattttattatttctccataagttactgccagtttttgagatacatttatctgatctcctgttattacatctgtacctggtgctttatcactgtttactattaatgttgttttagtttcataaactggacttaatacaaaaaaacttatgattccacttacaatcattgcaatagttgttattaaaactattatccaagctctttttttgataatctgaaaatattcttttaagtcaatagtttcttccatttttacctccattttctttgattttataaatttttagcattttatagctatttttctttaattcctactattttactttgtttttttgtagttttctgttttattcttccttattatagtaaaaatttttacaacttcaaaataattcgttctgtgtttttttgcattttactcctttttttataatttttgttatttttcgacagattattctgtcgaatatcattaaatttgtcgaaaattttctaaatattatttatcttttctaactaattttttactttttggtaataataattaaattttaaataaaaaaattcgtaggttttatcctacgaatttttttattgttctatttctatttctgcttttggtgattcaatagatttatttctattattaacttttacttctaagaatttcataaattcttctcttaattctggtctttttagtgcaaagtctactgtagcttctaaaaatcctagtttatcacctacatcatatcttcttccttcaaagttgtatgcatatattgcttcatgttcacctaatgtttttagcgcatcagttaattgtatttctccaccttttccaggtttttgattttcaagtatatcaaatatagctggagttattatgtatctacctagtatagccatattcgatggagcttcttcaacttttggtttttcaaccatgtcttttactttgtatactctatcttctatatatttaacatctaatattccatatttgttagtgtcttcttttgctacttcctgaacacctagtatagatgtattgtattcattgtatgcatttagtaattgttttaagcaaggtacatcattatctactatgtcatctcctaaaagtactgcgaatggctcgtctcctacgaaacttttagcacaatatattgcatgtccaagtccttttggttctttttgacgtataaaatatatgtctaccatgttagatatacttcttactagttctaacatttcatttttacctttttgctctaattcaagttctaattctatactgcggtcaaaatgatcttctatagattttttacttctacctgtaactattaatatttcttctattcctgagtttactgcttcttctattatgtattgtagtgttggtttgtcaactataggaagcatctcttttggctgagatttagtcgcaggcaaaaaccttgttcctaatccagctgctggtattatggcctttcttactttctttttcatttaaatttcacctccaaattcaattttaatctctattaaataaatccctagtataaactttttcttctacatcaaaaagttcttttgataatctatttgatactataatatcgcatattgacttaaattcatctaaatctcttataactttagagttaaagaagctatcttcttttaatactggctcatatacaacaacttctattcctttttcttttattctcttcattattccttgaaccgaagatgctctgaaattatctgagttagttttcattgttaatctataaattcctacttttttaggatttctttttattatttgatctgcgatatgatcttttcttgttctgttcgcatcaactatagcacctattatgttgttaggtacatcttcataatttgcttttaattgttttgtatcttttggaagacaataccctccatatccaaaagaaggattgttataatgacttcctattcttggatctaagcctaccccttcaattatttgcttcgtatctaatcctctaagttctgcatatgtatccaattcattaaaataagctactctaagtgctaaatatgtatttgaaaataattttacagcttcagcttctgttgaatttgtaaataatactggaatatctttcttaaccgcgccttctaataataagtttgcaaatttctctgctctttctgatttttctcctactattatccttgaaggatgtaaattatcatataatgcttttccttctcttaaaaattcaggtgaaaatatgatattatccgtatcaaacatagcttttactctttctgtatatccaactggtactgttgattttattaccatagtagcttgtgggtttatggataatacatttgctataacagcttctactgttcttgtattaaagtagtttttttctggatcatagtctgttggtgttgatattattataaaatctgcatctttgtatgctttataagcatctgtcgttgctattagatttaagtttttagtagttaagtattcttcaatttcttcatctacaattggagatttcttgttgtttatcatatctactttttcttggattatatctactgctattacttcattgttttgtgctagtaatatagcattagataaacctacatatccagttcctgctattgcaattttcattgttgtctctcctttttgcaagttttatagttaaagtcttttttgaaacttatttattctatcatctataatgtttccttggcttattataattgcttgttttagtgtgttgtttgtttgttctttttcttcaattattaaatctatgtacttacatacctcttcacttagtgattttgatacggttttgtagtaaagtgacggtgtatggtcaactacatagtgtagtattccttcctcatagtaaattggatcttctatagttgtagctttactagtttctatacctccgttggcatcacagcttatgtctattatcatgctaccttttttcattctttttaaatcttctttgtaaactatatggtcagttctttctatatcccataagattgtgtttactattacatcgtatttatgtagttcatgcttaaatagttcttctgtttttctatcgtatacagttacgtctgcgcctaatgcttttaatatatttaaagctcctcttcctgtgtttcctttgcctagtatcgctaccttcgtatcataaggcatttttttgtataagctatatgcgtgcaatattgaagcttctccagctatttcattgtttttccaaaatacatgtcttccgtattcatacatgtcttcccatgctattgctgtgcatttgctgtttactattttgtctgtaatgtgcttgttttgaactgcatgtatccatccaaataatacttgtcctgttgataattgttctagatattctgcatctcctattttagggtcgcataaaacatctttttttagaagatcttctctatctacaactttagctcccgcttttatatagtctctatcttcaaaccctagtttttctccatatcctttttcaaaaaacaacatgtctttatttttaattttatatatgtcttctggcgttaatgctcttctatactcattttcttttgaactaactaaaaatccaacactcctcataataactcctcctatgttgactctttgctttgttttatttgtcttatattatcttttcttttggtagtgtgattaaatctcccatcatgatatctacatctttatctaatctactgtctattcctccacatggagtaaaagtcatttctcctaatactggtcgtccatctacatcgtagaaatctaccctaacaaaaggaaatggctcacttagtttttgtgcatattctatcattttttcaaaagattttggtttgtatatatttttaacttttccttctttttgaacaattttagagtcgttattataaggaagtatgttccacttattgtctaagaaataaaatttagctctttcgcttcctcctctttcctcacataccatagtaaattttgcttctccattaaagcaaaatactttatagtctacaggtccgtttccatctcttccttctatgaatttttcagctattagttttgcttccattttatcgtattgcacttctgctgatacttgtgagtatctactttttaaccaaatgttacatgtttcttttgttttttctaaatctaatttttctttgtctgtacaaattatgttatatccgcatccatgagtgccttttagtgcaaatttctttggtaatttattaaagtctatatcttctgcatttttgtacattccatatatagggtttaatatctcttctaaaccacaactttcaacgtattctcttacatcgtacttatcaccacatttggcaaccctatcatcttgccagtatagttttagccattgaattttttcgttaaaagttataggattttctaaatctagcctttttttcatagcaaatagaaatagtacttttgaagctactactggcgatatttgatacagtattggcgatattgagaaccacacctgcttttgaatatttcttaattttgatttcaagaataaaatcctcccattgtatatataatttgtttatcagtgtgttttttacggtatattttgctgtgttttatgcttggtttagtgttatattcagtttttgattttttattttgtatatcctattttttttgctggtattcctgcccaaatttcattttctcccgtagaacaagttagtactgagtttgcgcctactaagcttcctttggcgattgttaaagttccttttttacataaaatttttgctccagcgcatattattgcattgtcttctattttaattttctcaaattcactttcgtgtatttctttatgtatatccgctcttcctaatgtaactccttggtataactttacgttatttcctatttcagtttgtggatgaaccactaggcctggtgcgttatgtgctaaaataaaattttctcctataactacttctctaggtaaatctattttatataagagatgtagtaaaaatcttacaactctgcttttagcatgtctatttctatattttaaaattatctttaataatttttccatccggtccctctctacttatttattttttcataatagctttttcgaatcgtcataaacagtgctaaaaccataaataatgcagcacacttgttacttgaatatataggttctgctatacttgttactactgtatagcaaattaatccaaatgtaataattttacttttatagtcattgtagccttttaaaaattgaacaaatataaaatataaaactagtattagtaatacaactcctataaatccagtttctcccattatcattgcccaatatgtatcagctatataagatggcatacttggagataatccccatacactacttaatccgtattcataatataatggagagtaaaactccctagacatatatgatccaaatgttccaaatcctgttcctaaagggaaatagtctttggctattttatatcctgctgtgtataagtatcctctagctccattaaaaaattctgatattattctcggtagtgctatgtataccattattggtattaaaagtataaagtattttaatttgaactttttaattaatttcatgaaataaaataatattatataaacacatataaatgctatggccttacttcttcctgtaaaaagtaccaataaactacttgcaattattactgaaagttcacctttagttttgtttgtatagttataatataaaagtattgtagtcattgaaattatcgcaaagaaagcaagttctgttggatgtgaaaatcctatagaaactgtatgtagaccaaatctcataccttgatcttctaaaaagtttaaaggaatatttactatacctattagtgctaatatgtataatgatatttctagtactttacttatattttttaatatacttgctttaacatcatagtattgaaatattactctacaactaaagtaaagcatatacccttttgctgtcataatcatactaagaattccatgtttaaatcctatgatgttatgtgtagcatttgatacaaatcctaaaaataaatatagtaagaaaaatattaatgctattaattcgtacttagttatttttatagctttctttttgtttagtaataatattagcgcatatattgtagtaatcattgctaagccttcatccatgtaactgaaaaaaggtacatttacttgtattaaatcttggaaaatcattgctatcaaaatcatctgaaatacaggtatcattttttgctcctatttccaccagttaaaagatataagtcttttattttattatggttaacttcgttgctgtaattttcttttatatctttaaaacttttgttgctgtaattttctcttagattttgattttcgatcatttctttagttatacttacaagtttttttatatctcctggtacaaaaattctaccattttccatatcttttataacttctggtatacttcctatgtttgtagctattgtaggaacgccacaactcatagcttcaagtatagccattggcatagcttctttgtatgatggaagcacaaatatcatagtatcttttagttctttttctacttcctctttacttacccatcctaatagttcaaatttatcttgaaggttatatttttctattaattgcttagtttgttctagttctccgtctccacaaacagtaaatcttatactgtcatcgctttttactaattcttttgccatttctataaaatcaaaaattcctttatctttttctattcttccaataaaaagtattttcttagattttgtgttatagtgattatttttatttgaattaactgaattatttataacaactatttctgaattagtcattttttctattttctttttccaagcttcacttaaaactattattttgttacatttatttaggttttgagttattttgttttttgtacttggattagcatttagatatacatcttcaaaagctcctccatgtatgtgaagtatgatttttttattaaatttgttggcgatttttataaacatactttttctaaaaaaactcttacctgatgctgtatgtatgtgaactaaatctatgtttttaaaagttaggcaatagctcataatagccattgagtttaacccatataatatcttttttattttcgatccaggcaccacagtatgtatgttttgtatattaaattcttttaagtattttgaatttgtatactcctttataactgttgacatcccacctttgaccttgtctttgtgggggccaatcataagtatattcattgcattgcctcctttgtttaatattctgaaagatctattatttttgctattttaatatcttcttctagaggcttcataggatctgttccatttgcaggtgtaaatgttaattccccaaagtatatttgattgttaacagaataaaaatcaactcttacgtatggtaatcctgtagataattttattgctgcttctttcatttcttctaaatttttaggctcatctatatagtctactcttcctaatttacaaattacatctaaatcattccaatctggatcatagtagttttctttatgatttgtaaatctatctgtgtgtacttcaatcatatgaacttgttcctttgaacaatggaatttgtagtctcttaaactacctgtttcatcttctaaatattcttcacatacaattcttgattttatatttttatattgattttctttagtgtacttatagaacttttctttttgccaagagtttaatttttttattgtttcttctatatttagtttacttttatctttacatatgatgtttccaccagttccatttgtcatttttaaaacaaactgctttggtaacctgtcaaaatttatttcctgtgcactatcataaactccatataatttgggtaaatattcaggtcctaatacttcttctacatactttcttacttcatatttatcaacatatttcccaaatttttctaagttgccattgaatttaatccattgaattttttcaccaaagtatttaggatttttcaagtttaatagttttttgtaacttcttccataatctatatataaaactacttttgtaggtaaaaacatccctaactttcttaaacttttcataaatttacctctcaattatttttgtaaaaactcttcaatactatttattatcgttttggtatttgaaatgtattgtttcacttctattttttcactattatttattgcatcttttaactcttttatatcatttatacctattacgaattttagatcactaaattgttctactatttgtagttggtggtcatctacatgctcttgaaattcttttaatctaggtattgctattgtctttttacctttttttactgctcctattatagctcctgttccaccatgagttatcactgtgtcacagctttccattactctactaaattcttctctatctaagaagtttttgtatttataatgttttggcttatatccactataacctgtttgagcaaatacttcttttgttataatttttttttcaactaaattgtctagttcctctaataatctattaaattgaaacttttgtgagcctactgttacaaatatcaatatatcccccccttatatattgcctctggatatacttttttcatttcttcccattgaacataaaattgatctgcaaatttatatattagttttcctgtaagtgtaggagattttatttttgcaaaagattctatgaatataagtttttttctaaatatctttgcaagtaaacacataggtattgtagataaagctcctgtagatataactacatcaggcttttcttttaaaaatatctttaatgtctttatactgtttataatcatgtaatatataaattttatttcatgtctgttgacttgttttaaataataaaagggtatatcttcgtttgatactgagtaattagttttctctgtcacaacaaagctatcatgtttttgtattagtggttttagcatcattatttgttcaaaatgccctccacttgatgctataaagcatatttttttcatctaatcaccttaattcttatttttttatgatgcattgtcatctccaaataatacaaaaaatgtcttgaatattaactttatgtcaacccaagtacttctttcttgtatgtattttaaatctagttctacccatccatcaaagtctatactgtttcttcctcctacttgccaataacaagtaagtccaggtttaacagctaatctttgtaattggtaagcattatactgtgctacttctcttggaataggtggtctaggtccaactaaactcatttctcctttaagtatattaaatagttggggcaactcatctatacttgttttacgtatgaatttcccaacttttgttattctaggatcatctttaattttaaaaactggtccagtttgttcgtttaagtgttgaagttcttttaatagttcttctgcattgtataccatagatctgaattttagcattttaaatgttttactgtattgaccacatctttcttgtccaaagaatattttcccttttggatcttctagttttataagtattgatactattataaatacaggtagtaaaagtattattcctattgctgatcctataatatctataattcttttgacaactaagtagcctttacttacactattgtttagttcaatcaattcctctctaacgagagtctcacaaaaactaagatcagtgctagtattttgcataaatttacctcctttgacttgttttatcatatgtgctaagtgaatctacttagcacatatacttttatttattttgttttgttattttttcgttttgatttctttttagccctaccctgagatgattcaccttcatagtagtagttatagtatccatgtgaaccacttgaatcttcgaatttattaagtacaacccctaatatatttgcatttactttgtctaatctttcttttcctatttttaacatttcaacgtctacttcatttgatgcaactactaacatagtcccatctgcgtaagtagatattattcctgcatctgttataatccctattggtggtgcatctataaatatgtaatcatagcaatctcttaatgatgctatgaatgatttcatttttcttgatgctaacatttctgatggatttggaggtattttaccacatgtaacaacactaagtcctggtacttctgtttgatttacacattcctcaaaatttctttggcctgttaatatttctgtaataccatgagagttacttacgttaaacattctgtgtactgtagggtttcttaagtctccttctactactaatacctttttatcttccattcctgcaaaactaactgctaggtttgctattactgtacttttaccttcattttgttgagaacttgttacaacaattgtctttatttctttatctaagtttgaaaactctatattagttcttacagttctatatgcttctgaaataggtgattttggatttatttttgttattagtctttctaacataattatctaccacctttcttttccatattttcattagggataactccaagtatcggtaatcctgtatatttttctatatcttgtggagtttttactttattgtccatataatcgagtatgaacgctacaaataatcctattataaatcctaaaaatgctgctattactatatttaaggcttttctaggctttattggtttttctggtgtaacagctttatctattacttcaacgctatttgctttagttattctttttacttcttttgtaaatactcttggtatagcattagctatatccatcgcttgttcagcgtctttatcttgaactgttattgatataatttgtgtgtccttaactggagatacagatatcattttgcttagtttttcataatctaaatttaaatctaacctatctataacagagtctaatactgctctagattttattatttctccataagttagtgttaatttttgagtaactgtaagttgatctcctgttataaattctgcctttttattttgctctgtgttaactattaatgttgtatttgcttcatataccggacttaatataaaaaaacttattattccacttaatatcattgctactatagttattactgcaattatccaagacctttttttgataatttgaaaatactctcttaaatcaatagtttcttccattttatcctccattttttctttacgttttttgtttttagataaattattattatttcactatagattttcatcttttcccttgtaacttccacgatatttctatagaaaatgttttgtagtgttgcataatactatttttttagataccaattttcattatcgacatttcattttcattctttactgttttttacgtttttctattattttttaatatataaaacgtttttattgtattttattttatttaatgtgtattttttatttttgtctgctgattttattaaagtttgagtttaagtttcttgacattttaaatttttttctctactaatctcatcaaaatagatatatttcaaatgacttattttgcttttttttcaatttggttagtcaattttgatatttctttttgttatgaattgtttacttattaaactaatagacattgtaatatataatttttattatttctaaatttcatgactaaacctgaactctagcttatcccctatattacatcaccttgctgaatattattctcgtatttttttaataaaaaaaattacccaaaatgggtaattttttattttctacttattttcaaaactcttataatcatatataaacttgtgtaattgttcattgttatattctttatcccagaaaattacccaacctttttcttgactaatagtttttccatctctatgtccatcaagtgggaattcaagttgagcaaaattggtactattcatttttaataccttagttgctagcttaaatatttccattggaggcatatttgttttagtgtaactaattatagtgtttcctaattcaattaaatctccactagatgttttcgctaatttattataagctgcttgaagtacagttctttgtctattatctctgtgataagcatcatctgcatatcttattctgctataggctagagcttctgctccgtttaatttttgcttacctggtccatcaattcctggtatatggcttacctctttaggtaatatatcaatttctacaccacctatagcatctattattttttcaaaagaatcaaaactaacagctgcatatttatcaatttttattccgaaattttcatctatggtttgaagtaaaagtgaaggtcccccataagcatatgcatgagttaacttttgttctccataaccaggtatatctacatatgtatctctagctaatgatgtgattcttatatcattatttttttcatctatagtaagtatcatcatagaatctgatctatttcctttttctaagttatttccatcgattccagctagtaaaatattagttacacctcctttttcttctaccttttgaatctttgattttatatctttagcagaacctttatcatacattgagtttagcttaaaataaaagtatccaaaagctaccataggtaccgctactataaaaactattagcccaataactaccttttttaacgtactcataaatctcctccaatattaaaatgtaattatttatatcttatcatatacaaatatctgtatctactagttttatctttttaaaactttggcttaacctaaaacccccaatcaaattaatagcattctttattttaatacataaaaaaagactgcatatgcagtctttttttcatggcaaggattcatttttacttattttgcagtataacccgcatctagaagcatcttaacgcaagcttcaccttttccgtcagcaacaagcactataggacccgtacatcccataccactttctgcatatataccgtttttccataaaaccctaacagcatcttctaagtccattatatctataccagaaatttgatgagtaaccacctctttttcaggcatttttacttcttcctcatcatcttttttaacttctttcttagttaaagcgtctattatatcgtcgtatttagcatttttagctgctttaaattcttccttagatactttagtaacgtcacctttaacaacatcataagcatatctaagtgcattagcaacaactggagacccagatgctcttgataatattaatatctttctatcatagtcttcacctacaccaggaccatatccaaatccattagcttcatagtccccaccagtagtaaatgaagagaatactttcataaatatatttccgcttaaagtatcagtaaccataacatccggagcgccacataataaatcgttacctctcattacacaaccaccgtcagctctaactgattcagcaaaacttatatcgtatccattagcttgtaaatcttttagcgccttttcaacttgtctagcaccatcaacatttaatatacctacagtaggattttttattcctatagatttagcagtagatattccataaactgcatttctaaccatagcttctattctgtgagtcgcactagtaccagtagtagtagcaaggatcatttccttacctctacctggagttataactctaccaacagtagatactcctatagggaagttataatgcatagttacacaagcatcaatgtatcctgagtctaataactcttccatttttgaatgcatttcactttcatcattaacttcaacaacctctaggtcagtatcaaccttaggccctattaacactatatcaaataggtttgacttagctaagtgagcaccttttactaggttttcagttccatgttcactacctaaagtagtcaaaccaactcttacttttttaccaaattcgccgctttcaatagcattagctatatcaagaaaagtatcagcaataatcttcttaggcataacaattcccctctcaaagtgaattttttaaaattctatccgtcttattctatttctctactctaccaataaatctaatttaataaagaagaagtattattaactgatagcataaataatttttcaccgtagggccttatcgcttgtaaggattgactttggtcatattaactttgttttaaagtctgcagtactttaaactcttaagtttcatattaccaaccccacaccttgcaagcgatacgctctaccttttatctatactcagtcaaagttattattcttctattaacatatcttgagctaattttctcattgattctgctattattttctttatttcttctttagaaacagcagcagtttcttcttctataccttggtttctttctactatgaaagaaacaccatcgaataagttagtcattctacctaagaataaacttcctttaccaactatcatagctctatttttatcaccattagttaaatcatctatacagaatcctatatatggaactcctgatggtatatgtccttgagttggagcccatcctggtattcctctatcagttacaaagttctttaattcttttttctctaagtctccacgcttaacagcaagagcacctatcattttgtagttagcttctggaacatctccagccccagctggcttagttatatctgggttttgcatttcaactgagtaaacatcaacatcagttatttttaagttagctctatcaagacctgtagttattaaagccgtcataacagcttgtggagaagatcctgttccaacactgtgttttcctgttaagtcagttcttattattgggtttacaccatcattttcagaaactaatatagcgaatcctccaacaacatcttctaaaactggaagaccttttttaacatggtctttagcattcattccaagtttagcactagctccacctgcaactaccataacatttttataaactcctgatttaacaagtgcagcagcatttattaaagcatgagtaggtccagcacagaatcctcttgtatcagaaccagaagcgttttgaagtccagccatttcagctatagacttagcaaagttacctccacctctttggttcatatctccacaagcctcttctgaacactctataacataatctatatctagtgggtttatattattctttctaattaattgtatagctgcaacaactcctgaagccttaacaactaagttttcaaacattgtatgagcatttaagttaacgtcaacatcatgagctctttttacatatccaactaattcaccatcatggtataatccttcagcatggtgatcagctattaattcttttgcatcatctatattagaacccttaacttttccaaagaatggagctagttctgggtaattattttcgaaatcaggttttatattgtttacaaaatcttcttttaacttaactaagtcaaaagcatcacatatttgcatcattaataaaaattcgtcttgaggcattatttccccaagttttccttgtctagtaccttccattttgtgttcgcaccaaggaagagctatttctcttaattcttccggtctattgtttcctatgtaaacttggtttggcatgtagtttacaacttcttcatatcctcttatgtggttttttacttcttttaaaaattctgaatctggatgtgtttctctttcaacagcacaagtagtaccattttgaactatcatatctggtgtgtgaactaagatgtagcttgccccttttaaaactggaaatgtcatattatttacccccaatgtatatatgtattatttttttcaacggactaaataatagcctcgttgctaaaacctacaatattagattcattaaattattaatttcacttataatatttaaaaaatagatgggtaaaaatacccatctatttaattttttatttacttatattctaagcttaaattaagcttttgcagatatatcttttaaagttatatcttcttcaaatactgtttgaccgtcaacttcagtagctaaagcaactaaagctttttcaactaattttcttcttaaagctttttcctcagctggatctaacttaggatttccaagaggatgaggtatagctatagcaggaactattctgttggctccaactgttaaagatatagggactactgtacagatatgaacaacaggaagtcctgctctttctatctcttttaccatcgttgcaccgcaacgagtacaagtacctcaagtagaagttaagattactgcatctacgcctgcatcttttaatttttgagcaaactcagcagcgtacttcttagaacttgcaacagcagttccgttacctgtagttgagtagaataactcatgtaaagatcctatagctccttcagcttctaaatctcttaaaacatctactggtaaaactctatctgaatctaggttacaataaactgggtcgaatccaccatgagcagtttcataagtgtcttcagttaaatccataacacctgctatactgtactcaccgtacttagaagcagaagatgactctattctatctggatttcctttaggaactataccaccagaagtaactaaagctatcttagcattagctaaatcttttacagctgggtttggatctactctatcaaagttaggcattggatattcagttacgaactcttcaccttttattttctttaataacatatctacagctctcttagaacctctttctttagcgaagtaattaactcttattcctctttgtatatatccttcttcagctggagatcctatttcttcacctttagctaactttttagctaaagctgctatttttggaagagcctttctcataccagcagcagagtcagcagtctctattatataaagttcttttttgaacatatctgctcctgggttttcaacgtacattcctgttaaagctggtatatttaactcatcttttacaaacttagttattgttcctgcagcaaccccgtatctacctgcattgaacgctggaccagctataaataattgtggattgaaacttttaaccatttctaaaacttcttggctagcagactccatattttctccaaagtagctatccccacaaactacagttccaactatttcgatttcatcccctaataacttgtttaattgtgcacttatcggaggtaagctttcagctatatgtggcttagtgtcagctttttcttctccaccaattcctgcgaagaattggtttacgtagtgaactactcttatcttttccatcttatctcaaccccttttgatttaattaggcattatatttacagaattgacctcttatactgttcatttcttctactatttcatcaacttcaagaaccatttccatcatacttacttgatcttcataaactgactcatcaaataattcttttacttctggctcaacaacatgataaacagctaatcctaactcaacaccagcaagtggtccagcgaaagttggatctccagcagttactgtttcagctgcaagacctgcagcttcggcttcagcagcacctagtaaaaccacaacattttcagcaccgaatttatcagtagcttctttaactctgttttggttttctaagtccatagccccagcagcagttcagacaaaacattctgttgaagcaaaaactatttcagtattttctacagtgtttacacactcttctatagcaggtcccggaataccatcacggtcacctattattatgattttcttattagttaatacgctcataataattctccttttcctttatattttttattttatattcaactttaattttaaagttattcctaaatttaatatcctttagcagttaagaatccaaatcctgtttcattagtagctccagttataacttgtatctcagctactatagatccatcttctcttaaagatccagcagatccaccagctattacatctgcaacttcaacatgacctattactctatccatcttaggtaatataacaacttggttagcatttcctcctgttacaacagcatctgctttagcatctgcatcagctaatgattgagaagctccatctctaccagcatactcatcagtaactataacagttttaacaccttcaccttcaattttcttgcagttcattataaggtcagtatctgggttaccgaaaccttcttgagatactataacagcatctaatcctaattgcttacataacttagcagtccagttagaagatctttctttatctgctaggtatacgttttcattagttataataacacctacaaagtttatttcttttccatgttgagcatataaatcttcaactacagagttattcatgtgtacataacttgggttcttgtcacaagcagaaacacagttaccacttactatagctccatccattaattcagttgggtataataaagttggtactatttgcttagcatcaactccgtatacatatgtatcatgtaataatccttgagtttgaagcatatatacatatcctacctttggaagttctggatactcagctattgattcaagtaatggcttagtttcataagttactacttcatctggagttaaatctttagctaattgtcctaagtaagtagcagctttaaatcctatcattctaacagccttttcatgttcatgttgctttaatccatctactggttcagctataacaacaacgttgtttaacttagaaaatggagtatattcagctccaggaccagtcatatctattataccttcttggaaaccaactattttaccagttgtaactactcctacatttttaagtgcgtgagttctaccttctccaacagtatcaactttagatataacacctgggaatattccacccttaccttcaactttgactctcggttctataacgtctttaactggtattattctaacactttctccaggacgaactatatctaaatctattgattttatatgctcatctccaccaattacatttaacatctcttctttgttgatgtataatactgaatctttaacttctgttacttctccaaattgtacatcttttataaagattttccctaactcaagacgcatattggcaccccctaattttttgaacttaatttattttaacggggaaatttatcccccattaatttcttataagtacttctttatcatagcttctatattagcaactgttgcatcatccttagttacttcgtctattttagctccatctttgtatatagctatagttggaagacctaaaaccttctctcttatagcaactcttctagctttagtagtatcgaatttacagaactttatattttccccatacatttctgcaaatctttctatatcaggaagtaatgctttacaaggttcacaaccttgactccagaaatcaactaaaactaacccttcagcttctaaaacttctggatcgaatgtgtttttttctaatgctatcatttctaaatcccccttattggattttatatattttaatatattttttaaatatattattagctattataatttttaagtaccgtactaagtaatgtctaagctttgcctaaacatcatcccccgataaccttagtaaaagtaccttagcagttagtaacttcttcttcaaaatttgcttctatatatttttcagctgtaacagcagctatagccccatcagcagtagctgtaacaacttgtcttaaagattttactctacaatcccctgctgcaaatacacctggtatatttgtaagcatattatcatcagtttttatgtatccacgctcatccatgtctactttacctttgaataattcagtttgagaatcaaatcctacaaatacgaatattcccattgttccatcttcttcatcagcgaagtattcattagtttcaccagtttgagtatttttaaatactacagattcaactaatccatcaccttttatttcttctattactgtatctaataagaattctatcttatcattagctctagctttttcttctatagatttagcacatctaaatccttgtcttctatggactatagtaacttttctagcaaatttagttaagtataatgcttcttctattgcactgtctcctccaccaactacgaatacttcaaagtcttcgaaaaagtcagcatcacatgtagcacagtaagaaactcctttacctgttaattctttttctccagggcatcctaatttcttaggagtagctccagtagctattataacagtcttagctctgtactcacctttttcaccttttaatacttttatatttccatctaactcagtatcaactatggcatctctaactatttcagcaccaaactccttgcattgttctaccattcttgctattaaacttggtccagtagcattttcgatagatcctggatagtttgcaacttcatgagttataactatttgaccaccagttttacctttttcaagtattaaagtcttcattttagctcttgcaccgtaaaggccagctgcaagacctgcaggtccacaacctattatgactatgtcatataaattttccataacctacgaccccctgtttttattaatatatatacatcaaagtttatgcatattgcattctttgaattgtatttctaattatatcaaaatctattactctgaaatcgtctaagactctttcagtccataaaggagttgctttgttgtttttaaatttttctgctgtttctattgcgtcttcaattaagtttagtgaatttatgtctaaagatttcccctttttcattatgactgtacgatatggtgtctcattgggttttacgctcccataaagcggatgtgatagtagttcatacccctcatgaactaaatctctacaatgtcttagtgttcctatataatctatgtctaacgttaaaacttccttatctttaacgttttcctgaatcataggattattagtgattattaacattagtctacactcactttcaaaatatcttttgttaaactaaaaacaggaaactaagtccccacttagttccctgtcaaattacttttcagagatccgtccagttaaagtccttttacctgagaatttcacttaaatttctttgggataaatttaagtttgtcccttcggtcccctctaacatccccatattagaagttgtctcctttaaccttcaaacggtttgatttttagttttgtctagcccctttgttgctttgtatttcttaattacattatatctacgttagtaaatatatacaacagttttttaaatatttttttaagtttttttgttttatttgtctattttttgtcaaaacattgatattactcaattctttgaaataactttcattcatggttttttgtatacaatttaatttattcttacaacttatatttattctatatttttataaatattcctacttttctaattgttatttttaatttattttttataccatatcataagttatacatacaggctttttagttcttggatcttttactatttctgcatctatattaaatatttctttaagattttcttttgtcatgacttcatcagcactaccttcacatacaactctacctttttttatacctatcatgtgatctgcaaatctggcagcattattaagctcatgtataaccataactatagttcttccctgttttttatttaaatcttctaataactttaaaatttctaattgatgagctaaatctaggtaagttgttggttcatcaagtaaaagtatatcagtttcttgagctagcgccatagctatccaagctctttgcctttgtcctcccgataaatcatctatgtttctatctttaaactcttcaattccagttatttctaaagcccaatttacaatatccttatctttgtcattaacttttccaaaacctttttgatgagggaatcttccatatgctattagctcttcaactgtaagtccacttggtgcttgtggactttgaggtagtatagccatattttttgcaatttctcttgggttttccttatatatgtcttttccatttatatatatatttccactctttggagttattactcttcctatagtttttaagattgtagatttgccacaaccgttagcaccaattattgtagttattttacctttaggtatatttaaatttaagtcttttactatatctacatttccataagatatatttaaatttttagtagttatacaattcataatactctcctctttctattttgataacattaaataaataaaatatggcacccctattatagaaataactattcctactggaatttctattggagctaataaatttctcgatatagtatctgctactaaaattattaaagttcctataagtgcagatataggaatcaacctttcgtgttttggtcctactaattttcttcctatatgaggtgatactagacctaaaaaagaaatacttccagatacagatgtagctacaccagctaaaattaccgcatatactattaattttcttctttctttttctactttaacacctagtcctgtagatatctcatctcctaaatttaacacatctagatatctagatttataaattgaaagtcccataaatataattatgaaaggtaatattgcaattacatatttccagttacttccccatatacttcctgaagtccatgccattactctattaaactcttgtgttgtaaatttcaactggaatatagttagtatagatgtaaatgctacatttattcctatacctattaacagtaacctctgagaactaatcccttttttaaatgctagtgtgtatattaaaaaagctccaaataaagcacctgaaagtgcaactattggcattgtaaaaatagttaaattacttataccatcataaacatttccattcattaaaaacatataaattactacaaaaagtgctgatcctgaatttatccctaaaattcctgaatctgctaagtcatttttagttactccttgaagtattgttcctgctgttgcaagtgctgctcctactaaaattgcaataactatcctaggtaatcttaacttaaaaatagctatttcatgatttctttgaccttgtcctataagtgtttttatcacatccataggttctatagcaaaagatcctagatttaaacttactaaaaaagtaataaaaattaaagctattagtattgatgctataattaaagttttttgtctattaactttagctttcataactatctagtttcctttcttacaagatatataaacatagggacacctataagtgcggttattgctcctactggtgtttcatatggtggatttatcattcttgataaaacatcactataaactaaaaggacagacccaagtactaaagaacttggtattatatatttataatcagctcctactattgccttggctatttgaggaattataagtcctacaaatacaatgttgcctgcaactgatactgatgctcctgtcattaaaattactactagtaaagatataaatctaactaaattagttttttgtccaagtcctatagctacctcttctccaagacttaaaattgttattcttggtgccattataatagctaataaaaatcctataccaccagctataattaaaagttttacaccttcccatttagcacttactaatcccccagatatccaaaagctcaattgttgagataagttaaagtacatagcaatagctgtagctaatgaaactaacaaagttcctaatgcagtccctgctaatgcaagttttactggatcaactttccccctagattttgaacttataaaatatactaaaataccacttatactcgctcctaaaaatgcaaatatcataagcataaaacttcctggagcaaatcccggtaataccttttgaagtactaaagctatagctattgtaaatgtagctccttgtgttatacccattacagatggttctgctattggatttctagttataccttgcattatagttcccgaaacagctaaaaatcctcccactaaagctgcagctaaagctcttggcaatctaacatctctaactatctttgaatctaagctatctaaatttaaaaataagctatctgccaaagtttttaaacttatatctttagatcctattgatatagataaaattatcccaattaataaaagtactaacccaattattattaataatgcagttaaaccttttttacttaatttacgcatacaatttttcctttcttgaaatttttaaggatcaaaatatttaactaaaaaaggcgtgaaaatgaaaatcattttacacaccttttgtattattttgataattcatttctaactgattctaataataattctcttcctattggattatatgattgagcaaaataaggtgtagcatcaagtattgttacattcccctcttttacagctctaatttgtggccaaacagtacttttttctaaatctttcttatcagaatctgtagctataacaattatatgatctgcatctattttagttaatccttccatactaaccataggtaatgttatactatcttgttttggcatgtttttaggtctagctagtttcatatcatcattaactacagttcctaatccagcatcactaaataccataaattgaccttgagatgctaataccgttaaataagttttttctccttttttagcaattacttcttttcctaatttttcagctttttcatcataattttttatccactttttagcttcttcttcttgatcaaataattttgatacatctattaatttatttttccagtcatttgcatagtctttcatcataactactggcgctatttcttttaattgatcatatattttttcttgtctttgactcattattattaaatcaggattagttgataatattgcttctacatccatagtatccatcattgagtgacctactattttagcatctttaagatctttttctatgtattttggtaatttatcagtttcatatgaatctacgttagcagttcctactggtttatgacctaatatcattaattcttcactactacctgatatatctactattcttttaggatttttaggtatttcaacttcgccttttacagactgaacgattcttgtctttgattcttctttactacttgtctcattacttgaacatcctgtaactattcctaatgtagctaccatcgatgcaagcaatactaatgattttatttttttcatgagtatccctcccagttgtttaaaattattaattgaaattagttatcattatgattattttttattataacatatacttaataagagtcaatacttttttaatttccaaaataaggatatgaaaaaaagaagtttgaaatttacaaaagtaaatttcaaacttcttttttagctttttcttataagtttttatcatctatagattcaagatattcatttatagttcctataacactacttacacaaccttcttcaaatggagatattaaattagcttctttaactatatctaagaaagatttagttccaccaatcttacatatatttaaataatcttgccaacctgactttctgtcttctctcatctttttccagaattgtaaagcacatatttgagcaagggtataatctatataatagaatggatttttaaatatatgtccttgtttgaaccaccatcctcctctttcaagaagatcattacctttatagtttttgtgtggttgatatttgttttctaaatctctccatacaagttttctttcttcttttgtcatattaggattttcatatattatatgttggaactcatctactaaaactccataaggtataaacttaatagcacttcctaagtgagtaaatttatacttatcagtatcttctttaaagaataactccatccaaggccaagttataaactccatgctcatggagtgaatttcacagctttcataggttgggaagtttatatctggtatttctatccatctagacatataaacttgaaaagcatgaccagcttcatgagttaatacatctatatcatctgctgttgagttaaagtttgagaatataaatggtgatttatagtctggtatataagtacaatagcctccagcaccttttcctttttttgtttctaaatccattaattcatgttctatcataaaatcaaaaaattctttagtttcttttgataactcagagtacattaaaactccattattcattataaactttgagtctccctttggagttgcatttccactattaaattcaaaattctcatcgtagtatcttaattcttcaagtcctagtctttcttgttgtcttttaaatagtctagatgcagcaggtactatatattcactgacttgatttctaaattttgcaaccatttcagcattatagtctgttcttagcattcttatgtatcctagttctacaaagttttcaaaacctaactttttagccatcttatgtcttacttttactaatttatcaaataattcatcaaacttttcttcattttccttaaagaatccataataagctttagatgctttttctctttcatctctaaattgggatgtcatgtaaggtccaagccctgaaagatttctttcttctccatcaaaaggtattttagctgatgctaaaagcttagtatactctgatgttaatttattttcttcttgtagttcacttattatatcttttgaaaatgattgtattgaataatcagctatagacataaactgtttacctaaatcattagtaagttcttctttaaattttgaatctactatggctttataaaataatgagtttaattcttcataatgaggcccattttcatcccaatattctttttctttttcataaaactcatcttgtgtgtttatgctatatcttatagatactaatgttgccatactttctatatgatttcttaatttattaatcttatttatgttcgctttaagttcattataatcatgactatttttcatagctttaactaaatctttaaactcaatttttattttttcatagtcaggtctttcatatttaaaatcatgaaacttcattttatcacctctatattttatatttaattattatactgtattaataactattattttatgtaattttacaataaataatagttatcatatttcacttttttctaatatattccttatatgagatactttactatagcactaatataaagtcaatcaagatactttccctttaatcctacttattctgccatagttacaactattgatataattagatatataatataaactgtatttaataaattaaatatagatttggaggaatataatgtataaactaatcgctttagacatagacgggactcttcttaatagtaagaaagaagtcactaaagaagtatttgatgcaatacaaatggcaaagaaaaaaggtgttaaagttgttttatccactggaagacctcttcctggtgttcaatctttgttaaaagaattaaaacttaatgatgaagaaaattatgttgttacttttaatggtggtcttgtacaagagatttcttcacaagaagttatttctaatatagaaatgagttatgaagattttgatattatatataatgagttatctaaaaaacataatattaaaattcatataaatactccagattctgtagtagttccttataaggatgctcctaagtacagtatccatgaagctaatcttaataatattcctgtaatttgtatggatgaatctgaaataaatgaaaatttaacattctgtaaggtaatgcttatagatgagcctgaaataatagataatattataactaaaattcctaaagattttcatgataaatatactatagttcgttcggcaccatttttcttagagtttttaaacaagaaagttaacaaaggttctggacttcaagccttatgtaacaagttaaatattgacccttgtgaagttattgctgttggtgatgaggaaaatgatagacatatgattgagtttgctggtcttggagttgctatgggtaatgctagagatagtataaaagaaatagctaattatataactgatagtaatgacaatcatggtgtagctaaagttatatctgaatttatattgtaatatattttatacagtctaaataaggtggaaaatgtttattacctaaataaaaaatttaagttctcattgtttaaatctataataaacatatattttccaccttaacttattaattttttaataactaaatagtctctttattcttctcatgttcatttttcttaaataaaaatttaaaaaatcctcttatacctttaaatgttattattataataagtagtataaaaatccctgtaaacgcccctgaagaatctataacaacatctttcatactccctactcttccatctactgataattgtcgcatttcatcataataggcataagtaatactagctatcatagctactaaactagctatatatattcttttactaagaacataaacaaataaacttatagaagctcctatacatgcatatatactaaaatgcgctaactttctaactatataccccttacctccatattgtttaagtacattaaataccttctcttttacacttattaatctatgatcttttaaagtaacttctcctctaatatcatctattaccttaactgctgtatctgactgctcttttgagacattacctttttgacttgaaaaataatacatagttcccatagttaaaactactaataataaacataatagttttttcattatatcatcacctttcttgattaaactaagtatacaatatataattatctatttacagtaacatttctgtaaaatatatttatgctatactaattacataaaattttatatttataatcttttattttcaaactaaaaaagactatacaaataagtaatatatatttatactactttttcatatagccttaatatttatcctacataaaaaatatcatatgaagcttccatggcttcatcaatatctaaacagtatatatcttcatcattttcaagcccattttcttttatccatttatcaaattcattcttcgtccagaagaagttcatgatatttcagcagctagctgcccaatttgcatgtttagctaagtttaaatgtaatactcttaaatttggattatttaaacttactatttttccatcttttatagatatatttatttcttttccagtaacgtaacatctagaacttatatctatatcttggttaaacgtacatctccatccaagtgcatcaattgcacacatcgcattaaattctcttttgtctgctaaagtaactttatgcattgtaggatgtgctgaaactggatatatatagtttatataattatcttcatctacaaccattatgttttcatctataaatagttttaaagttttatttatactatctccctctaaattaaatcttagttttaattcttttataacttcatttaaacttacaggcctttttttatctattataatatccattatagctattctaatttctttttgaattttgtctaaatttctatacttattagtcttcattaatatctcccttaaactccgtaacacttcgataactgttttgttaatctattcttatactctaaatactcatcactttctctatctctaggtctacctaaatcaatttttaaatcttctattatacgtcctttatccctagacattactacaactctatcactcatatatactgcttcatctacatcatgagtaaccattattgcagttattttattttttatccatatattttctaactgttcttgaagattttgtctcatttgaaaatcaactgctcctaaaggttcatccattaataaaacttcagggttacaagctaatgctcttataaccgctaccctttgtttcattcctccagatagttgatgaggatacattttttcttttccttttaaatcagatatctcaagcaactcttctaattttttttctctttcttcttttgaaagtttttgttgtttcataggaaattctacgttagcttttactgttttccaaggaaataatgcataattttgaaatacaaaagctctatctattccaggtctatctacaactttattatttaataaaacttgtccttcttcacaactttgaaaaccacctattatagttagtaaagttgtttttccacatccagatggaccaagtaaagatacaaattccccttcttttatatctagatttatattttctaatactttattttcaactttattattcataaaagttttatttacattttctatttttaatttcattaatcatcaaacctccatttgcaaaggcttttgtttataaactttaatattctatctattataaatcctattaatgctgcaaatatcataagcccaattaaaagttctgtattcatcattgtttgagcttgtaccatagagtaaccaagaccggcactcgttgctatgaactcggctcagattacagacatccaaccagtactaattgcaagtcttgctcctgttaatatatctggaagtgcagctggtaacattacatttgtaaatatggtaaatgatgatgctcccatactttttgctgcattgtaataatcttttgatatgcttctaactccttgtattgtattaagaattataggaaatactcctgcaaatgctattaaaaatatagtaggtccatctccaattccaaaccatactatagtaagtggtacccaagccattataggtacttgtcttgcagagtctactaaaggtgaaaataacttttcacaactacttgaaaatcccattataagtccaagcggtaacccaaataacatagcatacataaatccttttaaaactctctgaagagttattaatacattttttactatttcaggatctgttatgcatgttataaatcctttaaatacatccatcggcataggcaataacaatgaactcccaattttttctgcactaaattgccaaattccaattataattataactgttattactttatataataaatccaaaaattttccattgatttttttcttttttaattttgtatttgcagaaactttaacttccactttttaaattcccccaaatctttatctgatatttttatatctgtgtaattttctaattcatttttaaatatagctttattttgtaaatcattaacacttttattatatagctttaaaaattttttatatgacttactttgtttaaatgttttattaactactaaaacataagtatcatagctattatttatagatgtggaaagttttgtaccttctaaactaagtgattttatagcatcaactattactccatcgactttgttactttcaagtgcataagctaatcctccacttataaaaggtatactctttgcttttttataatattgttttattaaatccaactgataatttctattttgtgtatatcctatttttttaggttttttatccttaagtaaaaatacatctgaattttgaactaaagcattaactatttcaaaatctttatcatatttaacaaatttatctgctgcttctttacaaattatagccatatctatttggtctgaactcagagcccattgcatagtacttgctcaacaatcatttatagaatatggttctaataaattttcaatatctacgtctgaaaaataattttgatttttcatatagttaattacaaagccagaggtatcatcagatacccctacccttatatttccatctattttttcactgtttggattaaaaaacaatataaataaacttccgattaatattgctagcccaattagtatatttttacttttgtccatctatctccatagccttttctttccattgttcatagctcataccttctgggaatactggatttactttttcttttataaaagtatcaaaatcatcagctccacaagattttaaaagctcttcatttacaacttcagtgtactcaggtatcttatctaaagccttattatctttgtacatatctaagttatttttatactcatttccatctatcttccaagtaagagttcttccttctcctacagtttttttgtatatagtcattagtgcaacttcttcatccacattatagtttttagcaaatattttagctgctttaactggattagtatatatatactctatagcttttgtatgtgctaaaaccattttctttgcaagatctggatgttcttttataaagtttgtatttaatgaaaatgaacaacagttataatcttttcctgtattcttttctttaaattgagttgttgatattatcttcccaacaccttctttttcagcaagtgatccccatgggtcacaagcactaaatgcttttatttgtcctgtttttaaagctaaataagcatctttacttgaatctatatttataacttgatacttagatgcatccactggaagtcctgtttctggaccataatctgtggtccatagtaaatcatttgctggatctgatgctatcttttgtcctattaactcttttggatcttttacattttttgatactactaaatattctgatccaccagtatgattatttgctgccactactattggtgatccttttggaatagccccaactaatcctttagttccaatgtaacctgcatccatttgacccgctgccatagcttctggtactttaccatttccaacagcttgtacatttaatcccaaatctttatatatacctgcatctacagcaactggagccgctgtcatatgatcacaattataatatcctaattttatagtataatctgaatttccttttgtagcagtttcttgttttttatcattactacatcctgttagaactgttgtacttattgcccctataaatactaatgcttttactctttttgatattttcatttaaatcctcccaaattatgatatatattatattaacaacatgagttcatgccttctccaaataaatctgtgaatttatctccttctaacctatatattgcatatcctacattcccatttttagatcctgataatattaattccatttcatctttattatctatattcttaaattctattgtcacatcttcttttggagctaatatagatttagtcatatacatttgactttcatcacttatgattcctaccatttcgttatatttatcattttttttataaactactaataaatcttcaacattatcattatttatatctttctgagtatacgtgattatattttcatactttgcatttttcttaaagtaatttaaataagattcatttacttgtggcaaatctttactttgcttatttttttcagcactatatataccgattccaataaaaactacaacaactcctagtaaaattaatatttttttacgcttcatttctaacaacctttcttaagctaggcaatatagcttttatacagaaaataactattataaaagaacatacatatttcatgctatctggtatatttaacattatagaatttgctatatttatagattcttgtgtataactcatatttatatttgtagctttacccattagaagataatttgttatgtatcctataactaaagcacaagttgtaagagttaaggaatatattgctacagttcttttacctattacattgtacatacttataagttctggtaaattagtagcagcccctgctattaaaaaagttattgccactcctggagatgctccacttgcaactaaagccgctataaaaggaatatgaccaactgcacatacatacataatacatgcaagtattgctatacttcctaaagataatacacctggattacctaaatatttttgaattatgctacttggaaatactgtagttataaagcctgcaacaagcatacctattactacatatttactaatagtaagtgctaattctgaaaaagaccatttaagtccttctattattttttgactaaagcttaaactatcttcttctagctctatagctacctcttcatcttcatcttgtttaatatataattcattttttcctaatttatttcctaaaattccaactattaaaggtacaacaaaccctgatataacataaataatagtaatatctggccctaataaccctaaacttaatacaactgctataggatttataattggagttgaggtcataaacgcaagaactggacccaagtaggcccctgaaaaatacatacttataccaattggaataactccacaactgcatattggaagtaacattcctgaaaccgtactttttagcaatgataaaatttttgtgtttcctagagatttttgaaatttttgaggacttattagattatgtagtagacctgctattataaaacttatgataagccaccctgaagccccatttaaaatacttatagatgaatatactacatctttaaaaaattctaatatatacattattgtctcccttaattattaatagcttgtattattgctttttctatagtatcttttgacaatctatcatatttttttctttgatttataattaaagttccttttgttataactccatatttttttatataagaaaaatcttttcccgcttgatataacttaatatctaacttatctttatacttctcccctattttttttattagcatcccatgctcgtcacatgtaggtcacgtatttataaattccactaatacctttgacattttattctcctttaaagcttaatttataatgaatatctaaatttcccccttaccatcatcaattataaccattttttaccataattgtacaatagaatatatctataattactattctaaatatagacaatttctatattatttttacattatttattaaattgaatcaactttattaaaattttaacttacctatttatttttctagctaaagtagctgtccaaattccaaccatagtaactcccaaaaacatttctaccccagataataatatactatgtccaactggtattatatcgccatatcctactgtagtgaaagtaactatactaaagtgaaatgcccttataaaatcatttattgctaaggtaagagacttattttctaaatatatttgtctatatgatataatttcattttctaaattaagcccaaatgccatatataaaacagtaaatataaatatcatttctaatgaagttataagagcataagtaggtctttcaccataaccacatattaaccaaaaagcaatagatttaaatttacttaatccttttagagtattccgttccatatttttgtatatataaaaatactctccataatgattcaataagttattttgctgaaatttataagctatatctctataaaatttataactattttctttatttttaaaacctgacttatcaaaaaaagtttcttcatcaaatctgcttactaaactatcatcaaattcaaaataattaatattagattcaacaaatttaaaagatttaaaatcacaatccttaacaatcatacgatttatactacattttgatattatactcttttttaaaatgctatagtctgtagttaatttcacaatatttaaatctttaaatattgcattttgcaaaatttaatatgacatctaaaaatagtaacctaatttttaaaaataatttttgttttttaataaatttacagtttataacacaaacttaaactaatatttttaatagatttaaaaaatatttacaatataaattgaataaagctttgtatttcaagtgttcatggtataataaaaataaaaaaagtcaaataaatgccaatttatttgacctttagatataataaaactataaatttataaaacgataaggaggaaattaataaaaatgagtaaaaattttataaatatgttactagaaacaaaggatcttaaaaactccttatatagcattttaaaacacagctttttataccactcaaataaaatagaaggaagtacatttacaacagaggccttagcccttttattagataaaaatgtagttacaggaaaacatactttggatgatgttcaagaaacagtaaactcaagttatgtatttgatagaataatagaaactttaggaaagaaaattgatgaccaatttttaaaagaccttcatgcaagacttatgtttaacactacaatgcatcaaagaggctatgcaggaatatacaaaacaattcctaatatgataatcggtactaaagcaaaaatagcacaaccatttgaagttcaatcaaaattagatgaattacttgaatggtactatagtttagaaaatgtaacattagcagatatagcagcatttcatcatagatttgaacttattcatccatttcaagatggtaatggacgtataggaagatttcttatgctaaaacaaatgcttgaaaataatctacctataaaaatagtatcttgggatagtgaagacttatatagagaaagtctaaatttatgtgatgtagactactatgagccattaacaaaatacttagaaagtctaccagactttagagaagaatataaacaactttgggattttgaataatttttaaaatgaaaaaagtagtaagttaccttagaatatctagtgcatcacaaattgacaatacctctatagaaatgcagcatgaaaaaatagagctttactgcaagttaaacaatatagagttagtaaatacctatattgatgaaggtttatcagcaaaggattctaatagaccttcttataataaaatgattgaatttgtatctaataaagaaaatgaaatagatgcaatcatcgtttacaaagcagatagaattcatagaagccttaaaaatctaatgataatggtagattatctacaagaaatagatgttggatttatatcaataactgaacaatttaatacaaatacagctcaaggacttttgtttcttcaaatgataggaagtttctcagaatttgaaagaaaactaatttctgaaagaactcactcggggagagtttctaaaggaaataaaaacttattccctgggggtaggattcctcttggctataatttaatagataatgatattttatcaataaatgataatgaggccgagatagtaaaaaatatattcaaacttagaagtaaggggctttcctatgaaaaaatagggcttaaatataacttcacaaaacaacgagtagcatatattctttctaacccaatatatataggaaaatatgtttatgatggaaaagtagaaaaaaataaaattaatcttcaagtcccacctatagttagtcgctatatttggaataaggttaattcaaaaggtaattaaatatgttttattgaaaataatttaaataaaatatatttgtaagctatattattacattgtgcttataaatatattacaattaacttacaagcatatttttgtatgcttacaaaatgtaagctactaaaaagctttctataagcttattgtaagcagcctgtaacttttaataggggtgattgatttgaataaggatgattttaataaactagatataaataaacaaatagattatttaaatactcagttaaaaaaaggaatttctttaactgtactttgtaaaaacattggaattgcaagaagtacagtagggggaagagcaaaaaaacaaggttatatatttgataaggaaataaatcaatatatattagaaaatgaaaattctaacggacgagcttacaataagcttactgtaagcgatatgcttacaaatgaaaaatctgattcaaagtttgaaagtaaagttgaatctaaaagtgagaaaacaacacctgtaagcaataatcttacaagcagtaataatgaaaatactaaccttatactaagttcgtctgactctgataatcttagctatttactaaaaaatatagatatattaaaaaactttatagaaaacagcaaaaaatcttcttcacctaatgaagttaatagtttagaagatataataaatgatatttataagtttaagcaagaaaagagaaattataaggttaaaagtttaagaattgattgtgatatattaaatgattttgaatctattgctaatgatttatctagtaaaggtattaatcagcaagaatttttaaattttatactaaaatcgtatatagacttttataaaaaaataaagtagcctttgtatacgggctactttattttttgtttagtaaaaatatgttttttaaactactttccatctaatggtaaaattcagttttatatgaatttattgttataaaatctaattttctagtcttcttattgtaatataattttgagtcaagtggaagtttatccccttttttagagaatatatataaattagaatcttctatacttaaagcatgatttttatatgttaaatcaacatatcttccagactttaatttgtgaaatccagacacttcataaacaatagttttttcaactatttcatccgttttttgtatattattttcatttattttagtgtaagtaaaaaatactaatgcaatggttattattatgtattttgaaacactaaatatagtttttagattattaatcattattatctcccccaacccttttaacccaagaatactatactttcttaactttttggggaatatggactaaaatttataaattttggactaaaacctaattagttttaaaataagtttttagagtatagcttaatttttagcatttcactcccaaataaactcattttagtccaatttcaaaattgttttaattttatatgctaaaataaatttgagtttgcttaacacatatggggtgaaaataatgaaaaaagaaacattcatagtgttgacttcaatcataccaattctactattttttaatgtaataatttttaaaaaaattttaatagctaatataataatctctctcactctagtaataatttctggtaggctattatcagaaattattaaattttaaaatactactaattaaaattaaatttttactttaggaaatagttttggttaatgcaattagaatctatttatttagattctaattgcatttttactatatatctttaaataaatttttaatattattatttaatttgaaccaaaaactttcgaattatataacaaaatacttagcgattattacaaactataaacataaatacttaattagaggagaattttatatgaaaaaaaataagttaataattttaattatatctttatctatatttttagtaataggtcttttattaataagggttattctaagcgattctcgttcatatcatcagacttttacaaaatcaacagacttaagtaatgaaaatattgaagggttatatttaaatgacaatattaatagtgaaaaagtagtatctaaatacggtgaaatatctaaacctagtcaagataataatcaatataattattattatttaacaaaaaatattgaaatagcaactaataaaaatgattctaagataattagattttgtgtagatgataaaaacttaagaactgaaaagggagtacgcattggggatagtaaagaaaaggcaataaatttgtatgggaaaaattattatactcgcatagaacaaggcgttgagattattggatatgtagacaaagaaaaagattgttctatcgagttttggttaaatgaaaaaggtattttttatattaggtttgattacaactatatggtataagtttaagttagaataatattttgtaatttattatattgttaatcaatagagcattaaatttagtgctctattttagtttcaaaaaacattcattttcgttaatatatttaaactttaataatcaaaaatgtatctcatttgtaaccacataaataaatttataacttacaattatcataaattacattttaaaaatttacacgaaatgaggggtatctattatggatttgtattatagtgatccaacgtttgatttgttttcactcatgttttttataatcttttttcttattttaggtacaattgtaattaatattattaggggtattaatcaatggtcttataataataaacaacctatattagatgtaaaatgtaaagttgtatctaaaagaagtgaagttataaggcacgctgggcatactgatgcaaatggaatacatcatagtggcggttcatctaccaagtattatattacattcgaggttgaaagtactgatagaatggagtttagtgtttcaggaaaagaatttggtatgattgcaaaaggggatataggaattttgaaatttcagggtagtagatatctagagtttaaaagggatatttaaattttagattacatagaataaagttaaagcccttaaaatccaaataaatggatattaagggctattttactaaatatctttgaataagtttttagagaatagtgtaaaaaataacttatttattcaatttcgttatgctatatcccaaattttctagataagttattacagtatcatctccaaaaaagtgtcctactcctatcgctactgcatatgttttgttttcttttaataatgaattaattctattggccatattttcatttctgtctttgacaattttagtataggcattcatatctaactcatctttaccattttctaaatgacttttaaaaaatagtgtatctccatttataaatgcattcataaaatcttttctatctttcaattcattttttatataatcaacatctaaaaattcatctaacatataattaatattatacgaagtatcatctagtgtttccaatgaaatagaatccttctttgattttctatacaaattttctaaatatgcatcaagaccttcatcttcaaatccatcaattgaatctatataattttgaattaatgcatttaacccaacttttgataaattagatacatcatcgtatttcaaatctaaatattttaatatatcttttaattgattttgttcttctttatttaaaaagtcttttaactcaccactagttaaataaattttatcctgtaatttttttatatactctggatctatatctttactgtttgtttcagttgcaagtgcttgagtattatttagaatatagtttaaattattgtttaagtaatttaatcttttttctcctagatgaaccgttccaattaaatatatactcttattatctttttttgcttcccaataaaaaccgtttacattattcttagaactacccttagtaataaagataaatattgaaattaccaatataattagtattaaaattttaaatatatttttcagtatatctcaatcccccttaacattaatttatatcattttaaaccaagtattttaattaatttcataatatttttgatataaattaatgtaaaacttaatgaaaaacactataaaaattaattctttaactgacattaaatactctctaatctaaaataatatttatacattcagaaatagaattgactagatattttgcattatcttttacaattgttggagagttaaaaaaagtataactattagtggtgctttggaacatagagatatcgttgtaagaatctccaataacatgtatgtcattttcatcaacattgaaaaactctcttaattcagctattgcaactcccttactgcactcttttctagaaatatctaggctatttttatttcgatgagtagaaatgtaatctccgaaattatcatttagtaaattttttacattttctagttctttacaatcattaaaaccaagtgcgaatgtagtaaattcttcttcaggaatttcataaaaatcattaaatctaacagcattactagatgtatattctgttggacctttaaaataaaagtatttatcagttgtaaattgaatttcacaattattagatgatatacaattatatatttgttcaacaatatttctttccatagttagctttttaactatattttcttcattatttagtataatagccccactagcaagaatcataaagtctagatttatatcaaaattctcaatagcaagttttaccccagaatatgatcttcctgtgcaaactccaaaaagatgtccattactctgaagttttttaatactttctaaatcactaggcattatcttatcctttttatcttcaaaatacaatgttccatcaatatcactaattaatattttcatgcttatacctctttttctacttcagttatcatattttgtaactcttgcatccactttttgtaaaatggcaatgttgcatttttatcttggagaaacaaagatactaaatgtgaattattcaataacagatattgataaaaatcactttttacttgattatattcattgtgttgtattagaagatttttcactttttctattgcaaatatataatctgtaacttgtttactgtctactgatgtgaatgaagaattatctcttctcatataattataaattggtttattaatgaagcaaattaaatctgaatatagtgcagtttcaaaagcgtacaccatatcttcatattgataaccagcaataaattcaatcttattatttatcaataattctcttttgaatagtttattaacaataatatgagctccatcttttaaagttaatattttacctatatattcatttctattacaagtataattagtcttagatattaaagtattttggtaaatattattataaaatattgacattccaccaactacaatatctgcattagtagttttcattgatgtaactaacaatttgcaataatctttagttacatagtcatcactatcaacaaaacatacatattctccattggcaatcttaactccataatttctagctacactttgaccagcatgattaatactaacaagacgtataaaatcaaattttttttgatagttttttataatttctattgatttatctgtagattcatcatcaacaaaaattaattctatatttttatacgtttgtgttactaaactttcaatacatctgtctagccatttttcagaattataaactggaataattatgcttactaaactcattgtctctatccccctaatagtgcgtgcattcttacactttatatattattaaagttttgtttttacaattatatcacccatatattaacaaaaatatattttttattctaaaaattacgacaatttctgatatctcttaaattaataacaagtcttaaaacttagatttggtaaatcatttagataaaaaactgtaataacgaaactggttgtattgatttttctaaaaatgatttacctaatttatataatttaaaatcaatttttaaaaatttttcagaaattaatcaaaattttcaaaaaactattttatattgtaaaaaattatgtataattaattatagatgactaaaaattacatattagcaaatctagggaaatctagagacgcaaagctaaaggggctaaggtcaaattagactatgccagccagttgccgaagaattaatattctttgtttttatagagttattttatgatgtaatcgtaagattattttataatgtttactttagatagcaactaccctttagacacagggtagtttttttatttcatataaaataaccataactctataacaagactatattttaaaatttggggtaaaatgtttagttattgtaaattcatatgcatatcagagggaggatattatgaggaaaaaaatatcagcagtattggccatgtctataatagctacaaacgtttcaccggcaataaatgtatacgctaatgaagtagtaaaaaagaaagcagtagcaatagagaaacaagtatctaaaaacatgactgttactgatttcaaaattaagaacaatcctaattttgctaagtacaatgaattgtatagagttggggtacaatctatatcaaacaatggaaggagttatccaggaactaaaatagaaaatgctatagatgggaaacttgaaacacattgggagacattcactaaaaatgatgaaacatttaaaaatgaagtgactgtggaatttaaagacatagccgagataaacagattagcttacgctacaagacaagatggggctaaaggtaagggataccctactagtgcagagatatacgtttcagaaagtgagacaggggaagactttaaactagcaggaaaagtagaaggaagtaaagcaacaggtggaatggtagaatttaaatttgacactgtacgtgcaaagagagttaaattcaaattcgtagaagcgcataacgagtgggcaagtgccgcagagttttggttctacaaagaagataaaactctagacaagatggaaagattatttactaatacaaatatgaatgaggtaagtaaagagtttgcaactactgaagcattaaacgctttagagaaagaaactgaaagtcatccattccgcgaaagctttaaagagtatatagataatgcaagacttgttttagaaaataaagaagtaaactttagtgaaactaaagtatctaaattgttagggtatggaacccctaaccaacaagcttatgatgaaaagtttaaattaggtaatgagcatatagcaaatacagaagttaacggtggaatgtacccttcaactaaaatagaatatatgtatgataataatcctaatacacattgggaaacaaacagaagtaatggaaatgacttcactaacgaagtaacatttacttttgatgaagtgcaagagttagatagaatagcattattgcctagaagtggaaaccaaaagggattcccaactaagtacgaaatatatgcttctgatactactaagggagatacatttaaattagtatctagcggtactgcaaaggttacaactgactttatgcaatttaaatttaaccctacaagctttaagagattgaagtttgtatttaaagagtgtcatatgggtagaccatttatatctgaagctagattttataagcaagatactttatccgaaaagatggaaacattatttactgatagcaataagaacaaagtaaatcctgacttcggaactttagataaacttactgttttagagaacgaagcaaaggtacatcctttatatagtcaattcaaagaggatttagatgacgctagacaagtattagaaggtaacgaagtaacttatacagaagcaaaagtttctaagttcaaggcttttggaactgaagagttagctaaatatgataagttatataagatagataatagtcatataaagaagataactactaatggtagtcattgggcagacagtactataggtaaagctatagacggtaacccaaatactaactggcattctaatgctagaaacaatgagaaccatacaaacgaagttataatgactttagaccaaataagaacgttagatagaatagtttattattctcctagagatagaggtttcgcagagaaatttgacatatatacttctaagactactgcaggtgatacattcactaaagtaactagtggtagtgctacaagaactagagactctatatctataaagtttaacccaactcaagctaagagaattaagtttgtttataagcaaggatttgaagatttcgcattagcgtcggagtttggactttataaacaagatgaaactatggataagatagatagattatttactgatgctagtatgagcgagttaagtgaggaatttagaagcactgaagcacttaacactttagaagaagcctgtaagaaacatccattctataatgactttaaagaggatttagagaatgctagaaatattttagagcaagaagagataataagtggaggtgcgactactaagtcatttaagcatttagataataaaaagtatatagaacaatttagaattccttatagtaacataaagaggataactaataatactggtcaatatgcaaatcagactatagataaagcggcagacaatgacataagtacttattgggaaactaataagcataacgatgaaaattggagcaatgaggtaacagttgagtttgttaacccaataactatagatagattggtttatggtgctagacaaagtgatgctaaaggtttcgcacaagagtttgagatttacggttctacaactagcaaaggtgaaacatttaagttagttgctacaggtaaagccgacaaaactaaggacttaatagaagcgaaattccaacctactaagtttaagagaataaaactaaagtggactaagggtgaccaaaactgggctactttaaatgaaataatgttctttagaaaagatacagtttcagataaggttaacagtatattcacaaatgaattaaagaatgagttaactccagagtataataacttaccagctattgaggaattagaaaaagaagttaacacacatccattaaaatcagaacttatgaaaagtataaacatggctaaagagttaatcaagaaccctgagagtaataaaggtcatgtttatgaattagaaagcagaggagacgctataaaggaaagtcaaaagagaaaagtatggaactttagagattggcaacctacaggcttagcagttaagtcaggagagaaaataactgtttatgttgacacagagccaggtgaacctgtacctaatttagtatacaaacaaatggatagtagacataatggtttaagagatatcagattaaacagaggtaaaaacgaaatagtgatacctgaagtcgaagcaggggacttaagacctggaacaccattagcaggagttctatacgcttacaacccttatactccagaccaacaatctagaaaacctaagataagaatagtaggtggtgtaagttatcctcaattcataaaaggtgtaactactgatgaacaagtaatgaaagatttacgtgaatacaataagaagttagagaaagaccctaagttacctgatgtatttgaagtggttagtgataaagcttttgtaaacgttaaagcgacatacgctttaaactggtatactgagcataataaattacctagctatactgcagataaatctgatgaagtaataaaggaagcaatgaaattctggggatttgatggttctaaagacatacactcagactttaactttagatatgtaactatgcttaagaacttagatggtggagcattcatgaatgcaggaaacggtataactggatataactttaacgaacagaatggagctttaaatgtagatactggttggggattcatgcatgaattaggacacaaccttgatacaaataatagatcaatgcctgagataactaataatattttacctcttcatttccaaatgattaaaggtgaagctagtaagatatctcaacaaaatttatgggagagtaaaatattccctaaagtaagtaaagaagattattctaacaatgagtggtaccctgcaagtgacactagttcattaactcatatggcaccattatggcaattacaaatatatgacaatacattctggcctcgtttcgaacagcaatttagagaaagaaacataggtgggggagattggaatgacaagcatgaagcatgggcagttgttgcatctgatgtattacaattagatttaactgagcattttgctagacatggtttccgcgtaaatgaagcaactaagaaacatatgtctcaatataagaaacctgacaagaagttatggtatataaacgataacaagtaccttaagaaaggtgaaggtttcaacaatgagttagattgtaatcttaaagttaagacacaagagaattctgttaaattagacatagcaatagataaggctaacgagaatagcttattaggatatgagatagtaagggacggtaaagtgataggatttactactaaagatactttcactgacactaacataaattcaggaactaaccatgagtataaagtaataccttatgatgtaaacataaaccctgcagagggagttagtgttaaagcacaccaaccttctatagaaactgttggaggtgtaactttaggattacgtgagaagtttaatcctctagattacgttaaagccactgattatcaaggtaacaaaatatcagatgttaaatttacaagtaacgtggatactgaaagaagtggtaactatacagtaacttatgaagtgactgcagatggagcaactactagagagataatgaatgtagatgtagttagtaagtatgattacttatctgatagagaatggaatagtcatcatactgactggggtacaccttcacgtaataactctataaaaggaagaactttaggagagattaaaaactacgataagggtataagattacatgctaacggaaatgttgtttatgatttaggtgagcataactatgataactttgaagttaaagttggagtagacatgaatattgaggctcaaaataattcaagtataactttcaagattgtaggcgatggaaagactttagcaacaactaaagtattaaagcatgcggataatatgcagtatataaatgttcctgtaaaaggagttaaagaacttagattagaagttaacaatggtggaaacggaaatacttcagaccacggtatatttgtagaacctaaattaacaactaataatgctaaacctgaattaactatacctaaatctcaaactgttaaaattgggcaaactttagaagatgtggttggaacttataaagctatagatgcagaggatggcgatataactggtaatgtagttgttactggacaagacaaagttaactttaatagagttggtaactatactataacttattctataactgataaggatggcaacaaaactgaaaagagcagagttataagtgttgtaaatcctgaagactttagatatctatctgattatgagtggaagtctgctactaaaggttggggtactataggtatagataagtcaatagataaacgtgaaataactcttactggagaagataaccaaccagtagtatataagaagggtataggtactcatgcacattctgagatagtttacgacttaacagataagaacgttaatatgttcagttcatttgttggtatagaccgtgagatgtataacgggcctgcaagtgtagagtttaaagtttacgttgatgatgatttagcatatgatagtggtgtaatgagagcaagagacgctcagaagtttgttcaagtagatttagcaggtgctaaagagttgaaattagttgcaactaacggtggggacggaataggttcagaccatgcagactgggcagatgctaagttatacttcgtaaataatgatagagtagataaatcagatttaactaagactatcgaagatgctaagaaaatagagaaagataattatactgacgaaagcgttaaagctttagatggaaagatagcagaagcagaagctttattaaaagaagaaaaacctagtcaagaagcaatagacaatatgactagtgcattacaagaagcagttaaggctttagtagagataaacttagaagaagttgttagcatacctgataaatatctggttaaatctttaagtagtactttaggtaaagagggtaactttacagtaggtgatatgcgtaagttaactaaacttgatattggttatggtgtagaaagtcttgaaggattacaacatgctaagaacattgaaagtatagttggtgaacgtaacgaagtaagagaccttagaccactatctgggttaactaaattaaaagaggttaatttcagagagcagtatgttgcagtaggtgagttaacagttgttgacggtaagcttaaagttaacacagaagcatataatagacaaggtaagaatataacaactaaagtatctttagtagctaaagatggaactattgttaaagagcaaggtttagatggaacaactaaagaagttgatttagatgtttctggtgtagaaccaggatactatggagttcatgttgcttacgaagacagtgaaataagtggtatattaatatacatgacaggaattaaataaatattaacaagggggatctagtgaataatatctagatcccccttaaatataatttttttctgattttaacttaaatttttttattaaattcagcatattaatttcataatttcatcttatatttaataaactgcttatgttacttaatattgtattttcaaggtttatacattatttaataaacattaaatatatatttaatgtttattaaataataattaaatacttttttaatatatttttaataactatttaatagtacatatattttttatcttctttattaaacctagtaaaaatagcattcattaaatacttttacaactaaattatatatgcaccaatgcaaactttatataaagtatcatttgtaggtaattctaattcaagtaactttattaaattatttctaattgctaaagctatagctttgatattatcactaacctttaaatcttgttctgcatctacattagatataaaatccacttcaattaaagatgctggcattttagtattttttaaaactgaaagctctttgcttaatttaactcctctatttttagtattaaaaatctttgaaatatcttcacatactccactagaaaacttatttaatttatcattttcatttgaatactgccaaacctcagcacccctaacactcttgtttttacttgaattaatatgaatagatagaaagtaatctgctttaaaatcatttgcaatttttgctctttcattaagtgaaatatgtctatctgataatctagtaaacttaaaatctaaatcataactttttagtaattcattaagaacctttcctatagctaaaactatatctgcttcattagttttgttttgtccaactgctcctggatcacttcctccatgacctaaatcaataactagttttttcataaaatcccctttctacttatctcccaatttattcaatttatatttgtaagttaattataaaatttaaaaagtgatttttttaataaaaagtaaaatatcttgattttgtaaataaaaaattgaaaaaaataatttttctataaaaatagccaaaaatataaggactgtaaaataaaaattttacagtccctatttctaaactttatttaacttatgtatttgtcctaccaatacttatccatctcatgtttatgttttaaatcttctttttcctctaacttatactcttttatcttattatccaaagtacttttaaaaaatttatatgaagtagcttttatagtttctacatcatctttgtcaagagttatcataacagcatcatcaaaagctttttccatatacttatttttaaaatcaatatctttaaagtcttttttgaaacttcttaaagttccctttgtaaacaaactctcatcaggtacaaaaacatcaattgaaactttatcgtcactattgtctttagatttaacttcattataatcaacctcttctatagtaactgcactttcctctaagtcaatgtcttttgaaatatctttaataatctcaatatctttagtaaaatactttctcttatccaaatctttaacaataaaatcaatagaatcaacttttctaccaaccttattttcttttatatctatttcaaaaagctctgtgtcgttaagttcctttatagcaggaagtataacccttcttttaaagttagcatactgaggataactattttcaagcataagatacatcttaatatcatcaactgtgtagttaataacttgcttagttcctgaccaaattctaattaaatcatataatctttgagcattgtaattttttaaactaaacaacagtgccaaattggcaggagtgtaccctgtttttaaatattgatctaataaatcatagattttcttaggactatcaattctaaatatttgagtttcctcgtcaaattgatatccagatataaaattatactgaccccaaactaatttatcatttttctttttttccataaaaaatatactcttttgcataagcccagataaatattcacttatcttttttacagtcctatcattagtcctttttattatgtctttaaactcatcatagtgtatgtaacaactcatagaaccatcataatccttttgaagtttgtataatatcaataaaaatattctattttcatttaaagataaactatattttgattgaattaatacattatttttcattagtatcttaggatttttagtatcagttaaattattcatattctcccccaaatattaagttcttaaatcaaaatatatcatgtcaaaataaaagtgtcaattttatcaatctgacacttttgttgctatcaaagtgacacatttgattatcaagttgacatatttaattatcaagttgacacatttaaattatcaagttgacacatttaattatcaaagtgacacatttcgttatcaagttgacacatttaaacaacccaacattagtatttccaatactttaaaccatgtctaaatactattaaatactataaatactttttttaaatactagtaaagactagtaaaggtcttttttcttatctaatctgacctatttttatagataaacatcaaataaatatacatataaaaattttataaaattgatactgttatcaaagtgttatatttaatagttccatatatatttaactaacagaaaatatcattttagaaaataaaagaattataattgccaaatccatttaatacctatcaaataaacacacaaaagtaccccgtaaattagcttgtacgaggtttaattgttatttttgaccatttatattaaaagataatttttttacctttatagcgctaatattttcttaatctaacacaaaagatttgatttatatttgaactttatcttgtttttaatattagaatatatttttttgaaaaataatcctcaaatatattttaggacttaaaagaattaaattattacaatgaaattaatcaattgattaaaagtaaaattaaaagggggttatactatggcagataatagattatctacagaggtatcagaaacaaaaaattactcaacactaaaaattaaatttgattgtggtttaaatgatgatggaaaaacaatagtaaaatcaagaagttactcaaatgtaaaagcaagtgctgcatctcttgatgtgttaaacgtagcagaaacactaatatcactacaacagcatgataaactttcaataataaagttagataatactgagctaaattaatataaactataggaggaatagaaaatgggagaaatagaaactaaattagtaatgacttttttaaatacattaggcaaaaaagtaagcttatttgtaacagatccaagagaagatttaacagaagaagaaataaaaaatgctatggatgtcataatagagaaaaatatatttgaacctaatggatttgatatagttgcttcagtagatgcaagaattgttcaaacagaaactacagaatttgatttggaagtagcgtaatacatattacatttaagaaagcccctctgagctaatgaggggctttcttagcaatttaaaagattatttggaggaatatattgatggagttggatttaatgcaattggtgtcaaatttagggtttcctgctatcgttacaatgtatttattaatacgtatagaaggaaaactagaaggcctaagtacaagtataaattctttaagccaaaatatttatgaattaaataataaaaagagctgagatataaaatttatctcggctcttttatttataaataactatactacttgatgatttttaaaaattcgatatgcaaaaggcacacaaataatactaagtatcgaataaagtgccattctcattgtaatcacatccattgtaaaaccagggaatggatatgagaaataatttgtaatatccatatcaaagactggttgacatgatgtataagggagaatcatataaatatgattccaaataccattagtttgactaacattaaagaataatggaataattattatacaaatcataacaattaaaactggaaatggtgttttcatttttgctgataagaataatgtaatagacaccattgcaagcattaccaaatataaagttgcaacacaaataataattgcttgtaaaaatgttaaagaatatggtgttgtagaatttataatttgtataggtagattccatccatctattccaaatgaaaataatacaattcccaatcctacaaaaacatttatggtatatataataagtgcaaaaataaatgatgctaatatttttgatgttattaactttgattttccatatctagaagagagtattatattatcagcaccagattgatactctcccgaaaatacaggtgcaatacaaatacaaactgctaatattggaaggaccattagttcaatacacagaaatatagcctcccatccctcatgatatccatactcatatggttttgatacttctttatttttctcataccaaaattctttttcctgattagagtaattccaatcttcataatcggcatttaaaatatgagatatttttttctctctttgttcataaaagtttgctccattttttataggtaaattctcaatttctgaaaaagaacgatcagaaaactttgaatttatatagttattattaataaaccataagtaagataatttagggcttatatatttgttaaaagttgaattatttagttcttttttaccatcattaataacaaaattatcaggattattaaatagctcttgatattttaaaatatcatttgtaattctttcctctgttaatgtcccttcaagttctttttgtgaccttttttctaattcaatagcaccaaaacctcgtctttggttaccatccttatcaaatgacaaaaattgtataggttgaagtaaaaatagcattactgttaaagctaaactgcctagaatcacaattatatttagtttttttcttataatttttttaagttcaaatactaataaatctttcatactatcccccctattgtgatactatatcatcaaaatggtataaatataaatcttcaagtgtaggttcaacattggttgcattttcagtaggttttacatcatttacaatcctaagtaaaaccttatcctccctatcatgttgtaggtttacaacacgatattttccactaatcatatctacattgttttttgggatagtacatttccatacctttttgtctatttctttggttgcaccttctcttaagctattaagaattatctgtccacccttcatcattagtattttatctgaaatataatcaatatctgaaacaatatgagttgaaagaataactattttatcctttgaaaaattagaaattaaatttctaaaacgtatacgttcttttggatcaagacctgctgttggctcatctaaaactagaattttagggtcatttaatactgcttgtgcaattcctagtctttgtttcataccacctgaaaaagtcctgatttttttattacaaacatctgataatccaactaattctaaaagttcttttgtttttatctttgcattttgtttgtttattccctttaaggctgctatgtaatacataaattctttagctgtaaaatcagggtaatatccaaagtcttgtggtaagtagccaataagttttcgataattttcacctaaggaatttatactagatccatttagtaatatatctcctgatgttgggttaagaataccacatatcattctcataagagttgtttttccagatccattggctccaagtaatccataaattcctggttctaaagtaacactaattcggtcaactgcaattttattgctaaattgttttgtcaatctatcaaattttaattccatattaaacctcctaaatgtgagttaagtttatacaatcatattttttattacaattaataactaacttgtaaagttgtatagctactccaatcattgcaataacaagcataacaatccaaatccataatgaagatgaaatatataatttaggtaaatataatgtagatattgagacaatccccattataaagactccaaaagcaaagcaataatagttactttctttattcttaaatttatttaatatccataagcacccaaagcaagttatcataaatggtacacaaatatataaaaatatttcataagcataaagtgatgttttaattccaacaaaaatacctaaaattgttaggcttaagatattcataagtcctaatatgcttatgcgtgatagcattacttgacttagtgtatattgggtagataattcaagttcaacagttttatatgtataagttcttgaaagttctgtaaatgtagagatataaattaatggagctatagatgaaattaagttaattacttgcattgatgctggataagaatatagccttaaaccacaaaataataaaatcaaaaattggatgatccacacttttttacgaataaatccaaattgttggaaataaaactcccaaaatgttaatcctctacattgagtctcacttactatttcacgtacctttaagatagtatcttgaatactactggattttggtggaggtacatttttatataatttatgtaagtctttttctaagtttttcttcaatataatcactcccacttaatttacttttaattgctaataaggctaaatttatcctatatctaactgtaaaacgagactttcctataatagttgcaatttcatttatttttaaatcatgaccgtactttaaaactatgacttcttgttgttcttttgggagattatcaataatgtgtttaagtgttattttatctgtgatactgtcaatatgttctgaggcagaaatatctataatttcttttgttgattctaaatactctgttttattctttttaatccaattaatacatagatttttagctattgtataaagaaatgctcttggttttcctctatccgaatatgtatttatatttcttacaaaatttaagaaaacttcttgtgtaatatcttgtgcatcttcactatttccaactttgaagtagcaatatttataaatagcatcataattttcactaacaatttgctcagctatatttgaatcaccatttttaattttcctaataggatttaccaacacatcacctcctcataatgtttaacaatattaaaatcaaaaatgtgcaaaaataatttaattattttttacaaagtctaaataaatgtattttaaatatgtttttaaaatatagttcaaaatttactatttcactccaaattaaaatcattttagtccaattttatcattatataagttttaaatgttaagatagatttaaaattttatgggaggtttattttgattcaaataaggaggtaacacaatatgtttgatatttttaatataataggcgaaattttagttttagtttttttatacttaacttctaatagatatcatagattagttaaactagagcgccttgaaaatactggaatctcagctgaaaaatataatacttatgataaacgtttaaggctagagtgtgttttatttgttgttgtaattggaagtgctactattttaaataaatttacaaatgttttaatagttgttttctttatgcttatattagggcttacatttaaggcacttataaataagtgtttttctattcctgaataattaattaaaattagtaagttaatacccttaaaatccaaataaatggactttaagggtatttttatacttaaatggattaacattgtatttatttggagtaaaataaccaattcaccataaaaaattaagtaatttatccgtattaataattaaagagaggaggcgtttaaatatgaaaattaaaaaaataacaaagtcattagcttgtgctacaatagcattaggaatgagtacttgtacattcacaagttttgctcaaggacctaatagtgaagatatagataacggcatagctaacttaaagtacaacaaaaatgaaatactagctacaaatggagatactattgaaaatgttgttcctaaagaggggataaaaacaaataataaatttattgtagtagagcgtaagaaaaaaacacttacaacatctccagtagatatatcaattgtagattctgtaacagatcgtacatacccaggggcactacaaactgcagatgattcttttgttgaaaatagaccaaatattttaatgtgcaaaagaaagccaataaatattagtattgatttacctggtatgaaaaaggataatacagttacagttcaaaatccaacttatgggaatgtatctggagcaatagatgaattagtatctaattggagcgataaaaactcacaaacacatacattacctgctagaactcaatatttagagtctatggtatatagtaaatctcaaatttcaaatgcacttaacgttaatgcaaaagttcttgataattcacttggaatagactttaatgcaatttcaaatggagaaaaaaaagttatgatagcagcgtataagcaaatattttatactgtaagtgctcaacttccaaataatccatctgatttatttgatgatagtgtaacttttaaagagctagttagaaaaggtgtaagcaatgaagcaccaccacttatggtttctaatgtagcttatggtagaactatttatgtaaagttagaaacaaattctaagagcaaagatgtacaagcagcatttaaagctttaataaagaacaatggtgcaagcaacagttctcaatacaaagatatatttgagaatagttcatttacagccgttgttttaggtggagatgctcaagctcataataaagttgtaactaaagactttgatgagataagaaatgtaataaaagataatgcaacttttagcttaaaaaatcctgcatatccaatttcttatacaagcacattcttaaaagataattcaatagctgcagtacataataaaacagattatatagaaactacatctacagaatattcaaaaggaaaaataaacctagatcatagtggagcttatgttgctcagtttgatgtatcttgggatgaagtttcatatgataaagatggtaatgaaattttaactcataaaacttggaatggtagtaatcgtgataaaactgctcattttgcaacagttataccacttgaggctaatgcaagaaatataaatatattagctagagagtgtacaggacttgcatgggaatggtggagaactgttattgatgaaaaaaatgttcctttagcaccaaatgttaatgtttcaatttggggaactacattatatccaagaactagcatagattatcaaacaaattaattatgggaaaatagtaaagaaggactatggattttaattcatagtcctttaaaatatataatcatcgttctttaattttgtttaagaatacataacttaatttatatactctaattttacattatatataaacatttatatttcatttatttatgctttagatatatccttagctccatcttgagttatatcaaaagtcatttttaaactatacataccatattctaatactgcagtaaacttagtattagttttattaggactagtatttttacctactgttaattctaattcattagtaaatttattatagttaagagatatattgtcattttcagaaagaatagttattgctggaagtccttctgttatttcataagttttataaatttttttaatatatttatcagctccagtaactggacatttcattttataaacagttccttcacttggagcttgtaccttaatatcttctttaagcatttgtccatacatattaaagaacttatcccctgaccaatcttcaaaagaatcagcagccaaatcttgtatgtcagttaaattagttacatagttattattacaactaaaagtatttaattttttaagattttttacaaaactaacatcatcaacaaaatcatcatcaatacttaaatattctaagtttgtaagatttcctaaatattcataatttactttagcagtacgtctattacaataatgcatatcaataaattttattttttcaagtttagaaataggttctacatcaacgattcctgtattattatatatatctaagtgttctaaatttttaagatttcttaatggagttaaatcacttatttcatttctgaatacttctaagaattctaagtttgttagatcttttattggagttaaatcatttatactattcatacttactttaagagttttaagatttttagcatactctaatcctgacaagcttttaattcctcttttaggagttcctttttcatctggacttaatgctaaaaaaccactatcaattttagttatagtttccatatcatgtgctgtaatattatctaaagaatttacatctcttcctagagctttattaatagcctttcttaaatttgcatcttttatattaactaattctatattattgactttatcatcgtcttttgatttgttgttttcaataaggttagtatcaacagtattgactttattatcatcttttatatcattgtcatcactagaattagtgtcaacattattaactttattgtcggtttttacatcactatcgtcattagatttagtatcaacagtattgactttattgtcggcttttacatcattgtcatcattagatttattgtctgcattagtgactttattatcatcttttgactcattatcatcattagatttattgtctacattattgatattattagcgtcttttgattcattatcatcattagatttagtatcaacattattgacttgattatcatcttttacatcattattatcattagacttatcatctatattattgatattattagcgtcttttgattcattatcatcattagatttatcatctatattattgatattatgggcttttttaattttattatctccattagacttagaatcaacacttttgactttgatactttcttttattgtattaatgtcactagatttagcatctacatcattaattttattatctttttttacttcattatgtacatcataattagtttctgaagattttttactagctataatcttattttcatgtagtttattacttacagttttcttatttttaacatgtattataggtttattatttaagaaatctttttttgaaatttcatttgaattctcaatggtatgttttttaggagttgaaagatttgtagttttttcgatatctaattgtttttcatcctcttttttatgtatttctttaatattttttaaattatcttttttagtatcttgcactaattttttttgattgttactaatattatcactttgttgcttactttcagatgaattacaacctgttaacaatactgaacttaaacttaatgctattaaaaaaatagaacctttttttaagtgtttcatttttatccccctcgtatgatgatgcgttctgttaacttgtttatattttgatatcgaccttattagggtttataatggtttcgataaaattgaaacctaaagttagccctcttgaatgttataacacagatgtatataagttaaaaagtactcttcttgatattctaagtgtacttgtatgtggtaaggtataatagatataaacttatattattcatttactactacaaaaagagcaagttcaatatagctctagtagagttttgttatattagctataatcatcaagaaaaaatcaattggttcgtaaaatataattaatattattaataatatatatataataattatcagtgtatttaattaacagaacctcgtcttaatagaattgtttttaatttggaaatcatttgcagttgacccaaatagatattatcatatgtttatttttaattccaaaagttattttcgatactaaggattctaactataaataaaatctataaccgttaattatttctttttatgtatagtaactgtactttttttatacggaccagtttggttttttgaacatattccaaatatcgatccttttaagattccaatatgggtagcatgcgtatatatactgtattgcaccctattagcaatatactggataataaataaagattttaaaatggaatgtcattatgcattaataataactatatatgtaggatttacgattcttgtactactttatgcagcctatcatggataaaataacatcaatataactcctgaaaatttagggattagctattaaaattaatgtccttaaaattgaaataaatagactatacggatattttaaccattgaaattatactatgcgagaggaggttgaaaaatgaattctagtaaattatttacagtgaaaactactatggaaaaagaagattaccataagtttttatacatatcgacatttataaaaagtaaaataaagattttgtttttacttttttttactgcttttctatcaggacaaattgcttataatgaaaattactttgatttaaaaggctttataattttttggattgtactagtaatggtagcaattttagctattatatttaagattgaaattaaatttagaaaaataataaaaactgataaaacaggattatttgattcaccagaaatgctagacttttatgcagattttttaattgtaaaaagtaaagtatttgaaggagaaataaaagttaaatacactcagatttataaagtatttgagtctaagaattattttataaattatttcaatgctaatcaggcaaccttaataagaaaaaaagatatgaaaagcgaagttattgatagtataagatctttatataaaaaaaatcttacagataaatataaaaaagtgaatatataatttaagacaatattatatttattacttaacaagtcttaaaatttctgtttaaggcatagttacatatttagaacaaagttaaagcccttaaaatccaaataaatggattttaagggcttttttactatatacttttaaatgtgtttttagagaatattatttcttagcaataccaacgaaaacatcaattttctctaaaatatttaatttagttaacaagatatataaaaacattggaaatacagttaaaacaaccttttagtaaatatctatataaaatttatttttacataaatctatttacatgctttatataattaaaatattctcaaattatcttcatctgtaaatgttacaaaaaatagtactactatgtatattaatattgatatagtaaataaaatttttcgccataattcaaaccctttatctatgtcattgattataaaaattaccgtaaaaaaaaataggtagaagcattttcttaccaaaagttattattctttctttactaaaattaaaagttattgatttattatccatatttctaacactttctaagtgatcctatctcactaataagtattttatttttttagaataaacttcaaataataaagcggttattgcaattattgatgctcctatacttatatacccaaatactcctatatcatttgatgtgattaaatttaacattacccctagacaaagaattattccacttaaatttttcataaaaatcatctcctttttactcttttagttagaataacatggatcataactttaaatttaaaaatggactgaaatctataaatttggaactaaaacataattcaaactttactatttcactccaaaataagatcatgtcagtccaacttttacttttgtttaaatttttatattaagataaactagaaaggatgtgttaaaaatggattcagttaaaaatattaacagtgataattttaataaaaaaacaacttctactctattaagtatttttcaatcgcttggtattatttttataggggcaataattgttaattttatagtcaagtggtaataaaacagtgctattttgaacaggtcttaaaaattctctttacggactatcctatttagaaaaaattaatgctcctagaatctaactaaatacattctaagagcatttttatatattcatttaaatttaatttatttgtaaacacatattcttattcatctttatccttatcagcatcatttttattattgtcattattatcgctatctttatcaccatcagaatcacctttattgttgtcattatgatcattatctttatcatcatccgtatcatttttattgttgtcattatgatcattgtctttaccatcatccgtatcatctttactattatcattatgactattgtctttatcatcttccctattgtcttcatatctatcttcaagttcatcttttatttctttatttaaataaactggattagatttattttttagtaaatttataagctcatcaacagacatattttctattgtatcttctaataaatcttcatttattatctcatctgctttatatcttccaaggcttatccctttttcaattgctttttctctatcttgtgatgaaccatacatataaactatttcaactccgctaaagttttttctgattatattttgaatatttctttcaaatactttattgtctgtactttctaaaaatgcaaatcctacaatcattgaatccttattctttatatctttattgtttttaacatatgatctaataatcttagttgcttcatcaaggcttttcccgtttaaatctttcatattcattttctttccatctttatttaaaccttttgcattaactactattttattctcatcaacttcaagtcctatacttggatttatatctaatgttactaatgcatatggatttgatatagtttccttgtgtttatctgaaaagttaaatataaatataaagaaaatcgaggcaactattgccaatggttttattatttttttatttttaaattctataactttactttttttaattatatcttcttcagtaaatataatcatatccccaatagataaccctttttttatttttatttttaacatatccccactacttttcataactattgcatggtctttatttaattccataacgatacctttataatacataagcttagtcacctctatttccctacccatagcattaaatttctatattttttaaagaatattattataagtgaaattataaattttttacttctctttattactttttctgtaatcatatattttaaagacattttttttattggaagtctctttttttcatacataaaatcggtaatatcacaatctttacttgctttctttgatacattaatagcattttttcttgtatcactatgttttggagcctcgtctattaaatcttcaatcgttaatttaaataaattaagttcttccttaaattgatttatttcatttataagttctgttttatcttcaattggattatataaaatgttatgtatgtctactcctatctcgttataaaaatctattgaaacaacatcgatctttttcttctcttttattaaaaaattttttactctactttcaattactatctttgcaaatgataaaaatggacctttttcttcatcatacctatttaatgcctctacaaaagccataagacctatactaaattcatcgtcattttcaattgaaacatatttacctgtaacatttgaaattgtatttattataaacccaatattttcttcaacaatctcatttatatcatcttttataaatacctcttttgacataattattattcccatcctgatttttgaaatatatttgttaattatatatattatttaataaggaaaagcagatatttcaataagctatatctgcttttgttttttatataacctctgtacttggggctaatacatttacactatctattttttcaaaatttaataaatcgtctataagtaaattatcttgattttttgatacttttatctcgtaaactagctcaaaagaatcacttaatatatttttagcttttatattgtttctaattttatatttatcaagtatttcttgaattgtatttaaattaacttctttccctcttataactagtaataatttatttccacacttactttcttttcctgtaacaatcataaataaagctattaaacaagagcttactaggcataaaaaaagattttgtgtagctgatgcaatacctactgacatactccaaaaaataaatcctatatctctatagtcttttatatttgttctaaatctaactattgataatgatcctaacattcctaaggatatagctaaattactttgaattaaatccataagaacagtacttataaatgctatcataacaagtgttatgttaaattttttattataatttaacgtatcatatgaaagcttatatgtataataaattattgtagaaaaaacaatagtcataataatactttgtataataaattttggtgtttgtgcattttggattattgagtttaaatccatacttccttttaatatttgattcatattaacatctcctgtctaataataatatttatttaataattgtcttgatgttccatacttgcttggaggttttccaataaagttacactttgacaaaatttcttgtatctgataaaacaaaaatctatcatatttaacttcaagaatagtttgatccttaggcatagcttgcttaaagtttatatcttcattaaataaatcataattaaagttggtataccttaaattgttatcaagagttattcttgtattgaaattttcatgtgtaaatgctctcctatcatattcaaccatagaaactggtctataattatgagttttcattaagttaaatgcataattagaaagaggattattgttatagtttaataatatggaataatctccattgattaaccttattgcatcttctttagaaattgttatgctttcttttaattctctgtctaaatgttttcgcttaatttcaaatttagcaaaagtatctgtagtgttgtatattctcaatcttacacgttttcttttttcagtttttactagtttttgtgtaaaatcttcattatcaatactatcaaaatatacacttcttgttttatagccattatagtcaccatatttatctggaattaatattttacttaaagaatttagcaagtaaattctatctgtaagagaaactaaaaattttacttcttttcttgatacagacaacatgccaattttactcatagtttcacctcctaaataatttttcactatataatacaaagctgttttaatttttagggactttttttataaaatttgaaaaatatattaaataaatatatatctaatattttgaataaagttaaagccattaaaatctaaataaatagattctgatggcttttttactgttatccttaaataaatttttaaagaaatgctaaaaactttattttttttataaagttgcaagtttttgcttttcgtttacgaattaataagtgtaaaagcttttacagtaaggaggaagtaatttgcaagataaattaattatcaaatatataaaaaagaaaaatcaaaaaggaatggaaattttaatagatcaatacaactctcttattacatcagttattagatttcatttaggaaaattaagtaactatgaggaagaatgtgttagtgatactttactagccatttgggataacatagaaggttttgaaaaagataaaaatacttttaaaaactggatatgtgcaatagctaaatataaggcaatcgactacaaaagaaagtatttaagcaaaatagaaacttcaaatttagaagatcagacttattatatagacaaaaatctattaaaaatagagattcaagaagaattgaatgaaactctaaaccacttatcaaaagaggatagagaaattttcacacgatattacatacatgatgaaagcatagttgatatagctaatgataaacagatagccatttcaagtgtatatagcaagatatcaaggggaaaggcaaagataagaaaatctttattgagagagggaggaaagtaaattgatagataaatataaggtattaaataatgaaaaaattcaatttgataaatatagtgaagtagaaactgataatgaaaaaatgaagaatctaatgaaatctaagataaaatcaagaaaaaaagcccataaaaagctacttatagcaagtataactgcagcacttgttctaggttctgcaactttaactactcagacaacttgggcttatatcaatagattagtaacccatattgagtcatttttgggtaaggaatatagtgaatttgataagtataagtttgaaggaaatcaatcaatagaaaatgatggtttagttcttaatctaggagatgtaatgttagatgataagcaactaattataagtttaggtatagactatagcaattttgacttagaaaagcatgggtttaataaaaaggatttcaaaccagatttgccacttattacaataggggatatatctttccctggtcaaggtggaattattcatcaaagagatgtgagaggggaagataaaaaagagcttttatatatcgtttctttaactaatattgatactgatggcgatggtgtggtagactctgattttgatatacttaatgctcttgaaaaagataaagattataatataaaaattcaatttaaagattttgatatcggagagtcaaaaactgaaaaaggaagatggttaagtaaaagccttgggaattgggattttaatacaactataaatacttctaacatatcaaatgatgtaaaaatcattaaaattaacaaggttattgatataaatgaagaaggtataaaacataaattaaaaattgatgatataaggatatctccagtatcagcaaaaatcaaaatgaatgtagaggagaataactctgatagtacttattttttatcagcaaaagatgaaaatggaaatactttaagtagtgacaataatgctatgtctgatgatgaaaatacagtctatagtaattttgaacttaatggaactgaagaaaaaataataataacacctattatttattctaataataaagaaaagatttttgagagtgaaaaaatagaaatagatcttccttagaatctaagtaaatggattctaaggttacaatttttgatgaataagaaaaaactagtatcaaaaaactaataaatgcatataatgatatatgtagtaaaatacaaataatttaaaagagacctagagataggttataggagtatttttaatgataaatggaatagtaaaatggtttaacaatgaaaaaggatttggctttatatcagtagaaggtggagatgatgtattcgtacatttttcagctatacaaactgatgggtttaaatcattagaagaaggtcaacatgtaaactttaatatagttaaaggtgctagaggtcctcaagcagagaatgtaactatattataatatatatatgttcgagagaaagacacattgtgtgtcttttttttattctaattaattataataacctctaataaactaactagtaattaattttcaatttataaattactagatctctttaaacaaattttagttaatttttaattattaagttgatatatgaaatcttttaaactacactttatagcaaattattttaaggggtgtatctacttatgagtaaagagggaatgaataaagtattagaattttataattcagtatctgaaaaagggagacttgaaagagggcttggtattattgaatttcatagaacaaaacaaattttaagtaaatacataaacaaggattccaatgtaatatacgacattggtggaggtgttggagtttattctgattggttagcacgtaaaaataataatgttcatttactagaactctcaccaaatgctgtagagtatgctaaatcaaattataatacttttatttctgaagtatgtgatgccagagatattaataaagataatgaaagtgctgatattatattactcatgggacctttatatcatctacaaaatatagctgatcgattaaaagtattagatgaatgttatagagttttaaaaaaaggtgggcttttattttcagtaggtatatctaaatttagtacaacaacttgggcattatctacgtttggcactagaaatgagttactaacggaaaaaccatttatgaatatgatagaaatggaattgaaagaaggtattcatgatagaccacaagattatccatatttacttacacatgcttatttccatactccattacaactccaaaatgaaattgaaacagtaggatttaaaacattaaataaacatgccatagaggggactatatggtttaccccagatttaaataaaaaatgggaagatattgaaactagagatatattgttaaatatattagaaataacagaacatgaaatagaaataatgggaatgagtcctcactttatggttgtttctcaaaaataacaatatttaaaattttactttaaggactagttatgtaagataaaattaaagcccttaaaatccaaataaatggattctaagggcttttttactagacatctttaaaccagtttttaggtaattgtaattttaaaatacatatttattttttatataacatatctatatgtggtatattatcttctaaatatacatttgaaatttcattaaatcctagactcttataaaagttaagtaagtatgattgtgcttgaatttttatttcattttcatttaaattattttctataaaatctatagcttttatcatcatctctcttgaaattcctttaccacgataattcttattaactactactcttccgattgacacttcatcataagaaactcctttttctaaaattcttagatatgcaattatttctccatttttttgagcaaatagatgatatgagtttttatctttactatcacagtctagatatgcacactcttgctctacaataaacacctcatttcttaatgctaaaattttgtatacttcttcaacatttaattctttaaattttttaatgctccaattcatttgtttacctcctatttaattttaataataaatttaaataatgctaatttacccctaataaacataaaagcactgaatctcattcctccttaaaaaaggccctagtggaataagactcagtgctttttaacattcttacccggggataagaataagcatcatattatttagttattaaaataatatcataaaagtaatgtttatacaatattaataaaaagtttctaatttttactagagttctttaaaccagtttttaaaaactagttaattaacataaataattctagcgaattataaaatattccccctttaatatcttttctataagaaaggcaagattctcttgttctatattctctccctctcttatatacctagccacaatttcaactaaggcaccagacataaatgccattgcatattcatacatgtatttactatcagcatttaatgtatttcctatttcaataagatattgctcaaatttcagtgtcattatatatgttagattattattaacaagtaattttataaaatctttatcgctttcgatatatgttacaaattcaaaacatatatcgcttatcgtattgatcttctttctagtgaatctttctataaataagtcaaacattttatcaaaatgaagttccaatacttcttctttagagttgaaaagtgaataaaatgtttgtcgtgatacaagtgaatgttcacatatactttttattgttattgattcaaatgatttggtttccattatagaaagaatccctttaataatcatctcttgtgattgcagggctgtcggattatttcctttatacatagacataacctccttaaatgtctaacttatctcaataatattgacatatgtaaatgttattgagataatcatagcataacttagacatatgtcaatttttttaattattatggaggaagaacttatggagatgtttttaactcttattagtggtataggatggattattgtttatgaagaatgtattagattaggttttaaagaaaagacatatgcaatgcctttattcgcattaggactaaactttgcatgggaggctacttatagtttttcagatatatttctagctgctcatggtcctttagagggtctaaatttaattcaagcatatgtcaatgcgtcatgggcaattctagatatagttatattatttacctattttaaatatgggaaaaatgagtttcctaaatcaataaatcaaaaacatttccctgcatggattatattagttataatatgctgttttgctttacagtacgtattcataaaagaatttggatttataatgggagcaaaatactctgcttttttacaaaatttacttatgtcagtaatgtttataaatatgtatgtaaaaagggaaaatatgaatggacaatctttattactagcttatgctaagtggattggaacattagctccgactattctttttggaatattagactataatatacttgttttagtttgtggtattttttgttcagtatttgatattatctacattcatcttttaagtaaatataaaaaaacaaaactatataacgaaactcaaaatgatattcctattggatatagaggttaattatgatttattatttttcaggaacaggaaattcaaaatgggtagccaagcaaataggaaaagaaatatcagataaagttgtatctatttcagaaatgaataagaatggagaaatgccaaatgaagttaaagaaggggagatactagggattgtatttccatctcatatatccttagctcctaagccagtaatggagtttgtaaaaagaattaaggtagataaaaatgcttttgtatttgtagtttctacttgtggagattcatcaggatatgctgtaaaagttctacaaaagcatattaatatagatagtggatactctgtaattatgcctaataatcatattacaatgattggttcagatagtaatgaagttattagaaataaaataaaaaatgccaaaataaaaatttcatctatatgtgaagatataaaaaataggaagaaagaacttcaatatgatgaggggattgtatcaatgcttaaatcatatgtaattgcgcctattgtattatctaaattgaatgataaaaaattttatgtagaagattcttgtattggatgtaagttatgtgaaagagcttgtccagttcagaatatagaagttgccaagggatatccaatatggaaaaataattgtatacattgtatggcttgtattcagcattgtcctaaaaaagcaatccaatatggaaaatcaaccaagaatagaaaaagatttgttatgaaagataattttgatatatgaaataatatccaaactacacaagaaataaaaacaaactttttatgtacaattatctcaaatactctaacaagtcctaaaatttcactttagaggatagttaagcatttgaaataaagttaatgcccttaaaatccaaataaatggattttaagggcttttttactatgtatctttgaatatttttaaaccaaatataaaactctattagagtatatattatcataaatataagtgagactttctccactaatttttctcaattaaaattgataatataaaaatccatattaatattaatagtaccttaaaaggcaagtcaaaataatatttatttaaagatattccacttctataggtattatttattcaactctatttttatggctttatcttttaataattccacattatttacataagaaacagaaattttgcttatactttttattttttcctcattatgtttatatccatttaaatcaatagtttcagtatattttccagtttttctattaacgtatgtatcttttaatccacaaaaatctactttatttccatttttatcgaaatattctaagtaaatctcatggtctacaagtccttctttataataagtgtattctattttatcacctgttaccttgaaactgtctatctttatctttccaacttcacttgtcttaaatgttaaaggaagactatttatgctctttggttcagacattttatcttctgcaaaatgtatatattttatcggtataacttgtaaatattttgtattactatttgcacctataaactcaaatgagtttgttgcaattccagttttttcatctggaccataacttccattatctattttatttaaaattttccctttatcatccataagttcaaatccagctaaaagttcattttcttcatttgatttatttgaatcctttaattcactagtttgaagaagcatcttatttcctaatggagaaattataacttcttttatatcataattaatttctcctattgtaaattttttattaaccttataaatatggctatctatgttaattttagatttatctaaattagtagctacattccagttaccatctatatcaaaaatattatctatctttaattctaccttatcatttgcttttatatctataccactcatatcaaatctataaataccttctaatttattacttcctacatacttagactctgattctggattactgtatggattgacttcttttccatttatgtataaatcaataaatggctcagcaaataaaggattttcatctgccttataattttcttttatatttttatctgtttttatagtataaaatacagtcatacaactttcatcataagacatactgtttactttaaattctatacccttatctttaacaaataaatttaaactcttagaagttttctctagttcatgtttatcacctttaaacctagaatctttattgctatcaaaataatttactatatttttcactataggtatagagtctgctagtgaaggatttataacacccatcactccacctccaacaactaatgtggctattgatgcaaccattacatttttgtactttcttatattcttttgctttcttccttttgatatagcattcttagttatatcatctatattatctggcatttttatatcatcatatttactcattatgcttcctccctcagcaaatcatataactttttctttcctcgtcttatatatgactttactgtattttcattacaatccattattttagatatttgacttactgttaaatcctgaaaatattgtagtattataggtgttttatacttttcatctaatatatctattgcatcatataaatctattttttcctctatagttgaatattctatttcacctatataatcttctacttccacatctttaaacctatttacgtgtctatttttcatattcacattatttataagtattcttgttatccaagttttaaaataatttgaatctttaagtttatcgatatttaaatagcccttatacactgtttcttgataaatgtctaatgcatcgtgctcattttttgtataaataaatgccattttataaagatattctttatatatatttataagctcttcaaaagcttgatctgaaccttttttagcatcccttactaaatctatttcttctgttgatttattttttttactaaaaagcctcgctctttttagtactatattttctgtcatattgtcctccctataatcatgattacgcatattagattcagtaaatattcatttagttgcatatttttacaatttttttaatttatatttaaatatttaactacaaaaaactaaaaaagctatcctcaaatgtgagaataactttatattttcataaatctttttcttttaattaacttctaatatccgcatgatattatcttataatctccatctttattcttgactaaagtatattttaggtaatttatacctgacttgtcaggtttattatcaaataaatatttaactttatatttaacatccagagatttaccatttttaaaataaatatattttccatttttcaatctaccttcaacagttctaaatggaacttcttctgaatctatgtacttaatatatatcatatcataaggctcttcagcctcaccgtcaaaacctatataactgtaatcataaccatccattttaaatatacactcatttataagatctttatcttttgtattaattgcatttatatatacttccataacagatttggagtcttttttccaatctacaggtaaattttccttatcaaaacttttatattttaccttaaaaaatataaacccagctaaaaatataaaacatattaaaaaaaactttgttctatttttcataaaatacctctctcattattgtcctcctttactgccttttatattatagcaaatatataaatttactttttaaatttggagtaaactatgtaatttatggactaaactttatatattttacataaagttaaagcccttagaatctgaataaatggattttaagggcatacctttaaataagtttttaaggagtagttgcaattaatatataatttaagtaagtaaaaaaataaggaggtataaaatgacagaggaaatactgagactaaatctattacaaataaaaaaaaataattacgaagttaataataaaaacttatattattcatacgcattagatatgctaaaatacattggaacaactgatgcaacattacgtgatgatttaatttatgatattttctcaaaatggattaatcagaatatattttctgatgaacaaatgcaatcttttttaactatttgtatagatgaccaacatttaatgaaaagtattggtgctataaatgacgatacagttttcactcgtacattttctgcacttattattgccttaatactacactctaataatcaaaagagttttttacatcatcatgtaattattgaaacaacaaacatagtaattgattactatactaaagaaatggatttaagaggctatatagactataaaggttggtctcactcaatagcacatggagcagatgtaattgatgaattagcacaatgtagtattttggataaagagaatttagaaaatttactgattacattgcaattgaaaatatgtcagggtaagtatgtgtacattgatggtgaacctggacgtataagtattgcagtaaaaagtatcttaatgagaaatgaaattaatgataatgatataattttgtggttaaaaaggtttgaaaaacacacctctgagagtaattcgtcaatagaatactatcataaaaagattaatatctctaattttttaaagagtttatattttactttagaaggtgattttaaagattctatgataatggataaaattcacaatttaatcactactttaggagaataaagttatagaatctttcatagaaagggaagaagatatctgtagatgatcacaatatcccaaccaacactaaataaaaactaaaatctatataactttctacttccctaacataattatttcattttaattcctcctaattaatcattttaaaaacaattcttttgtatgattaaattcttctattgtatttgcagatattatttcatacttctctttatcatttattaaaaaaattgatttaaaatcattagataaaaaaattgtaaatacttttatatcatttttatcttcaaatgcatttccaaaatatacattatcttcagttatacctaagtttatattatatgttttttgacctatttttaatgttccttctaaagttttgaaagtacagtaatgtatgtagcttattgatactaatagatcgaggacttgaccaaaaagattatttgattcaataaatggtatgcagtttttagagtactaactctaactaaataaatattaatctattaaagattatgtggttattatagcaaagaggatacacctgttcccattccgaacacagaagttaagctctttagcgccgatggtacttggtgggaagctgcctgggagagtaggacgtagccgcgtaatcttttttatttaaaaatttttaagaaaatgtataaaaaaaaatactacaggatataatatatgtataaataaatactcaatctcccctattaaaaggtctctatcccccatagaggccttatttttttatattttaaaagtatgttaaatatgttgttaatagaagtttttatgtatagtatctaatgtataaggattatttatattaatatattaggaggtatttaaatgaaatactatggtacatatagacttgtaaagaacgaggatttaaatcatcatggaactttatttgcagggagaatgtcagaatggtttgtagaaagctgttttataacagttgccaatgaatataagcatccagaaaatttggtatgcttgaagattcatgaagttagttttaaaaaacctataagaaaaggcgagattataaaagtagaatctaaaataatttatgctggaaaaacaagtgtaacagtttacggtagagttaccagaagtggtagtgatgaagtaatcgtcgaaggctttttaacttttgtttgtgttgatgaaaatggagtaaagatgcctcataatttaactatagataatccatcaacaaaagaagatattgaacttttaaataaagtaaaaaattttagaaaataatataaaaaattaaaaataccactgcttaatgtagtggtatttttaatttaaataaaaaaatatttaaaacactctaaaaaagagaatattaatatagagtgataaaattgttaaagctatgatataattaatattatattatgaactaatgttcggttaggagaggatattgtggagtttaaaattcaatcggattataagcctacgggtgatcaaccagaggctatagataaaattgttaaggctataaataatgatgaaaagtttaatactttactaggggttacaggttctggaaaaacatttacaatggctaatattatacagcaagttaaaaaacctacattaataattgctcataataaaactttagcagctcaactttacagtgagttcaaagaattctttccagaaaatgcagtagagtattttgtaagttattatgattattaccagccagaagcttatgttgcacacagtgatacatatatagaaaaggatgctagtataaatgatgaaatagataaattaagacactctgctactgccgctatattagaaagaagagattgtattattatatcttctgtgtcatgtatatatggtttaggggatccacaagattataaggagcttatggtttctttaagaccaggtatggaaaaagatagggacgatattataaaacgattaatagagatacaatatgaaagaaatgatgttaactttactcgtggaacctttagagttagaggagatattttagaaatatttccagcaaatactgatgaaagggctattagaatagaatttttcggtgatgaaatagacagaataacagaaatagattatctaacaggcaagatagttgggcttagaaatcatgtagtgatattccctgcatcccactatgttacaactcaagaaagaatagataaagctattatagatatacaagaagagttaaaagaaagaatagattattttaaagataatgataaattaatagaagcacaaagaatagatcaaagaactagatatgatatagaaatgttaaaagagataggtttttgccaaggaatagaaaactactctagacatataacaggaagaaaagctggagataagccatatacactaatggatttctttccagatgattatttaatcataatagatgaatctcatgtaactgttcctcaaatcagaggaatgtacgctggagatagatcaagaaaaacatctcttattgataatggatttagattaccatcagcttatgataatagacctttaaactttagtgaatttgaagaaaatataaatcagatattatttgtaacagcaactccaggtccttatgaaatagaacattcaactactatagctgagcaaattataagacctactggattgctagacccaattattgaagtcagaccaataaataatcaaatagatgacttggtaggagaaataaataatgttattgaaaaaggtgaaagagttcttataaccactttaactaagaaaatgagtgaagatttaagtgattaccttaaagagataggtattaaagtcaaatatctgcactctgatattgatactctagaaagggtagagataataagggatttaagattaggtaaatttgatgttttagtgggtataaacttactaagggaagggttagatattcctgaagtttcattagttgctatattagatgcagataaagaaggattcttaagatcagaaacatcacttatacaaactataggtagagcagcaagaaatgcaaatggaaaagttataatgtatgcagataaaataactagatctatgcaaagtgctatagatgaaacaaagagaagaagagaaatacaaatgcattataatgaagagcatggtatagttccaaagactatcaaaaaaggaataagaaatgcaatagaagctacgatagttgctgatgaagaagctatatatggagatataaatgaaaatgatgaaagtagcataaaagaatctatagaaaatcttcaagctgagatgatggaagctgctcaaaatcttcaatttgaaagagcagcacagttaagagataagataaaagaattagaagaaaaattaaaataaattaaaagacttaattgatataattttcattatgaaaggaacatagctatgaatgataaaattataataaaaggagctaaagaacataacttaaaaaatgtagatttaactctgccaagagataaatttatagtttttactggactttcaggatctggaaagtcatctttagcttttgatactatatatgcagaaggtcaaagaagatatgttgaaagtttatctgcatatgcaagacaattcttaggacaaatggaaaaacctaatgtagagtatatagaaggtttatcaccagctatatcaatagatcaaaaaacaacatcaaaaaatccacgttctacagtaggtacagtaactgaaatatatgattatttaagattattatttgcaagagtaggagaagtacattgtcctacatgtggtaaaaagataagtcaaatgactatacaagaaatagtagataaaatgatggagtttcctgaaagaactaagttacaaatactatctcctgtagtaagaggtcaaaaggggactcataaaaaagttatagagaatattaaaaaagaaggttttgtaagagttagagtagatggagaaaattacgaagtaacagatgaaatagatttaaataaaaatcaaaaacataatatagaggtcgtagtagatagaatagtaataaaagatggtatagaaaacagattagcagattctattgaaactgcagttaagttgtctgatggattagttatagctcaaattatagacggagaagaaattatgtattcaactaaatttgcttgtccagaacacggtataggtatagaagaattatcacctagaatgttctcatttaacagtccatttggagcttgtgaaacatgtaatggattaggagaaagtaaggaagtagatccagatcttgtaattccaaataaagagctatctataaagcaaggagctattgcagcttggggatcagtaggtacaaatgatgatacttattatagtaaaatggtaaaaagtttagcagaaaaatttaaagtagatttatctactccatttaaagatttaccggaagattttgtacaagaattactttatggacatgataatgtaatggttgaatttgtatatgaatccaagtacggtggaactcgattatacaaggcaccatttgaaggagtaatagtaaatttagaaagaagatatagagaaacaaattcagaatactcaagagaaaagatagaagactttatggcagaaagaccttgtcctaaatgtaggggtaatagattaagaaaagaagttctttctgtattagtagataataaaaatataatggaggtaacagattactctgttaatgaacttatagattatattgaaaatataaacttaacagataagcaaaagtttatagcccatgaaatactaaaagagataaaaggtagagcatcattcttaagagatgttggactagattatttaaacttgtctagaaaagcaggaactttatcaggaggagaagctcaacgtatcaggttagctactcaaataggttctgcacttgtaggagttttatatgtattagatgagccaagtataggacttcaccaaagagacaatgatagattaattaaaacgttaagacatttaactgatataggaaatactcttatagttgttgaacatgatgaggatactatgagagaagctgattatattgtagatatagggccaggagctggagttcatggtggagaaatagttgcagaaggaattttagacgaaatacttagaaatcctaattcattaacaggtcagtatttaagtggaaaaaaagttatacaaattccagagactacaagagaaggtaatggtaattttatagaaatagtaaaggctacagagaacaatttaaaaaatataaatgttaaattcccattaggaaaatttacttgtataactggggtatctggatcaggaaagagtactttaataaatgacattttatataaagggatagcaactaaaataaataagttaagagatagaccaggtaaacataaagaaattaaaggtatagagaatatagataaaataataaacatagatcaaagtccaataggaagaacaccacgttcaaatcctgcaacatatactggagtatttgatttaataagagatttatttgcatctacaaatgaagctaaagctagaggatatcaaaaaggaagatttagctttaatgttaaaggaggtagatgtgaagcttgtaaaggtgatggaataataaaaatagagatgcattttcttccagatgtttatgtaccttgtgaagtatgtaaaggagaaagatacaatagagagactttacaagttaagtacaaggacaagacgatatcagacgtattagatatgaatgttgaagaagctcttacattctttgaaaatataccagcaataaaaagaaaattagaaactcttatggatgttggactttcttatattaaattaggacaaccttcaactcaattatcaggaggagaagctcaaagaataaaacttgcatcagaactaagtaaaagacctacaggtaaaactttatatatactagatgaacctactacaggacttcatatggctgatgtagataaattaataaatgttttacaaagattagcagatactggcaacactatagttgtaatagaacataatttagatgtaataaaaacttgtgactatataatagaccttggaccagaaggtggagataagggcggaaagatagtagcaactggaacacctaaagaagtatctaaggtggatgggtcatatacaggattattcctaaagaaatattttgaatagaaagtattacacaagaaaaatgaggttgacgtaggacagcctcattttttatttaatttatttacttgtagcttctttttgagataattctttttcatattgagcaaattctggttcagaaccgaatataaaatgaccaggtcttatttctaaccacttaggttgatgctcagaataatcatgtatgctagggtcgtattttatacgaactctatgtctttcatgttctgggtcaggaagtggtatagctgataataatgattttgtgtatggatgaagagggttagcatataactcctcagaagtagttaattcaactaatttaccacgatgcataactcctatacgatcacttatatatttaaccattgaaaggtcatgagctataaataagtatgttaatcctttttctttttgtaattttctaagtaaatttacaacctgtgcttgtatagaaacatcaagtgcagatataggttcatctgcgattataaatttaggttgtatagctaatgaacgagctataccaatacgttgtctttgacctccagagaattcatgaggatatcttcctgcatgttgttcatcaagtccaacagttcttaagagtttatatacagtttgtgttctttcttctttatttttacaaagaccatgtatatcaagaccttcagctattatatccattacagtcatacgtggattaagacaagccataggatcttggaatatcatttgcatatttttatttacaaatgctttagtatctttatctaatttcttagctgaaatatttttaccatcaaacactatttcacctgctgttgggtcatataatctaattattgctctaccagtagtagatttaccagatccagattcaccaacaagaccaaaagtttcaccttcataaatatggaaacttatatcatcaacggctttaacaacattttttttatcgatagggaagtattgtttaagatttttaacttccaatatttttttcttagtcatttgaagacaccttctttcttcctatgtttgcaggtctttctaatttaggagctaatggatgtaataaccatgtagcagcagagtgagtatcactgactttaaacataggaggctctgcaataaaatctattttaagtgcattaacgttacgtagtgcgaatgcatctccagcaggaggattcattaaatctggaggcgtaccaggtatattatacaattcattttcacctatatctaaactaggcatagaagctagaagtccccaagtatatgggtgttgtgggttgtaaaaaacatcgtcagatgtaccaacctctattattttacccgcatacataacagcaactctatctgccatattagcaacaacaccaaggtcatgagttataaatataacagcaactccagttttcttttgaatatcctttattaactctaatatttgcgcttgtatagtaacatcaagtgcagtagttggctcatctgctataagcactttaggattacaagctagtgctatagcgataactatacgttgtctcatacctcctgagaattgatgaggatattgttttgctcttttatctgggaaaggtataccaacaaggtctataagttctatagcttttttcatggcttcatctttagataatccttggtgttttattattccttctgcaatttgtttaccaattgtagtagtagggttaagtgaagtcataggatcttggaatatcatagcgatatctttgcctcttatagattccatttccttttctggtaatttagttaaatcttttccgttaaataatatttcaccatcttttataatagcatttgaagacattattctcataatagttttacaagcaactgatttaccagatccagattcaccaactatagcaagagtttcacctttatgcaaatcaaatgtaacatttcttacagcttgaacttcacccccgaaagttttgaagtgaactttcaaattcttaacttctaataatttctctttttccataaaatttatcccctttctaactattgattacgcattttagggtcaactgcatcccttaatccatctgcaagtaagtttaagctaaatattaataaacaaattacgattgatggaataaccatcatataaggatttgttagtaattgcttaaatccatcatttattaatacacctaatgatgcatatggaggttgtagacctaatcctataaaactaaggaatgcttcatagaatatagcagatggtaatgagaacatcatcataacaactacaggacctattatattagggaataaatgtttaattattatttttttatcaggagctcctaatgttctagaagctaaaacgaattcttgatttttaagtctaagtacgtgagaacgtactattctagacattccagtccatccagatatagccatagcaagagacatagataatactcctggttcgaatactaatataaataatgttaaagtaacaagacttggaatacctgttagtatttctataaaacgttgcatatacatatctactttaccaccataataagcagaaacaccaccgtaagtaacacctatcaaaaggtcatataaagcagcaagtacagctataaataaagaaactctagctccactccaagtacgagtccataagtcacgacctaaatcatctgtaccaaaccaatagttgacatcatctgcaacaccttttttctcatatgaatttacttttgtaactttaccatcataactagtttcatttttagttccatctaatattcctagagaagataaaactggaactctaggaggaagtttagcatgacttaaattttgttgatcataagtatatttattaaacataggaccaaatgctgtaagaaaacatattattaaaaggataaataatcctgtaatagcacctttatttctaaataatctttttctagcatcctgccaaaatgttaaactaggtctagttatagcttcatgttgagtcatatcagctggactaatttcgaataaatcgtcagtaagttgaacttctttgccgtcaattataactttatccatcattaagctttcccccccgcaacacgaattctaggatctataattccataaagtatatcaactagtaaaattacagctatataacaagcactatagaatatagaaactcctgatatacagaataagtcattagttgttatagatgacactaacaaatctccaagacctggaactgcaaatactttttcaacaactaaagatccagtaagtaatccaactgtcaaaggtccaagcatagttataacaggtattaaagcatttcttaaagcatgttttattattacagctgctttagtcaatcccttagattttgcagtaactatataatctgcatttaaaacttcaacaagttcagttctagtaaaacgtgctatatttgctatagagaaaactgctaatgctatagatggtaatactgtccaagaatatctaaaatctgaaccgataggcataccccatgtaactgggaaaatctgaaattttcgtgttaaatataattgaagaagtgctgctaaaacaaatgatggaactgaaactcctaaaacagatattactgtagccaagtaatcccagaatgtatttttcttaagtgctgctactattccaagtattaagccaacaacacttccgataactagagcttgagctcctaacatagctgaaggttttaaacgagtacttattaaatcttcaacttttttgttatcatacttaaaagatcttcctaaatctcctgtaaatacacctttcatatatcttacatattgaactggaactggtgcatcaagaccgtattgtttgttaatcatttcaatttgttgttcatttagtttttcgtcattaaatggacttccaggtaataaccttaccaagaaaaatgtaactgaaacaacgattagtagagtcatgaacataagagcaagacgttttaatatatagcgacccatcgctacacccccttgaataaaatagtattatttaaaaataaattctgataaatataaaaatataccagaattttgaaaacaagattaaaaaatatatatataaatatttatatatattttttatttaaaatattattaataaattaaaaaacttatgaataaagtactggcagatatgattagaccagatgataaaagtgaactagtattagaaaattgatatcgtttacaaatatattcatctatagagatattgctttcagataaaatacctctgcttcttcggagttgattagaaattttattatatgcatagattgttaaattaaaaaaaccttgttcggttacataaaagaatacaccaaaggttaaataagtcattccaattatgaaagatgcatttataaaagaaaatctttcaaaactattgatagcataatatgaaaagctaagtattaaatttatgaaaatcaacttttggaattttttcaaattaagaatccctcctatcctaaatacaatttactagattatacaagttaggtttaatataatattaatacggtttttgtgaaaaaacaatcatttatataaaaaatttataatatttaaaaaatttaattagaggaatttaaatgcaaaagtttaaatataattattatatatatatcagaaaaaatgaaacttaaattaaaaaataaatcaaaagaataaaaattaaaaaaatactgacttttactaaagactatcctataatctgaattaatacaattaaatgatagaaattaaataaataagggggaaatattatggttttaaagaaaaaaatggctgtgatgtgtgcaacatcagcaatagctgttatggctttggttggctgtagtagcacaggcggaggagatacatctgggggaggaaataaaactggaaaaggagaagctaaggctttagacgtacttgcgaatgaaaatgcaagagctgctatagcaatgtctgtagatagacaagcaatgtgtgatactatattaaataatggaacaatacctgtatcatattatgtagcagaaaaattagcatttaatgaatctggtaaagactatagagaagtagcaggttctatgggttatgagcataatgatgaggaagcaactaaaaaatgggaaaaggcaaaagaagaagttggttttgatacagttacactagaattattaacatttgatagtgaaagtagtaaaagaacagcagaatttatgcaatcagaattacaaggagcacttccaggattgaaagtagaaataaaaacacaaccattcaaacaaaaattagaattagagagtaaaggtgatttccacttatcatatgcatcatggaaccctgattacccagatccattaacattcttagaaacaatgcaaaaaggaatacaatatgctaaaaatacaaactacaatagtgaagaatataacaagcttatagaagaagctaaaactgcagagaatcaagaagaaagctgggctaaatatgcagaagctgaaaaaatgatgttagaagatggatatttagtaccactagttcaacaaggttcttcatttttagaaaaaacatatgtaagtggaagacttactccatcatttggtgtcccagctatatacaattgggttgaattaaaagaaggtaaaaaagaacttaatataacaaatacttcagatatacctactttagatatcagtaaggctgaagatactgtatcttcagaagtgttgatgaacactatggaaggtttggttaaattagataaaaatggagaaatgattccaggaatagctgaaaaatgggaaaaatcagaagacggaaaaacatggactttcaatttaagaaaaaatgctaaatggtcaaatggagaccctgtgacagctaaagattttgaatactcatggaaaagaacattagatccagcgacagcatcaacatatggatttattatgtatgatataaaaggagctaaagattataacttaggtaaagttgataatgcagataatgtaggcataaaagcaatagatgattatacattacaagttgaattagtaagaccagtacattattttgatagattaatgttctttaaatcattcttaccacaaaatcaaaaagtagtagaaaaatttggaggtgaatatggaacatcacatgataaagttgtttataatggaccatttacattaagtaactggaaaatagaagatatgtttacactaagtaaaaaccctaattactgggataaaggttcagttaaaatagataaagtgaatacaaaaatagttaaagacccaaatgcagctcttaacttatatgaaacaggacaaatagatatagtacaactaacttctgaaaatgttgataaatataaggattcttctgaatttaaaacaacattaaaggcatcggtaaacttcttccaaataaatggaggaagagcagaaactaaataatataatttagaatatttaacaggtttatactagaaatttatagtgtaaatctgttttttgtttttggaatttaaataatcaatttttaaaaaatttgaaaaattagaaaaatacaagcatcaaggacaaatcatagtgcatataataaaaaaacgtatattattattctaatattattgcttagtaaatttagttatttaagggggagtaatttatggttttaaaaaagaaaatggctttaatgactacaactgtggcaataactataatgacaatggttgggtgtggaaatagtggatcaagttcaggagggactaatggggatccttacaaggttcttgcaaataaaaatgctagagcagctatatcaatggctatagataaaaaaacaatgtgcgatactataataaacaatggaactattccagcagattatatagtagctgaaagtttagcgtttaatgaacaaggaaaggattatagagaagtagctggagaaatgggataccattacaataaagaagaagctacaaaattatgggaaaaagctaaaaaagaagttggatttgatacagttacattggaattattatcatttgattctgaaaccggtaaaagacaagcagaatttatgcaagcagaacttcaaactgcattaccaggattaaaagtagaagtaaaatcgcaaccatttaagcaaaagatagcattagaagaaaaaggggatttccatttatctcattcaggatggtcaccagattatccagatccattaacatttttagaaactatgcaaacaggcgtaaaatatgctgcaaatactgggtatagtaatccagaatacgataatcttatagaagaagctaaaactgcatctagtcaagaagaaagttgggagaaatttgctaaagctgaaaaaataatgttagaagatggattcttatcacctcttattcaatcaggagcttcatatttacaaaaaccatacgtaagtggaagacttactccagcgtttggagttccatatatatataactgggtagaacttggggaaggtaaaaaagagttaaatattacaggagcatcagatataccaactttagatccaagtaaagcatcagatacagtttcatcagaagtattaatgaatactatggaaggcttaactaagttagataaagatggtaaacttgctccaggaatagcagaaaaatgggagaaatctgaagatggaaagacttggactttcaatttaagaaaagacgctaaatggtcaaatggagattctgtaacagctaaagattttgaatactcatggaaaagaacactagatccagcaacagcatcaacatatggatttattatgtatgatataaaaggagctaaggattataatttaggtaaagtagataatgcagataatgtaggaataaaagcaatagatgaccatacattacaagttgaattagtaagaccagtacactattttgacagtttaatgttctttaaatcattcttaccacaaaatcaaaaagcagtagaacaatttggaagcgaatatggtacagcacatgataagatggtttacaatggaccattcactttaagtgattggaagatagaagatgtatatacaatgagtaaaaatcctaattattgggatgcaagctcagttaaaatagataaagtaaatactaagatagttaaagatccaaatgcagcacttaatttatatgaaacagaacaaatagatatagtaggattgaattcggaaaatgttgataagtataaagattctccagagtttaatacaagaaaagatgcaggaacatttttcttaatgcttaatggtggaaaaggtaaatagttaaaaaagtaaaagaaatgatgcttatgtaagtatcatttcttttactttttttaatttattaaagattaaactagggtataatttatatatatatatttaaaatatcgaggtgaaagaatgtttgatattcaagaacaattaaaaaaactcccagcagaacctggagtttatttaatgaaagatgaaaatgataaagttatatatgtaggtaaagccatatctttaaaaaatagagttagacagtattttcaatcgtcaaaaaatcatacatctaaagttaaatcaatggttaaaaacatatataaatttgaatatataataactgattcagaattagaagcattgatattagaatgtaatttaataaaacaatacagacctaaatacaatgtattacttagagatgataagacttatccatatataaaggtaacattaaatgaagattatccaagagtcttaaaagtaagacaagtaataaaagataaagctaagtattttgggccatatacaaatacaacagcagtaaatgatacattagaaataataagaaatatttacccaattagaacttgtaatatagatatagaaaaagctataaaaaacaaggtaagaccatgtttaaataagcatattaaaaaatgtgtaggaccgtgtactggagaagttagtaaagaagattacgggaagatgatagaggaaataatcttatttctttcaggaaaagaagaaaaattaatagaacttttaaaagaaaagatgaataaatgtgctgcagattttaattttgaagatgcagctatgtatagagataaaattaaaagtttagaagatatgattcaaaaacaaaaaatagatttaggtagttcggatttaaatcaagatgttattgcaatggcgagggctcatgatgaagcttgtgtacaagtattttttataagaaatggaaagatagttggaagagaacattacatactagaaggagtaatggacagttcacgagagtcaattttatcatcatttataaaacaattttatatgtcacaagattatatacctaaggaaatcatcatagaagatgaagtagaagatagttttgtacttgaagagtggttatcatctaaaaaaggccaaaaggttattataaaagttcctcaaaaaggtgaaaaaaagagtttagtagaaatggttagaaaaaatgctgttgaatatcttgagaagttttctaatatgaacaagctaaaatatcaaaaaagtataggtgctttagaagagttaaaaactttaataggtttagaaaatatacctaaaagaattgagtctttcgatatttcaaatattcaaggtgttgactctataggttcaatggtagtttttacagatgggaaaaaggataaaaaagagtatagaagatataaaataaaaactgttgttgggcctaatgattatgattcaatggcagaaatagtggaaagaaggctaaaatatggagatttaccagatttaatattattagatgggggaaaaggtcaggtaagctcagtaaaaaaagttttagataagtataatgtcaatattcctctatgggggatgtataaagatgataaacataaaacaaagggattaatttcccaggaaaaggagatagaactcgataaaacatccaatttgtatagatttgtggctagtatacaagaagaagttcataattatgcaatttcatatcatagaagtttaagaaataaatctttgacaaaatctgtattagatgatatacaaggagtaggtgagaaaagaaagaaagcattattaactcactttaaaaatatagaagaaataaagacagctacttttgaagaattattagaagttgaaggaatgaacaaaacttcagctgaaaatgtatataatttttttaaatcataattaatatttataaaggagtaaaagacattatggatagtgaaagaagtgaaaggtcagtttcaattagagaattagttaaagacataggattagatgtagtttatatgcctgatgatgttgagtattacgtgcattatcaagatattcatagaccagggttacaatttgcaggatattttgaacattttacttacgatagaattcagattgtaggtagaaccgaatacacttactttagccatatggattcagaaataagaaaaactgtattagataaattttttagctatgaagttccagcactaatagtatctagaggccttacggttaatgaagatgttattgaaatggctaaaaaacataatagagtagtattggcaacaaaaagaaatacaacaagattaataaacaaattgtctaattacttagattctaaactgtcacctacaattagtatacatggagttttagtagatgtatttggagtaggtgttttaataagaggggaaagtagtgtaggtaaatcagaaacagctcttgaacttgttcaacgaggtcatagattaatagcagatgatgctgttgaaataactaaaattgatgaaaatttacttatggggcaagctcctgaagttttaaaacattttatggagataagaggtataggaataatagatgttagaagtatgtatggtataggagctgttaaagattctaaggttatagatttaataataagactagagtcttggaatgataacacttactatgatagattaggtctagataaagaatatgaagaaatacttggaatagatgtagaaaagttggtagttccagtgaagccaggaagaaatacagctatgattttagaagtcgcagctatgaactttagacaaaaacgaatgggttatgattctgctaaggaatttacaaaaaaattagctacattaatagataaaaataataattaaaaaggtgtgacaaacattgtcacacctttttaattattcagtagcttctgctaaattttcttcgcactcaaagaaattacttctgtcaaaataataagtatgaagatatctgtgagctaagtcgccataaggttcacccaaaaattcattatataggttatttacagaagagtttttatgaggtttacgtacttctgaatgtttatcaatatgataaagagcattagcacgagcttttattttatcataatccccatagtggtaaggctgacctccaccagctacacaacctcctggacaggccataacttcaattatatgataattagattttcctgatttgacttcatccattactttttgagcatttcctaatccattaacagcacaggcattgataattgtgccacctatatttactttaaattcttttattccatcaatacctctaactgttttaaaatcaatgttttctaaattttcattagtaagccattcataagatgtacgaagagcagcttctaaaacaccaccagtagcaccgaatatattagcggcaccagttgattctcccattggattatcaaaaggttcatcatctaaattaagaaaatctatacctgcttgcttaatcattttagctagttctctagtagttatagatacatcaacatctaagaaatcatcatttcctaattcttctctagatatctcatattttttagctatacaaggcatgatggaaacaacagtaatatcttttggtgttattccaatttttgaagaaaagtaattttttgctatggaaccaaacatattttgaggagatttacagctagaaactaagtttaatagagtaggatagtgatgttctatataatttacccaagctggacaacaactagttaaaattggtaagtttttgccttcttttaatctatgaataaactcagaagcttcttcaaggatagttatgtcagctgcaaagttagtatcaaatacatatttaaaacctaataatttaagagcagctacaatctttccagtcgtaattgcgcctgggcttaatccaaattcttcacccaaagcaactctaacagcaggggcaacttgaacgacaactgttttatcagttttgttaagttcatcccaaaccaattctgtattattaacttctgttaatgctccagtagggcatactgctacacattgaccgcagaaagtacagttagttttagaaatatcttcattaaaaaaagtagataccattgtttcaaaaccacgattaacaccagacaaaactcctactttttgtatttctgtgcacattgtttcacatcttctgcaaagtatgcacttattatggtctttaattatagacttacttgaagtgtctatacctaaatctgattttacacctttgtaagttacttctcttactcctaaatcttgagctataatttgaagttcacaattaccatttttctcgcaaacaaggcagtcttgagggtgatctgatagcaaaagttcaactactgttttacgagcattcagagcacgaggtgtattagtttgaacttccataccttcacgcacattcgttgcacaagccggaactaaccctttttttgtatcaaccatacatatacggcaagatgcacatttattattcatatttatttcgtccatatgaaggtgacaaagtgttggaattttaatatttagttttttagcagcatcaaggattgtagtttcgctcttaacagatactgctttaccgtttatagttaaattaactaaactcattgattatcccccttatttcttaattattgcattaaacttacagttatccatacaagcaccacattttaaacacttagttgtatcgatttcatgtttttctttaacatttccagatatacatcctgcagggcaaattctagaacattttgtacaacctatacaattatctgttataacaaagtttaatagtgcctgacatttaccagaaggacattttttatcaataacatgagctttatattcatcataaaaataattaagtgtacttaaaactgggttaggtgctgatttacctagaccacacaaagaggtagtagctatggttttagaaagattttctaagtctaataaatcttgttcacaacctttgccatctgttatttttgttagtatttcaagcaaacgtttatttcctatacgacaaggagtacatttaccacatgactcttcaactgtaaattctaagaagaatttagctatatctaccatacaatctgtttcatctaaaacaagcataccacctgaacccatcatagaaccaagattacttaaattatcaaaatctataggcgtatcaagataatctataggaacacatccaccagatggacctccagttaaaacagctttaaattttttgttatctggaatacctccacctatgttataaacaatatcttttaatgtagtccccataggtatttcaacaagaccaacattattaatttttccacctaatgcaaagactttagtacctgatgaattttcagttccaatatttttataccattgaccaccattttctattattggaggtatatttgcgaaagtttcaacattgtttgagcatgtaggtacatcccaaagaccttttttagttgagctataagttttcatacgaggttcaccacgattaccttctattgaacgcattagagcggtaccttcaccacaaacaaaagccccagcaccatatttaagttctattttaaaattaaatccagtacctaatatattttcacctaataatcctagtttttcagcttgactaatagctaaatttaatctttctatagcaagaggatattcagctcttatgtaaatataaccagtatctgcgccaacagcatatccacaaatggccattgcctcaagtactttatgaggacatccttcaagtatggatctatccataaatgcacctgggtcaccttcatcggcattacaaacaacatatttttgattagattttgattttctagtagcttcccactttatacctgtagggaatcctgcaccacctctacctcttaatcctgaaagtttaacttcttcaatgacttcctcaggagaaagttcagttagacatttaccaagattagcataaccattattagctatataatcttcaactttctcaggattcatgtaaccacacttatgaagagctatacgcatttgttgtttataaaatgacatatcttctagtttagaaactttttttctttcagaggcttctaaaaataataatctataaactaaattaccattaactaaatgttcttgcacaatttcttttgcatcatcagctgatacttttatataaaaaatatcatcaggacaaactctaactattggtccttgagcacaaaatccaaaacatcctgttagagaaacagatacagaatcttcaagtcctgcatttttaatttcttttttaaaattatcgattataggtaaactatttgcagctctacatccagtgtctccgcaaactaacaattcttttttgtttttttcttggcaattattgtctcttaaatataggtttggttttaatttgttaattagatatttaagctcgccaaatgatcttattttattcatatattcccccccttttatattaacaagtaacttctatttggttatattcatctaggatatcttttacttggtcaactgtaacttgtccatagacttttccatttacaacaactactggagctaaaccacaagccccaacacatcttaaaccttcaagagaatatttaagatcaggtgttgtttccccagattttatacctaattgcttttcaaactcagcaaggattttatcggcacctttgacaaaacatacagttcctaaacaaacacttattttatatttacctttttgttcagtagtaaagtaagaatagaagcttacaactccgtaaactttagcaggtgaaacatctaatttttttgagatatgaagctgaacttctttaggtaagtagccaaataaaccttgagcatgatgtaggacttgaattaatgctccctttttagttggaagagcatcaataaattcatctaattcttcaaacaacttgttattacattgagaacaattacacatatacaacctccttatattaaatataaaattttataatctattatttattatatttatcatcttattaatattataacttatttattttaaatatttttgaaagtttactaaattttcaaaaaataaaatattaacatttataaaaaaacttaaaaaaatacctcaaataatatttttattacttgaggtattttaaaaataatttataaaacaggtgataaaagccttgatatagactctttaaattttattatttgaggtctattatcatatatttcttgagtaacttgaatacatttttcgatatcaacttcaaaaatttctttttgttttatggctatatcaggacagtacataaacgcatttacttcaaagttaagctcaaaactacgtatatccatattagcagtacctattgaacaaatagaatcatccataactactgttttagaatgtaaaaaggcatttttatcataagtataaatcttggcaccaaactttaaaagttctcctgcatatgaatatgaagcccaataaacgaaaggatgatcaggtttagatggaatcataattctaacatctactcctgacaaacaagctattttaagagcatcaagtagtgaactatctaatataagatatggtgattgaatatatatgtattttctagatttttgaatcattttaagatatccatattttatttcatctatctctgataagtcaggtccactagatacaatttgaataccggtatttccattataaggatttatatcgtcgtttagatattttgtaaagttaatatcttcacgagttgtatatctccaatccatcataaatctaaggtttaagtcattaacagcagatcctataattttagtatgagtatctctccaataaccaaatttaggatctttacctaaatattcatccccgacattaaatcctccgacaaatccaacttcaccatctattacaacaattttacgatgatttctataatttaagttgaaatttataatttttaaaaatgaagggaagaaagctccaatttttccgcctgcttttttaaacctgtgaattcctttttcagatagtagtctacttccaactgtatcatataaaagtctaacctctacaccttcagagattttattaataagaatgtctaaaatttcattaccaatttcgtcatctttgaaaatataaaattcaatatgaatatattttttagctttttttagttgtaatttaagctcatcaaaaaactcattaccatcagtataaatggaaactttgttatttgtagtatatggtgagctatttaaagtagctaaagaataaatcatatccttatgttcaactatactaggttcaaatttttcggagtattgtaagaaatcactagaatctaacattctactttttagtttttcatcttcttctttctttaatttaaacatattgtatttgttcatacgtctaccaaatactatgtataaaacaaatcctgcagcaggaactattgttagtattaaaatccatgcaactgtagaatctatacttcttcgttctctgaatataagatttaacataactaaaaagttaattatatatatagcagttactgcaaattgatatgaaaaaatttcagataaaatattagtcgccccctcgcaaatatattttaatcaattgaataattatatttattataacaaaaagggatatatttctctatataaaaacccccttattaaaaataagagggtttaatctattttatatttaattaattatttttcatttttactcataaataagaagtaataagaacctgctattatcataccacctaatatattacctatagtaacaggtaaaaagttgtgtaataatatatttcctatatttaagttagaaacatcagctaaagttttatgagcagcttctaaatacattggatttaatttaaccattaaaccagctaataagtatcccatatttgcaacaacgtgttcaactccgatacatacgaatacgaatatacctaaccaacccatgattacttttcctgaaacatttttagcagcatatgatgcccatacagtagcacaaactaataagttacatactacacctgaagccacagcagccacaaatcctatatttgttttaccgacagcattttttataacaactccaccgtataaaccattactccaatcaaatacaccagagttagcaactaaagcagccgcaaatgctgcacctattaagtttcctatccaaactaaggcccagtttttaccagcttgtccccaagaaacttttttcttaagagctgctaaagttataagtatgttacttgtaaataaatctccacctgcaattaagataagtacaagaccagcagggaacataagtccagctaccatttttcctaatccgtaagtagcagggttagctaataaattataagatgctgcaatagaacctaaagcacctaaagctatatacattccagctaagaatgcagatactaaaacttttttagttggagtagttgcttttttgatacctgcatttaatgtgtactcagctacttcagcaggcgtaagcatttttttgtcactcatttataattcctcccgtaaaataatatacaatttagtcaaaaatttatcatttatatacaccgttaataagtatacaacaaaatatacattttgtatacaaaaaacgacatacaaaaaacatactattttaattactcaaaaaatcaaactaagtaaacgtattctaatggatttgagtcaattaatttaatttagattcatataattaagtaaaaatagttgggaggaaataacatgtatacaaactttcttacacctgtagagataactaaggctactatagagtccgggataaaaaaagctcacttatctacaaagaaaatgatacttcttgggattttagcaggattatttataggattaggagggctaggaaatatattaataagtcaaaccgtatcagatattggcttatctaaatttgctggtgcttgtgtatttccagtaggacttatgttagttgttgtttgtggagcagagttatttacaggtaataatcttatgacaatagcccttatggataaaaaaattaaaattaagcagatgttaagaaattggggatttgtgtatttggctaattttataggagctattattcttgtaatttttatttattttagtggaattttaactcaagatgcagctattaaggctattaatcttgcagaaagtaaagcatcattagactttattcaagcttttatgagaggtataatgtgtaatattcttgttgttttagcagtgtggtttgcaacatctggcaaagacataatttctaagatatttgcatgttggtttcctattatgctatttgtactatgtggttttgaacatagtatagcaaatatgttttttattcctatgggaatgtttttaggtgctgatataaatatttgtcaattagtatttaatttggttactgttacacttggaaatatagttggaggtgcaatattaataccttatatatattacaattgttatgcaagaaaagagaaaatcaattaaatatataataaaatggacgttgatagttatatcaacgttttttagcttttttttcaaggtgtttgtatattgttattttggttttaatacattattatagtatatgtataattttaaagtaaataaataatttataaagtgaataaatgacatgaattaggaggaaatataatggataagaaatttatatataaaagtttattagatatattagataaagaagaaatttttttagatgagcctatgaaaaatcatatatcatttaaagttggagggcctgctgattttttggttaaacctaaaaatgaagaacaaataaaaaaattagtaactttattaaaggaagaaaacataccttatataatagttggtaatggatcaaatcttttagttaaagatggagggattagaggggtagttataaaaatagctgataactttaatcattttgaggtaaaagatacaactgtatttgcacaatctggagcgttactttcttttatgggaaaggcagtattaaataataatttaactggatttgaatttgcagcaggtataccaggtacattaggtggagctatagctatgaatgcaggagcctatggcggagaaatgaaagatatggttaagtctgtaagattaatggatgaagaaggaaatatatttgagttaaaaaatgaggaaatggaatttggatatagaaaaagtatattaagtaaaaaggattatatagttttatcagcaatattagaattacaagaaggtaaccatgacgaaataaaaaatcgtatgagggaactgacaaaaagtagagttacaaaacaacctctaaatttacctagtgcaggaagtacattcaaaagaccagagggtcattttgcagctaaattaatagaggatagtggactgaaggggttaacattaggaaaagctcaagtttcagataaacatgcaggatttgtagttaaccttgggaatgcaaaggctaaagatatattagatttaatagatgtagttaaaagcacagtatattctaagtttggagttatgttagaagaggaagtcaagatactaggagatgaataatattatggaaataatagctgattatcatacacatactgtgtatagtcacggaaaaggaactatagaagataatgtaaaagtagctattcaaaaaaatataaaaaaaataggtatatcagatcatggatataagcatattgcatatggagtaaaatatgatagtatagctaaaatgagagaagaaatagatatacttaatgaaaaatataaagatatagaaatactattaggtatggagtgtaatatactagatgataaaggcaatatagatgtagatgataaaatattgtctatgttagattacacaatggctggttatcattttggatcaatgacttcatctataaaaagtgcacttaaccatgcatttaattatctaaagtttaagaatcattgtaaggactataacactaatgcagtagtaaatgctataaaaaataataatctttttatagtaacacacccaggcgataagggagatgtatatatagaagaagttgctaaagcagcagtaaaaaataatacattcttagaaataaattctcaccatgggtacttaaatagtgaacaattaaaaaaaataaaagatacaggtgtcaaatttatgataggttctgatgcacatagaccagagcatgttgggaattttgataaggctataaagatagctaaagaagcagagttagattttaatcttataaaaaatattaaactttaagtgaggggatatgatatgaggtttataatagtaacaggattatctagatctggtaaaagtgaagctatgaaatccttagaagatattggattttattgtatagataatttacctccaactcttataacaaaatttgcagaattatgttatcaaggaaattctaatatagataaggtagctttgggtatagacataagaggtagagagtttttcgagactttacatgaaagtctaagttatttagaaaaagaaaattataaatatgaagttttatttttagactgtgcagatgatgttttagttaagagatataaaatgactagaagaaatcacccattagctaaatctacacaaataacggaaggtataaaagaagaaagagcaatattacaaactttaagagaaaaagctgatagcataatagatactagtaatatgaagcctagggatttaaaggaagaaataagtaagttatacttagaaggagaagaaaatcctaaacttacaatatctgtagtgtcatttggttttaaacatggaattcctatagatgcagatttagtatttgatgttagatttttacctaatccatattatgtagaagatttaagacctaaaacaggagatgaccaagaagtaagggattatgtcatgaattcagatgttagtaaagaattttttgccaagctaaaagatatgattgattttttaatacctcattacattgaagaaggaaaaagccacttagttatagcaattggatgtacaggtggacgacatagatctgtaacaatttctaacttaatatatgatgaattaattaaaaagggttatagagctgtaaaaaaacatagggattacactcttagataaaatatggagggaattatgacatcagtaatgatttttataggagtagtagggtggattttattattaatatcaattttaagatatcttaagataaaaaaagaagacaatactaaaactataaaaaatgacgtaagagaagaaaaatctaaagttgttgtaataggagggggaactggacagtcagtttttttaagaggattaaagtactatactcctaatataacagctatagtaacagttgctgatgatgggggaggttcaggagtactaagggaagatttaggtatgttacctcccggagacataagaaactgcttattatccctagcaaatatagaacctactatgagtgaggttatgaagtatagatttacagatggtgttttaaaaggtcaaagttttggaaatctctttttagctgctatgaatggtgtttatggaaattttgaaactgcagtttataaaatgagtgagatatttgctataacaggtagagtactacctgtaacgcttgaggatataaatttaattgctcaccttgaaaatggaaacttagtaaaaggagagtctaatataccaaaacatgtgaaatctcaaaatacacgtattagcaaaattcaattagaaccagaaagtgcaaagccattagatgatgttattaaatctatatatgacgcagataagattgtcataggaccaggaagtttatatactagcataatgcctaatttattagttgatggtgtcgtagaagctataaaaaaatctaaggcacctaagatatatatagctaatataatgacacaacctggagaaactgataactacaatgttttagatcatgtaaaagcaataaataaacattgtggagaaaatataattgatatagttatagctaacaatgaagtattacctaagcctgtatttgatatatatagcaaagatggagcaagtcaagtattattagacaaaaatcaaaaacatatactggaagatataggaataaaagtgatagaatgtaatttagtagaaataaagagcaactatataaggcatgatgctgattatatatctaatatagttgccaatttggcactaagtcatagttatgataatgagaagtaaaaaaggattttaaaagtttatgtagaaatccttattattatgttattttaaggagtgaacaccaatgagagaagaggttagtgccgggggcgtagtattatttggtaatgcagtgctcttacttagaaaatttaatggagactgggtattacctaaaggcaaagtggagattggagaaaatagagaagacgcagctcttagagaagttttggaagaaactggtgttaaagctgatatattaaagtatctaggtgaaattcattatacctttaaagaaaactgggatgaaaatagagcagtccacaaaacagtatattggtatcttatgcaagcgagaagcatggatacaattcctcaaaaggaagagggattcatagatgctaaatttgtacatctagacagggttgttgatttagctagatatgatgatgaaaaggaaattataaaagtagctttagatgaaataaaaaaaagattaaagaagaattaactataggtgatagaatatgtctttttcagcagaaacgaaaaatgaattggcaagagttttctcggataataaatgttgtaacataagtgaactttctgcgatagttagattatcaggaagtatacaaattgctggatataagaaattaaacttaaaaataagtacagaattaaattcaacagctagaaaagtcttcaaactactaaaatcaaactttggaattaatacagagatatcagtaaataaaaatcaaatgttaaagagaaatagtagttatgtattaatgataactaatgacatgggtgctaaagatttattaagagagttaggtatattatcagaagaagaaggttttttaactatgaataaagtgcctgaaaatcttgtaaaagacaatgaatgtgttagagcttttataagaggtgcatttttaggtggtgggtctataagtgatcctgaaaaaaattatcacttagaatttgtgacaaacaatgaagattttgcagagtctctaaaagaccttataaattcattaggatttaattctaaaacagtatctagaaaaaataactatgtagtttacttaaaagaaagtgaacagatatcagatttattaaatattataggagcacatcaagccctacttagccttgaaagcacgaagatagtcaaagaaatgagaaataatgtaaacagacttgttaattgtgaaacagcaaacttatcaaagactgtaaatgcagcagttaggcaaatagaaaatataaaatatatcgaagaaaaaatagggttaaaccatttgccaccaaatctaagagaaatagctatgttaagaatagagtatgaagatttgactttaaaagaattaggtgaaatggcaaaaccagaactaagtaagtcagcggtaaatcacagattaagaaaaatagaacaaatagcggatgatttaagagcgaaatatgaataagaggcgttaagcctctttttattttcaataattattaaaattataaatattggattttgattaacacgtatttattgtggtaaaattacttttataagcaggaggtgaagtctttgagtaaagattttgttcatttacatgttcatacagaatatagtttactagatggtttttctagagtcaaaaacttagtaagtagagctaaagagttaaatatgagtgctgttgcaataactgatcatggttgcatgtttggtgcgatagattttttcaaagttgcaaaaaaggaaggcataaagcctataataggatgtgaggtttatacagcacctagaagcatgagggataaagacccaaattatgataagtctcaggggcatttaatacttctagctaaagatacagaaggatatcaaaaccttataaagttagtttcaaaggcatatgtacaaggattttactacaagcctagagtggatatagatgaaataagaaagcatagtaaagggattattgcattatcagcttgtttagcaggagatgtttctcaagcattaatgaatagaaattatgataaagctaaaaatatagcattaaaatataaagaaatatttggcaaagataattattatatagaaatacaagatcataacttaccagaacaaaaagaggtaaatagagaattaataagactttcaaaagaaatagatgtaggtctagttgctacaaatgatgttcattatgttagaaaagaagattctaagatacatgatattttaatgtgcatacaaatgggaaaaacagttaacgacccgactagaatgagatttggtagtgatgaattttatttaaaatctagagaagagatggaaactgtatttcctgaagtgcaagaagctttagataacacagttaaaattgcggatatgtgtaatgtggaatttgattttaacactatacatttaccaaaatatgatgttccagacggttatacaccaagggagtatctaaggatgttatgctttaaaggattagaggaaagatataaaaatccgtcgcctgaaataactgataggttagagtatgaattaggcgtaatagaaaagatgggatatgtagaatatttccttataacttgggactttataaatttcgcaagagagaataacatcatggttggaccaggaagaggtagtgccgctggatcaatagtttcttacacgttatatataacagatatagatcctataaagtattcactattatttgaaagatttcttaaccctgagcgtatatctatgcccgatatagatatagacttttgttatgaaagaagagaagaagttattgattatgtaaagcgtaaatatggtgaagatcatgttgctcaaataataacttttggaacaatgggggcaaaagcggcaataagagatgttggtagagttttagatataagttataacaaagtagataatatagcaaaagaaataccttttgcattaggaatgacaatagataaagcgttagatacaaatcctaatttaagaaaattatatgaagaagataatgaaactaaagaaataatagatgtatctagaaaaatagagggaatgttaagacatgcatctacacatgcagctggtgttgttatatctaaaaagccaatagatgaatatgttccattatataaacatcaagatgctataactacccaatttacaatgacaaccttagaggaattagggctattaaagatggatttcttagggcttagaactttaactgttataagagatgctttagatttaatagaaaaaaatcataatataaaacttaatttttctgctatggaatatgatgatcctaaagtatatgaattactttcttcagggaatacactaggagtattccaactagaaagtggtggtatgagaagtttcatgaagcagttaaaaccagataatttcgaagatatagtagctggaatttctctttatagaccaggacctatggactctattcctaactatattaataataaaaataatcctggacatgtagagtatttacatgaaaaattaaagcctataatggaagttacatatgggtgtttagtttatcaagaacaagtaatgcaggttgttagagatttaggtggatatagttatggacgtagtgatttagttagaagagctatgggtaagaaaaagatggatgtcatggaaaaggaaagacaatattttattcatggtaaatttgatgataatggggaacttgaaatatcaggttgtgttagaaatggagttccagaagaaataggaaataaaatatttgatgatatgatagattttgcaaagtatgcatttaataaaagtcatgcagctgcatatggagtattagcatatcaaacagcatatttaaaggctcattatccagtagaatttatggcagctcttataactagtgttatgggaaatacagataaagttgtagagtatataagagaatgtaataatcttaaaatagatatcttaaagcctgatataaataaaagttttactaaattttcggttgaaggtaagagtataaggtttggattagcagcagttaaaaatgtaggagtaaatgtgttaaataatattatcgcagaaagagaaaatggcggtgaatttaaagattttaatgaattttgtaaaagattagactctaaagattctaataaacgtataattgaaagtcttatcaagtgtggagcatttgatgagatgggaaataatagagcaagtttacttcttggatatgaaaaattactagaaagtatagctttggatagaaagaaaaatttagttggacaagtatcgttatttgatggatttgaaatggatgcagcaataaataatgatatacaaaatatgtacaaattacctcaagtaaaagagttagaagaaaaagaaaaattatatctagaaaaagaagttttaggtatgtatgtaagtggacatccattatctcagtataaagataaacttaagaaaaatactacaattaacaatgcagatctaaatgatataaaagaagattacgttagctacttaaatttaaatgaaaaagaagtgacaatgggtggaatagtaataaataaaactataagaacgactaaaagaaatgatttaatggctataatagaattagaagatttatatggagttatagaagttattgtatttcctcaggtgcttcaaaaatataatactataattcaggaagataagatcatatatataaaaggaagattaagtataaaagaagatgaaaatgcaaaacttatagctagagagataattgatatgaatgaaagtataaatcaagagaaacctacattatacttaaaaataaattctatagaaaataaagatttagtaaatgatttaatatctgttgttactaaatacaaaggtgataatgatatatatatatatgcagagaatataaaacagatgtataaatggaatcagataaaagttaatataaatgaaaatttaattaatgagttacaaaatatattacctagaacaagtataaaagtaaaaatttaacactttttaaaattttattatataaaaagatagcgaaattatgatataataacaaaaaatagataatttcgcttctattgaatttttttaattttactgggataaaaaaacaatatagggacaaaatacgtcccttaagtttgattaaatataataatcaactaggaggtaaatataatgaaaactataggtatattaactagtggaggagatgcacctggtatgaatgcagccataagagctgttgttagatctgctatatactatggatgtaaggtttatggaataaatagaggatataaaggattaatagaagaagatatacaagaaatgaatttatcttcagttggagatataatacatagaggaggaactatactaaagtcttcaagatgtgaagaatttaagacagaagaaggaagagctataggagtaaaaatacttaaaaaatataagatagattgtcttgttgttataggcggagatggttcatttaatggagctcaaaaattaagtgaattaggatttccagctataggaataccagggactatagataacgatttaccatatacagattataccatagggtttgatacaactatgaacacgataatagatgcaataggtaagataagggatacttcttcatctcatgaaagggttaacatagttgaagttatgggaagacattgtggagatttagctttatatgcaggtcttgcaggtggtgctgaaaccgttatagtacctgaaattgattttaaaattgatgatgtttgtaaaagattaaagacaactcaaaaaagaggaaagagacatagcataatagttttagcagaaggtgttggaaatgctagagaattaggagaccaaatagttgctagaacaggagcagatttaagaataacagtattaggacacgttcaaagaggtggaagcccaagtgcatttgatagaatacttgcaagtaaaatgggtgtacgtgctgtagaattattactagatggtaaatctgctagagtagttggtataaaagataataaaataattgacatggatatacatgaagctttatctatggaaagaaaatttgatgatgaaacttatgaaatggtaaaaatattatctatataaattaggaggagttaacatgttaaaagggataaaaaagactaaaatagtttgtacactaggaccagcatcacaaagcgaagaagttttaactcaacttgtagaaagtggattaaatgtatgtagatttaacttctctcatggttctcatgaagagcataaagaaagattcgatatggctaaaaaagtaagagaaaaactaaacaagccagtagcaatattattagatactaaagggccagaaataagaactggtaactttgatgcaccagaagttttattagaagaaggtcaaaaatttactataacaatgaaagacgttttagggacaaaggatatatgtacagttagctacaaaggtcttgctgaagatgttgttgctggagatactatattaatagatgatggattagtaggacttaaggtagaagaagttaaaggagaagatattcactgtgtggttgaaaactctggaatagtcaaaaatcataaaggtgttaatgttcctagagtaaaaataaatttaccggcattaactgaaaaggatgtaaaggatatagaatttggtatatctcaaggaatagattacatagctgcttcatttgttagaaaagcatcagatgttctagcaataagagaagtattagaaaaaaataatgcaacagatgtacaaattatatctaagatagaaaaccaagagggtgtagataacatagatgagatactaaaagtttctgatggtataatggttgcaagaggtgacttaggggttgaaataccaacagaagaaatacctatagttcaaaaaatgatgataagaaaatgtaatgagttaggaaaaccagttgttacagcaactcaaatgttagattctatgataagaaatcctagaccaacaagagcagaagtaacagacgttgcaaatgctatatatgatggaacagatgcaataatgttatcaggagaaactgctgcaggtaaatatccagtagaagctgttaaaacaatggctacaatagcaaaaagaacagaagaaacattaaactacaatgaattattaaagagcaaaaaacttaatggggtaaatgttacagatgctataagtcatgctacatgtactactgcaatagatttaaatgcatcagctataataacatcaacatcttcaggacatacagcaagaatggtatctaagtttagaccagcatgtccaataattgctgcaacaaatgatgataaagttatgagaagattagctttaacttggggtgtatatcctataatagcaaaagaagctacaaatacagatgaagttgtagaaaactctataaatgcagctaaggaagcttcttacttagaaaatggagaattagtagttgtaactgcaggtgttcctgtaggtgttagtggaactaccaacctaataaaagtacacgttataagtgaagaaataactaatggtataggtgtaggaagtaaaactgtagaaggtaaagttagaatagttgaaaatgctaatgaagttatagattttgaagaaggtgacatagtaatcactcatatgactgatgcagatatgaatgcatatttagaaaaatgtggagctatagttactgaagatggcggaatgacatgtcatgcagctatagtagggttaaacttagataaaccagtagttgtttcagctaaagatataacaaaattagtaaaagacggagaaattataactgttgatgcagctagaggtgttatatatagaggatcaactagagtattataataaataaattattaaaattgttactatatttaagataggggctttataagctcctatttttttggtaaaataagtttttgtagtttaattattatgttcggaggaaaagcctatgttattaaaagacagagattatatagtagacattgttgatataggacaaggtggagttggaattggtaagcatgatggatttacagtttttgtagatggcggattaattgaagataagttaaaagtaagaataaataaatctaaaaaaaattatgcagttggagatattgttgaaattatagaaaaatcaccatttagagttaaaagagaatgtgcagagcatttatctaattgtggtggatgtcaaatacaggaattagactatgaaaaacaattagaaattaaaactaatgaagtaaaacaaactataagtagaatcggcaagttaaatgatgttgtaattcatcctacattaggaatggtgaatccttttagatatagaaacaaagctcagtttccaatacaaaaactagaagataagatagtaataggattttataaaaagaaaagtcatgatgtaatttctacggatacttgtataattcaacatgatgtaaatgataagataataaaaataataaagacatatataaaagcatataacgtaagtatatatgatgagaaaagtcatacaggagtattaagacatttagtaactaaggttggttttaaaactaaagaggttatggttgtattagttgcgaacggaaaaaaattaccatacctaaatgaattagcttctgtattaaaagaaaacgtaccaggatttaaaactttagttgtaaatactaacagagaaaagacaaatgttatattaggtaaagaaaataaggttatatatggagatggaaaaataaatgattatataggagaattagtatttgaaatatctccattatcatttttccaggtaaatcctctacaaactgaagttttatataataaggcattagaatatgcagacttaaaagaaaatgatacggtatttgatatttattgtggaataggtactatatctttatttttagctcaaaaagctaaaaaagtttatggagtagagatagttgaagatgctataaaagatgctaaaataaatgctaaattaaataatttagataatactgagttttatgtaggaaaagcagaagaagtagttcctaaattatataaagaaggtaagacagctaatgtagtggttgtagacccacctagaaagggctgtgatgaatctgtcttagatactatagtttcaatgcaaccagataaagttgtttatgtatcttgtaacccttcgacattagcaagagatttagcttatttaaatgagagagggtatagatgtgaggaagttcaacctgttgatatgttccctcatactatgcatgttgaatgtgtagcaaagttaataagaaaataattgtaaagttacattaaactcgaaaaaacaccttgaaagctcaatcggaacaaagaaaatctaactaaaataggttcacaaaggattgattaaaaggaaataaaaagaataaaacatattagagaataaccctttgaaagcagaaaaagagagcttttagagggttttttattttatataatagggaatattaaaatgaatataaaaaatacatttattaaattatatatatagtaagtgaaaaataggcgaagtttaataaaatctgacacaagctagtaatttcaatgatttaaagtgtgactagctttttaaaagttagtcacagaatagcttaaagtaattaaataataaaaaaattagcaagtaaattagataaataccaatatttttattatttgaatcatgatttcgtaaaaataaagaagttgaattatggttatagaatatatataaaatgaaaaatccatattttgatgaaaagtattaattaagagaaaaggctatctatgaaagaatataagtcctacaaaattatgaacctaaagagaaaattgcaggtgaaatctaagatgagttaggagaaaaattataagtgttaaaaaactttaattaccaatgtagacataaatattataatttgatcaacaggattaaatgaagcagaatattaaaaattaaaaataatcttaaataaaaaataactagttaagagcttttcttacaaaattgtaatacatatgaaagataaataaatatgtgatttctcttaaagaggataaaatagcattgtaatgacaataaggaacaaaatatgaaaaatacttatatataaaaataactagtaggaattgtatccttacttatagatttagttcactcaatggttgaatcaaagtttgtaaatgaattattagggtgttatctaaaataggatatttaacttcaaattagtagaatattaaaaaataattaaatattatgcaaaatacaattaaaattcacaatttttatatagtaagaataacacatattttaaaatataggaggtctattatgagtaaattaacaaccattaatatagaaaaattctcaactgaaagaaaaattatatcttatatgacaacgaaatcttggcaaactataccacatgtatcttatatgtatgaacctgatattacaaattttattgacgaatttaaaaaattaaaagaagaagataaatcattaaaaaatgtttcaattaattcattaatgttaaaagtattttctgaaggattgaaatttgcaccaaagctaaatgctcacatatcgtataatcaaagtactggtgaaggagaaattcatacaattaaagatattaatgtaaatatgccttggattttaccaagtggaaaaatgatgacaataagtataaataatattgaagaaatgtctttatatgaaattaataaatatattaaagatttagatcagaaaatttcaagtatagattcagagtgtttatctaaatcattttcagataaaataaactataatattataaacagtataataagtggagaacataaaatgtctgaagataataatgaggataaatcaaaaatacctttagaaattgggactataactatatcaaatattggttctacatatagagaacaaagaggtgctattgctttgttagatattatacctccacaagtttgtgtaataggctttggtgcaattttagaaaaaccgggtgtatatattgacgaaaatggagaaaaggctattggtattcgtaaagtattaccaatatgtttagcttttgatcatcgtgcattagattttggagaaattataccttttataaaaaaattagatagcatatttgaaaatccaaatatactaaaaagtttttaatccttattatgatattttcatagtaacaagatatatagaaaaaataaaattgaattaaagaaagagtatatgttatggactttataatttactcctaaaaataaaaatagtagttaaattttaaaatttagctactatttttatataatatattaatatctagcttgtactcctataatatattctgtagatggtttaccacagctaattactctcactccttttacgcttgctatccaatttttgtaatttactattacatcaacgtatgataaatcctcttattcttacaacaacttctgcttctggatttattgttttatctaacgctgctaatctaccaaatatagtaatatctctttcgaataaattatttattaatgaagtttcttttgtatttacatttgttttatatatcaaacaatactattgataattagaataataggaatagctaaatactatattacagtattctaactaagttcttattctgaaaatatcttctatattttgatatgtattcactatttcattattttagtgagattttttcaattaaaacagctcaatatgtagcaaacatactaaataaatatattaaatagtatttaaatttttatatcatttgaatacttttttaataattaccagtaacacttaacttatctgaatacatttgagtaagaagtggttttcacaaataaagtatacttaatattttgttaaatgtgaatgcattaattaaaaaggttatcatagaatgttaatattttattgaatttaataaccatactattactttttaggtaatatatataaatatcataaatttattctattttctttagttttcatttttaaaaattattttgaaattaaatttaatttaaaaagaaaggttttaattacaacggcagtaacaacaactttattgactggattttgcaatttaaatagttggagctactaatgaagatggtacagttgatccttataaaataacttttgtttataaaactggatttgatgataaacaagatgtaaataaatttataaataagaatccattagaagcgtatttaaaaggtaacaacgataataaaaatcagtgtttacatacgaagaatgagacatgttgaatgtgtagcaaagttaataaaaaaataaattatttagttgcgaatgctaaataattctgatatcatcatagtataaagtacatatgatacaaaaaagccatgaaggttttataaatccttcacggcttttttgctatataattgtacaaaatttaaactctatatcaatagatagatataaaaactatctattcccttttattgtgaagatgctatatagcatctttttctttattaaaaaaatttgatttaaagttattgttgtaaattttagaactaaaaaattcacaaaaatattttaaaaaatgagcatctttgaaagctatatttttaattatataaatgggtattcctatgcatatacaatcatctaatgcctttaagttataatcaaaattgctatgagtaaaaatttctaaagctcctattatatgaaattcattatatatatcacttgaattattttgtaaactatatgaatcttcaaatttgacaatagtaccatcaactaaaaaatataggtaatcaggtgtactatttttacaagttataaattcatttttattaaaacaatgcaattccatgtttttaatgaaatttacatcaaagatatcatttatattacatttatctatatagtattttaatgtttgttattgtgtatcatactaatagtttttgccttggagataatcattcaaataattagacatcctgacttgataggttattattgcatacaacttgtatttatatgtataggtattatagctacatataatacagaagatttatatgttaatattttttctaaaaagattataaaatctaaaataaaagaaaaggtatgtacgctaaataaagaaaaacttgtatacactgataaaaacactgtaattgaaatttatcctaaggatcttcatgatattatagaaaaaaataatacaatttatatatttggtgctaacaatacactatatttaatgatacctaacaatgcatttaaaagcgataatcagaaacatgaatttttacaaatactaaagggatttaactaataaaagttaaatccctttgtacttaaatgcaaagttataacaccattaaaaaagcaggagcaatgctcctacttactttagttcgtattatattaaatttgttcatcatattttttaacctaaactacaactatacaacaattaattcacttctttagttaatttaatcacttcatctttgccatttaaatcttctataacaaaatcaaatttatctaaattgtcaaacttacttgcttcaaatgttatttcaactatatcttttccattctctacttttatcaatcctggtctatcagttctgtatacgactccatctttatcaactaatttaacctttgatattatactttcatctatcggtacatttaccataaacttaactttaatccctgttgctacaccttttgcttctaggacttctacattatcattgcttccagttgtaacataatttactacatcattatttatcattgcttcatcaagttcaacatctagtttccaatcaccttttaaatttgctattttattagtttgtaagtttaagctctttattcctcctaaattaccttctgctgaatttaacattatatcaaaatatacatttccattagatatatccttagtgtcaactgatgtatctccacctgatactagccaaacttcttttccattttcgtcaacaattggctttgttcctataccttctttctcgtcataaaattgtattactctacctttatcatcagttatattaaaagtattaatgcttggcccattttcagcatatttaaatttcttcatattcttaatatcctctgatgaaactttaaactttaagtttatcatagtcgggtcgacgattgattttataacttctagtcttattccattactttcactatataccccttctatattttgttcgtatccattgtctatagctgtttgtacccctttgtatcttccattaaaaattaagtcttttacatttgcaagtataggactagttagggttatccctccaacaattaatactgtaactacggctatatttttcttgttgaataagctctttttattttttgtatcttttattttcatatctcttataatattaaaagcctcttcttttttatttcttatgctcataggtattgtttcttctttgtttaatagattctttatttcatcatctatgttattacgcattcttgcctacctccttattattgtttagtaaaaaattttcaaaacgtttccttccccttgaaagtcttgattttatagtattttcattctcatttagtatctcgctaatctctcttgtattgaatccatctacataatataaacttagaactagtttataatcactacccagtttttcaaaacattcatcaaattctaatctagcatcaatattttcttcgtaaaattcttccttagtatatttgtctatgaacacaatgtttttatttgctcttaatatatcattgcacttattaattagtatccttgttaaccaagttttaaagtactttgagttttttaaattactaatacttttatatgctgataagattgtttcttggatagcatcccctatatcctcttcattgtttagtatcgcttttgctgttttgtacatagtcaattcatgtttatctattagactaataaaagcttctctatcaccttttatcgctttttttattaaaatttccacattttcctccgttatatttattaattttgctttctatacttattagactcaagattttattatttaggtgcatttatatttaatttcattagaaaatatatttgtcatctttttaattttaatttttccaataaaaataggagcagatgctcctatattcaagttcgtattatatatatatattgtgaactttggtaagttgtatagtgaaattataaatcactatacaacttagttatttcataagattttttcttaatttcagctctagcatcaataggatatattatttcgatatctttaccatatccaaatgcaaattcaattccttgaaatatagcatcaaaatttatatccatatatatattatcatcttcaactacaatattactgatggaaataaactgtctagctttaacatggtttacaatggagggattaaccttaaaagtaaatgtatgctttggaatagaggacttaaaattactagtactagacttccagtgtttttctaaattaaaatatttaggtctatcaaataatgtatctgtcaataaagcagactcaatattactaactttataagttttaataatctcattattctcgcctattaaataccaaatacctcttttacatactaatccaagtggacttagtataacatatttagtttcatttatctttctatatacaatatttaagactttactattccatattccttcttgtagaatagaaagaatagctgtatctacttttattggattttctccccaagtgtacatatcgatgaaaatataattttgtatattcttaatttcattcatttgataggttgaagaattacctaaaagcttaatcatagtactatcttttaattttccaattcctaaatcatctaacactttatcacctgtaggaataaacaaagaatagagttcatctttatttattccacttagcgtggttttgtagtctcctaacagttttattccaccattagtacctctctctgtaaatataggtatacctaaagaacttaaagattcaatatctctgtaaatagttctaacagagacctctaattttttagccagatcatttgctgttaactgcttatgtacttgtaacaacataagtattgaaattaatctatctgctttcataaaattcctttctaatatgacataagatgtcagttattataacttataatatactttgtatcaaggtgtaattacaaaacaaatttaaactatatttttgtaaatactacagcgataaagagtatttaaaggagagttaatgatatgagtggaaaaataatattaaatttagccataagtttagatggatatatagcagatgaaaatggaggatatgattggataattggagatggtaattctactctaaacacagaaaataaatgggattataataagtttctatatggaattgatgttgtggttatggggagaaattgctatgatcaaaatatgcataaggattttcaaggaaaagaaatatatatagcatcttctgagaaaatagatgattataaaaactatcattttataagtggtaatatatgtgaaagtataagcaaattaaaaaacgaaggcaaaaacatattcttatttggtggaggaggcttagttgataactttgtcaaagatgatattatagatgaatatgttataggaataataccaactattttaggcaaaggaagaaagttattctttgaaaataatcctaagatagatttaactcttgagtattactctgttgaagatggtgttatagtaatgaaatactcaaaaagaaataaataaaactttttaatgcattattctaattcacaatattaatatattacgaattaatatttcttaatataaaaaggctagaaattaatacactgcaatatttctagcctttttcacatactatttatcacgaaattatataacaaagcctaattattaaaaaattgtatataaacctttaattttactcttcaaaaatactaattcagtccattaacctaccatgttatgtaaatttattaaattaaataggaaaatatggatataaacttatggaactagaagttaaaaaatctaaagcatcgataattttaggattactgagtttaaaatctgtaaatttttaaataaaatttataatatggaaagttcacaattgttaacaattgcgacctatttaaatagtaatactcatacttaacacaatctattatttattactatttaattttcgtgaaacattacaaggtgtcataactgttaagttatgaaactcttttgattatttttgaaataaaaaaagtcgtgcttctaacacgactttttttatctgtcttaacttaaagagttaacaccaacgaaatatttaaacagagactgttattgcctaagaaataaatattttcatggtactaattattttggattttgaaaatattttctaataactctattaaaaatatataaaatctttctactgactctatatcaatatgttcgttaattgtatgaacatcaaatatattaggaccaaaacttattatctcaacatcacttggtaatttttctttaaatactccacactccaatccagcatgtaatgcatttactataggatttatattaaataatctgttatatatttctacacttaaatcttttatttttgaatttgaattatatggccactctgggtattctccatatttgttagtttcaaatcccataatttcacttataatttcaattttattgataatttcatacaatttgcttcttaatgaacttcttaaatccattttaaactttattttattaccttctgtttttattattcctaaatttatactactttcaaccaatccatcaatatcttcactcattgtttgtattccatctggaagtaatactaaaaaatctattaccttatttgttatttctttagtaaattgatttttttcattttcaaaagttatttcatctatatttataaataaatcttcagatttatattcattcataaaaatttctttaatttttagacatttttctttaacaatattcttatcacattcacttatactgattatagaactacaaacgcttgggatagaattatatttatcacctccgtcaattgaaattatattaatatctatttctttttttaattcaaatagtaatcttgccattaatttatttgcatttgctctttttctatcagcttgtattcctgagtgtcctcccaataatcctccaatttctattttatatgtaggacttttaatttcttcaaactctaataataattctgagtccattaaaattccaccagcacatcctaatgtaaatactccttcttcttctgagtcgatatttaaaagaattttaccttctaataaatttgtatctaaattttgtgctccattcatagttgtttcttcttcagtagtaaaaacaaattctaatttagggtgttttatatcatctgaatctaatattgctaatccgtatgcaatagcaattccattatctccacctagtgttgtattatttgcatataaatacttattatctactaattttaattccaaaggatcacttgtaaaatcatgattactatcatttgattttacacataccatatccatatgaccttgaattatgacaggtggtaaatcttcatatccctttgttgcatctttttttattattatattaaaagaactatcttgtattacgtctaaattcctatctttagcaaattttaaaagataattacttatatttttttcatttccagaattacgtggtatcattgaaatttgtttaaagaaataaaatactttttcagattttaagtttttaattagctccattattattccctccaatttgataatccttagttaagtttatactaacattaaataaaaaagttttaaatagtgactccgattaatactggacaaaaaaatcctatattttaattcattttaaaatacgatatctatttttactatctacaaaatataatttttactaaattttagtttatattaattatttaaagctaaaattagaggaaattaaaattataaagtaaattgtatataaagtgataaattatagaacttgtaattataaacaaaggtgaaaatcactttatatggtaaaacacctaagaactaaaacaataaatacagataaaacttatcatggggctattgaacttaaatagaattgtagctattcataatactgaaaatattgcttcaggtaaagtaatgataaaacataatatgaagtataaagggaatttaaaacaagtaggcaagttaaatggtaatttctatgatttaaatatttactcaattttaaaatctgaatggaaatcttaaggataaaatcttaattattttaggaggatataatgaatttaaaaccagttaagtttactgaagaattggctaaggaaataactacttggaggtatgaagaagagtatgagatatataatttgccttcatgggatgaaattataaataagcaaatttctttgtgtaagaaagaaaaaagaaaaaattttattggatatttgaatgaagaaaagaatttaattggatttgtaaacttagtagatgaaggtgattctgtgtttttgggaataggtgttaaacctgaatattgtggtgttggaataggaaagcaaataattaagatggctttagatgaatgtagtaaaagatatgaaaataaaccaattattttagaggttagaagttggaataaaagagctattaaatgttatgaatctcaaggttttaaaatagttaagataaaaaaacaggaaacctatgctgggtttggtgaattttttgttatgaagtatgaatataggtaattgaattttaaaaatattaattaagtgtattaagtttttgtaattatatatttcataaatttaataaataactgtgctctagtacttatatgtattgaatcactagagtacagtttttttaatttaaaattcaactaatggttaaaaaaactaaactattacttaactagagttccattgtttagccatttacaaatatgtataatttaaaatataagataaaaatctataaatttaaaaggagatagtatgaaattgcatattggggaagttatatataaattaagaaaagaaaaaggtgtaacacaagaggtttttgccaacacattaggagtatctgtagcagctgtatcaaaatgggaaaatgaaaattcctatccagatataactatgctaccttcaatagctagattctttaatactacaatagataagcttttaagctatgaaatagaaatttctaatgaagaagttatggaacttatgaaaaaatgttcaactatatttgaaaaagatagtgttgaaaatggaataaaggcttgcgaagattatataaaactgtatccaaataatatgtttttaaagtttagaataggttctctatatatgatgtctttagctagtgccactaacgaagatgaagcaaacattatgattaataaggctatacaattactagaaacatcttctaaaagtgatatacaggaaataagtgaaacttcaaagtatatattaagctctttatatactatgaatagtcaagaagataaggcagaagaagttttgttgagtttacctaaagtgaatatggatagagaagacatgctaattggattatatattaatcaaggtaaatatgataaagcaaaaaagaatttaagagatttgacatataaaaaaataagcaatctaataacttctttagattggtatgttagtgtagcttacaaggaagacaatatatcaaaagttaaggaaattttagaacttaaagataaacttttagaaatatttgacttagaagatgtgtatggaactagtagaaatttaatgtttgctgatttatatgcaaaagaaaaaaacatagaaaaaactttagattatattgaaaatattgtagaaaatttaaataaagattataactttaataatcatttactatttgatggaatagagttattcaaaggagttcaatctaaaggatatcttgtattaagtctaaaaaagctactaataaatgatgagagatatgaatttataaaggaaaatgaaagatacaaaaatatagttaaaaagttagaatgcataagtctgaattaatgtatccttatcatacagatatctaatagtaaattatgttacaatttaattagcaatcgttctaaattaagtaaatataactggaggatttatatgaaatttaaaataataggtagtggtggttgtgtttctttacctaagccattgtgtaattgtaaaatttgcaatgaagcaagacttaagggaaagccttattcaagatatggatgtagtttatttttagaagatataaatttattaattgatactcctgaagatatagtacatgcgataaactattcaaatattaaagaaattaatactgtattatttagccatgttgacccagatcatacgctggggtttcgagtttttgaacaacttagactaaattggcttgaaatttctgagggaaaagaatgcaaaaatcctataaatgtatatgcaatggagcatgtaatgtcggatataaattctatacaatttaaatttggtacatatctagattattacgaaaatactaggaatttaattaaaagagagataattaataaatctatgcacatagaagatataaagataagttgtataaaagtaaatcatgcaacagtatttgtatttgaagaaaatgataaaaaagtaatatatgctccttgtgatgtaaaaccattccctaatgatgaaatattaaaaaatgcagagttattaataataggaaatactgttgttggtgatattcttaaagatggttttgttttaaaagagaataatccacttagaaaagaattatttagtttagatgaaattcaaaatataaaaagacaatacaatataaaaaatgttataattactcacttagaagaagactggggtaaatcatatgatgattatttagagttagaaaataagtatagtgggataaaatttgcctatgatggtatggaaattgatgtaaaataaaatcaaaaaagtataattattgtacaatattgataatttagtaagtgtcaacaacaattactaaatataaaaccgaacagaaataaataaaaatataaaaataaggaaaaactagtatctaataactattaaatgcatataataatatatgtagtaatatacaaataaattaagaggcctagaaataggttcacaggagtatttttttatgaataatggaatagtaaaatggtttaataatgaaaaaggatttggatttatagcagtagaaggtggagaagatgtattcgtacatttttcagcaatacaaactgatgggtttaaatcattagaagaaggtcaacaagtaaactttaatatagtaaaaggtgctagaggtcctcaagcagagaatgtaactatattataatatatatatatgttcgtgaaaaagacacatcgtgtgtcttttttttattgtaattaattacaataaaaatatataaaataataaaagcatcttagagatgatgtgcttttattgtgaacatatataatcttgaacttaagtttaatttatgtatttctatttctttagagttttattaaaaccttatatttcctttaataccctatcaaaaatgtaagaaatatttaaggttcctgcaaggcttttttaagacttagcatgtataataaacgtatcaaataaataaaacattgggagtgattatatatgacaatagtattaggaagtttaatgatagtaccatttatattagcagcaggggctggattattaggaaatcaattagaaagtataaatgaacaataattatatagataaaaagcatccactaatttggatgcttttttatttttacaaaaattaagtcttatacttagcctttgatatcaattgagtcattgttcccatcggacaataaatacactaagacctagacttatataaaatcatagttactataccaagcataattataataattaatttataagcataaaaggtgtcagagcttaaaagttatgacacatgaaattatatattattctaaataaaataatatatatgttgacatttatttagaattcatgtaatatgaagtttagttcacatgaacttaacttcatattatattaggagtgatttgtttgcaaaataaatttgtatcccgtattctagtttcaataatgtttattataatgggatttatccaaagaaaatttaattcaccatcagaatttgattttggatatttaaatatgttaataggtggagtacttttgataatttctatgatttctaatcttaaatatcaaaataataaaaaagaaatagacaaggaactatcaaaagattatgacgaaagagacgagttaatagatggaaaagtagctaaatttactttaagcgtcttaatatgtgtaattttaattattatgttcctttctaattggattatgattgaaacaaatgttgctttgtttattgttttgatatcttttatgattattgaatttttagctagaaaatattatagccaggctatataattaggagtgatctaatgaggaatagagttaaagaattacgattagaaaatggattaacacaacaagaattagctgacagagtatgtgtctcttcaagaacagttatatctttagagaaacaaaaatacaacccatctgttctacttgcatataaaatagcttcagtttttggtttatcaattgaagacacttttatatttgacgacgaggacaaataaaactaagaaatggagaaataaaaataatgaaaatattaattataatttttggagcattactaacactttggggaatatatagaatgaaaaatgatgatgccttatttggaaaaagccaagtaagtaaaaatatatttaacctagtattaatgggagaagcatctggaataggacagtttttaggtggaattgtatgtataattatagggataatatcttttataattaaataagcaaaaaagaggacttaatttttaagtcctctttttaattacacaaaataaaatgttatcctcataaatataaatttaatattcaattaactatgctaaatctaaatttgcattattttttccatacatataaatatacttgtatttatttataaagaataaagaaactatcaacgttgtaaattcagcaaatggaacaaccatccacacaccatttacacctaagaatcttggtaaaattataatacctatagtaaatagtataaacgttctaagaatagaaagcagtgcagataccttaccatttgaaaatgccgtaaacattccagaagtaaaaatattcataccaacaactaagaaattaaatgaaaatatcataaatccgttgaaagttatatcatataatgaagttccttttggagagaacatacctattataatatttgaaaaagacctagatgatataaatataaaaactgcaaatacacacacaatagtaaaactatatcttactatttttcttagctgttcatcatccctactaccataattataacttatacgaggtgatacacctgaagtaaatcctatataagctgagtttaataaaaactgtacataaagtattattgttatagatgctacaccatcttcacctaaaaacttaagcattgctgcattatataaaaatgttgtaactgcacctgacatttgagttaccatttcactagatccattcatacagctatctaaaatcaatttcatgttaaatttaggctttgcaaagcataagacattactttttcttgaaaaataaataactccaaccatagcaggaagtgcatagcttatacaagtagcaagtgctgcccctagtgctcccattttaaattcaactataaataaataatctaaaataatatttattacaccaccagatactgaacttataagacctaattttggtactcctgctgtaactaagaaataatcaaaaaatagttttgatatcataactggtgcaaaaattaaaaacacaatcaaataatcaaaacaatttttatataaattatctgttgctcctaaagcgtaaattatatcctttataaatataatagataataccgctactattaatccaactgctaatgcacttaatgtaataagcgtaaaagtttctttagcttcttgatttttaccttctcccatgtattttgctacaatggcatttcctccagttgcaaacattatacttatacctattaaaacatttattacagggtaaacaatattagttgcagataatgcatttgccccaacatatctagatacaaatataccatctatgattgtactcaatgagaaaaataccatcataataactgttggaaatgtatatttaattaaagatgttaaacttatcttattttctaatgaattactcattacaacctccttgatatatttatttccctaatatataataaggtatcctgttacgggatagtcaataaggagaataataaaaatgagtataaataaaaaaagatatttttctacaggggaatttgccaagctatttaaaataaataaaaaaactttattccactatgatgaaataggactttttaaacctgaaaaagtagaggaaaatggctatagatactattctgattatcaattagatttatttaatgttatatatactttaaaggaaattggtatgtctcttaaagatataaaagcttttatggataatagaaatccagagaatatattgaagctttttagtcatgaatatgcagaaattgaaaaagaaataaaaagtttaagaaaaaaacaagaaatacttttaaacaaaattaaccttgttaaagaaggtaaaaattataatactgatataacaattgaagaacaagaggaggaatatttagtattaagtaaaccagtaaatataagtgatgactcttatgacttaaatagctatatagatcatctagattattgttataaaaatgatttatatataggctatccagttggggtcattataagtcgtgatagtttatataaaaaggattataccaactttgattactactatacaaaggtcaataaagatgattctaatgaaaatataattgtaaaacctaaaggaatatatgcagttggatatattagaggatattatgataaatcacctcttttatataaaaaggtgatgaaatttattgaagatagtaacctatgtgtaattggggattcatattcagatgtaatatttgatgaggtagtaagtaaagataacgatgattttattataaaagtatctataaatgtaagttattaaaaatagacttgcattaccataaataaaagcgttatgttaattacctttatgatatacttaatatgaatttttatagaaaggagttttttataatggtactaaatgtaatgaaattaagcgaggagcaaagattgtaaatttataaaaacataactttgtgagggcttaaaaaatactagtttgttgtgcaatctttgctttaatctatttgccctaaatagcaaataggagtaaggtaaaatgaaatatacaaatgcacaagatatattaccaaaagaagttttagaaagtatttataaatatctagatggtggatacttatacatacctagaaaagatgagaaaaagaaggcttggggagagtctagcggacttaagtctgaaataaaaagaagaaacttagaaatatataataaatatttaaatggtacttctatagataatctttctaaagagtattatctttctaaaagtagtattaaaagaataatatctgaatgtaagaaaaaagtggctaattcatattagtcacttttaatttgtactaagaacttttttaattgttttcagtccatttttaataacgtactcatagtataattaaaattataaaagagaaataaaaattatacttaaagaggtgaattatggatataaatgtagatttagtcaaagaattaatcaaaacacaataccctgagttttctaatttagaaataaaaatggttaaaaaaagtggtcatgacaatagaactttccatttaggtgatagtatgtctgttagacttccaagtggtccttcatatgcttcacaaatagaaaaagaattaacatggttacctaaattaaaaccatatatatccctacctattccttgttctatagctaaaggggaaccaagtgataaatatccatttaattgggctataaatcattggttagaaggagaaacagttgattatgataatataagtgatttaaatgaattagcagttgatttagctagattcttaaaagaattacaatcaatagatgctagtttaggaccaatcgctggggagcataatttccatcgtggaggaaatatctctgtataccactcagagtatattgaattagtagacaatttatataaatttataggggtagaaaaatcattattacttgaaatttggaatttaggattaaattcaaaatggactaaaaaacctgtatgggtacatggtgatttagttgctacaaatatgcttgcacttaatggaaagttagaagctataatagactttggtatattaggagttggagaccccgcttgtgatttatcaatgtattggacattctttgataaagaatcaagagaaatttttaagtctgaattagatttggataaaagtacatgggatagagctagagcttgggttatatggaagcaactttttgatatacaatatcatataaatgatgattctaaaactgctaaaataaagaaaatagtacttgatttaatagatgaatataaactaaataatttagaattaaggagcattaatatataatgctctttttagtattaaaaaaatatatattttttgaaccttttgatatactttaattttatatataattaagttaatgacttaaatataaatagaaatttgaggtaaaatattatggataaatacacaaaagaagaattatcaaaggcactagaagttgtgacttcaactattaataaatgtgaaaaaatacatccaaaatttaaagaaggtacttctcaacacacacttcttaaaaacagaataaaagctatgtatatttcaaaaacattaataaaaggtgaaaatatttcagacaaatatacaaaagaagaattaaaagacgctatacgaccagtaacttcagttataaataaatgtgaaaaagcacaactaaaatttgaggaaggcacatctttttacaatcgtttcaagaaaataatagacgcaatgtatatttcaaaatcacttataacaaatgaaattaataaaagggattaatttataatttatataaattatatactaggggctaaagacatttctaattgagaaaaaattaagatgaaagattaaataaaaaaaataataaattttaaagggggattattatttgaaaaaaatccaaatattagagtctaataatcagttaatagatagtcaaatcaatacattagatatacttaaatttgatgaacttaatgatttgaagaaatacgtttatgaatcaattgatttatccaatttaaatgaattagaaatatttattgaagtaatgaaatgggtaagtgagcgcttagttcatgatggtgtaaatgatgctggaaatacatcttcattagaaatattaaagagagcatctaatggtgaaagattcagatgtgtagagtatgcaaaagttgctaaagatatattgctatctatgggatatattgctagaacactaaatatccaaagcaaggatgctgactacggaggagtaggtcaaggtcatgtagtaactgaagtatggtcaaacaatttaaataaatggattttccttgatgttcaattcaattgttatgcaattaaggataatttgcctcttagttattatgaagtttttaaatcattagatgatatatcatttatatttttaggtgataatcctaaaattgatgaaaagagatatatagaatttattaaaaaatactttggatatattaaagtaaaacgtattttaaatggtattgaatctcaattatttttacatctagatggagaacgtcaattactaacttttcaagctatggaattatcaaatgcgatattcactaaaaaattagatgaaatttattttaatcctaatagaacagctattttatttgagtataaggattctattgatgttagcaaaattataaaagaaaataatatagtttcagaagaagattttaaagcaaattacgatttattttgtgctaaacctaattttacattaagatttattagcaatactcctaatattgattattatgaattacagataaatgaaaatgattcagtaaaaataataaaaaatacatatgactggagtcttaatgaaggtgttaacaggattaaagtatgttctgtaaacaaacaaggtataaagggaagcattacagaaatgaagatactttataattaatgtttaaaaaatatttgttttaatatatataaatcaaactactttttagagggtatagtattttactataccctctttttcggtaatatttaggggtatattaaaatttatttaaaaatatattgtagaaagaaaaacaacctgctacattttaattatcaaaaggtaatataaaggggaatattagggatgagaattaaaaaaattttacctataatagcggtatcactatcaataggtatattaacaggatgtacagaaacaaaaacaaaaagtacacaaataaatgtacttgcaacaacagacttgcatgggtccgttccatataacatggcacagcacataaaaaaagaaagagaaaatgatccaaacatatcattagtagatgcaggagatttttttgatagtgacagcggtggagctatggataaatatttttctgataggcgtagtaagaagcaaactgaaatcgttacgtttgaaaataaatatgtagagtttccactagcaaaagatatgaatgaagtaggctatgatgcagtagtacttgggaatcatgaatttgtatcaaataataaatttcatttagataatatgatatctgactttgaaaaaaataatataaacgtattatcagcaaacacttataaacaaaacggtgaaagctacacaaaaccatatattataaaacaaatagatactgaatatggacaagttaagctagggatattaggccttactataaaagaagttaatgagggagaaccgggagacgaaaaacgagatttaaaagacatagagagttatgctggaaagttatatatgaatgacttagttgaagatgctaagaaatggacaaagataatgaaagaaaaagaaaatccagatataatagttgcggtagcacatagtggagaaaaaccaaaaaagccgaaacacccaggtaatagaatacaagaattagcacaagaattagatggagtagatgcaatagttgcaggtcatactcatacaacttttgaacaacatgactataaaaataaaagtggtgaaaatgtaatagtaacacagcctggaaaacatggagagtgtatatctaaaataacttttgaattagaaaaacataaagaaaattggagagtaaaagacaagtatattaagttaacagagtttgaaaaagataaaagccatgattatgcaaatgaattaatgtataaaattgcagatataaaaaggggaacaaaagagataaatttaaaagaaataactccatttgaatgggatagggcatatgtatttgacaaaaacacaacaataaaagaaatatatgaaaaagtaggatataaatggaggagtttagccgagcaggaaaaaggatatgaacttcaaatggtatttatgaaagatgaaaaagttgtatcttatttaattggagataaagataaaatagggattagtatgaagtttgataaatcaaattataaagatgggattatagaaattaagccaaataagaatgataagtttagtgttaaaaaaggacaagaagattttgaaactcatttaacttatatacctgtataggaatatgaaaataggagtttggcaaagacctaattcatcagattataaaaaatggacttcttgtaagaatggtactatctgggttattgcaaataagtatgcaggaaaactaggtataattacctttaaatttaatcaaaaaaggagtagaattattctacttcctttttcattaaattgttatacgattgttgaatataattaaattcatcttctgtaatagtgctttttatataacggctgtcatttcctttagatgtcaatatataaatatcgaattttttacttataaatatttgatatgcatgaaagtattcatctgctaagtcggagtctatccaactataaagccacaatttagtatcatgattaatattgtcataatgatgacaaaactcttcccttgtaatattggtataatctttgctattaataatattatgtatattatttaccgtttcagaatcctttataaatatggaaatatcagaactagctgtttgccccagttgagtaggagctttatcttcagtccaataatcatagtcggttattctgtaagattctggagcatttatagtttcaacaaaaggtcctaagttaacttctggcaaattagtggctgagttagtgcccttatttttattaatcataaaactaaccggtaaagctaatataaatagaactataaatagtaatagattttttttcttcattaatatccccctttttttaatgaatttacttacaataagtatactatatgagtagcaattcaaaaatgtaatcttttaataattagtatttgataacactttaatgatataaaattaatagcaagaaacttctctcattctaacttattcttgattatagcaatgatttatgcactataatcccactttctaacattagctttatgaagatgaaaaatattaaagtctttttatttatagttttatcaatttttctatattgcaaaattaaaaaagagggagcaagttatttattggggagtagttctatatactaactatataggaggtagtaatgattaatttaatattaaataataaccctagttgtaagactgtattaacaagtactgtcaaaaataaagtttggaatcttgaaaataaaccatatattaaaattgaaacagataatattaattcagactatatagatataaaggttatacaagaagataatattttatttagtgactatgttaaagttaataatggattagtttccgttaagttttatttagatgaagtattaaaaaaaactaataatattaaagtaataattggtgatcatgaagagatattcaacataacaactagaaagatttatggaacagtcaaatacttaaatggcaaacctgttgataccccaataatcaattgctcaaatagtgatatattatgtttaggtgatgaaaatggtaaatttgaactttttctaaatggtaaagaggaaagtataggtgtttttgatagaaattattcaacagaaactttagaagcttggttatataatgtaaacttaaaaaatgatattgagttagatataaaactagataaatgtgagttatatggtattgaatcatggaatcaagaatgtagtacttatatacattttatacctatgtctatagctagaataaatgaaatatctaaaaatacttctagaaatgaattagatttaattatgaataaagatatttggccaattcttgagaaagatgatgtagagttattttttaataatgaacaaatagaagtattatcatttgtaaaagtagatgactttttattgaaaaaagataaccaaaatatttttagaaaaggatatatagtatctatacctaaagtaaataaaaatggagtaataaaaatagtaataaaagatagatatttaatagaaaataacattcagataagtataggagaagggtattattttataaattagggtataagtcataacctcacacaactaaaaaattaaatgcaaactcaaaacatataaatgatcttcataatagttttaaacgttggataatgctgttacaagctaagtatttaaacaactacttagcttggttaaaattccttcaattaagtaaagtttctataaatattttgtatgtagatggaaaattgaaatatataaattgtaaaggatttttaggagatatgtttaaataagtttttaaatgaaggaaaaagaaaatgcagatatagtagtagctgtagcacatagtggggaaaagcctaaaaaacctaaacattcatgcaatagaatacaagacttacctcaaaatgtagaagtaattgatgcaatagtttaaagtcatattcatgtagcatttgaacaacatgattataaaaataaaagtggtaaaactgtaatagtaactcaacctggaaagcatggagaatgtatatctaaaattaattttaagcatagtgttatacgtaactgtatgaaaatgtatataatatccttatataggaatatgaaaataggagtgatataaagtgtattattttgaacattcatattatctaggtatattgatgacaattgtaggattgattatgagatatggagcaggtcaaagacctaattcatcaggctataaaacatggagttcttgtaagaatggtactaattgggttattgcaaataagtacgcaggaaaactaggtataatttgtggatttatttatactataattttctactttatagatagattttttaatttaaaaaatgaagtaggtatatcgttgtttgtattttttacagtattcgtacttattatcatagccacagaaattcgtttacataaagaaaataaaaaatcataataagtttgaatagttaaaaactaagtaattatattgaatatataaattggatattatttagagggtatagtgaaatactatatccttttttgctttaaattaagatgctaatatttaaaaactttggataaaatacttttttatatataatataagtattagtaacagaatttcaaggggagattatttatggaaaaaattattatcatagaagatgaagaaaaaataagaaatgaattaaaatgctttttaactaattataattatgaagttattgctatatctgattttgaaaatgtagtagacgaagttttaagtttagaagcccatctaattttattagatataaaccttcctgtatgtgatggttattacttatgtagaaaaatcagagaaaaatcagacattccaataattgtagttacaagtagagatacggaaatggatgagctaatgagtatgaacttaggtgctgatgattttgtaacaaaaccatacaacacacaaattctacttgcacgcataaactcacttttaaaaagaacttacaaaaaaactaacccagaaatacttaaatacaaaggattggagttagacttatctaaaaatagtgtaagctttgaaaatcaagaagtagagcttactaaaaatgagtttagaatcttaaattgtcttataaaaaatgaagggaagatagtttcaagaggagatttaatggattatttatgggacttagatttattcatagatgataatactcttactgttaatataaacagacttagaaaaaaattaagtgaaattggatgtagtggatacatagaaactaaaagggggagaggctatataatgccgtaactatgaatataaaagattatttaaaagatagaagcttagctatattattaaattttatattttttgcttttgtaatttttatattaaaagcatctcaagttgaaagagtaacaataatttttacaactatgctttggatagttttaagcagtatagaaattttttatggatattttaaaaagaaaagttactatgatgaagtaataaattctttaaatgaactagataaaaaatatttactaccagtagttataaaaagaccatctttttgtgaaggaaaaattttatatgatgtacttagcattacagacaaatctatgaatgaagaagtcaataaatataaatttaatcaagaagaatacagagagtatcttgatttgtgggtacatgaaataaaaactccaatagcagctagtaagctagttatagaaaataataaaaatgaacataccttaagtattttggaagaaatagaaaaagtagaaaattttatagaacaagctctttattattcaaagtccaatgaagttgaaatagattacataataaaagaaacagatttaagaaagtgtataaacaatactatcaaaagaaataaaaaattaattagagaaaagagaatttgtatagatatacaagattttagagaaaaagtttattgtgatgcaaaatggatggagtttatactaaatcaaatcataggaaattctataaaatacataggagataaaactataaataaaaagttagaaaaagaacttccaaagataactatatacacaaagattaaagataatagtctagaattatacataaaagacaatggaataggaattgataagaaggatttaaataaagtttttaacaaaggatttacaggtatcaatggaagaaaactaaaaaaatcaacaggaatgggactttatatatcaaaacgattagctcaaaaaatgtatttaggattagatatatactctgtggttaatgaagaaactactgtaaaaataacatttccaaaaagtaatatgattcaaatataaataaccttacattatcgtaagatagtcgtaaggttatcttattaattaaatcctctaaagaatataaaataaagttataaattaaaaatatggaggagataagatgagtacagttcttaaagttaaaaatatagaaaaatattatgggaataagaaaaatctaacaaaagctattaataatatttcctttgaagttgataagggtgaatttatagggattatgggacctagtggaagtggtaaaactacacttttaaattgtatatcaacaatagataaagtaactactggaaacatacaaattgaagataaggatataacaactttatcaagaaaaaatatagaaaagtttagaagagagcatttaggatttatatttcaagagtttaatttactagatactttaactgtatatgaaaatatatctttagcattatctatattaggagtaaaggggtctgaaatagataaaagagtaaaaagtgtagcaaatagactgggaatagcagatatattaagtaaatttccatacgaaatatcaggaggacaaaagcaaagagtagcttgtgcaagagcaataataaatgaaccttctttaattcttgcagacgaaccaacaggagctctagattcaaaatcagcaagagttttacttgaaaatttatctgaattaaatgaaagtatgaattctacaataatgatggtaactcatgatgcttttacagctagttattgtaaaagaattttatttataaaagatggaaaaatttttaatgaattgataagaggaaatgatgatagaaaagaatttttcaaaagaatcatagaagttgttactcttttaggaggtgacaataacaatgttatttaagctttccaaaagaaatgttcaaagaagtatgaaagattatagtatttacttttttacacttgctctaggagtttgtatattttatatattcaactctgtagaagctcaaacagctgtgatggatataacagaaaatcaaaaaactctaatggaagttacagctaggataatttcaatagtatcagtttttgtatctttcattcttggatttttaataatatatgcaaataactttataatcaaaaaaagaaatagagaatttggtatatatatgacactaggtattagtagaagtaaaattacttttatgctattttatgaaactataatagttggggttatgtctttggcagtagggctatttataggtgtatttttatctcaagggctagcttcagttacagcaaaattatttgcaatgaatatgaaaaaatatcaatttgtattttcaaaagaagcttgtataaaaacaataatagattttagtataatgttttttataactatgattttaaactttatagtagtttcaagatataaacttataaatttaataaatagtcaaagaaaaaatgaaaagttaaaaggtacaaacttaatattatctgtaatactgtttataatatctatagtttgtttaggatttgcatataaattgattttagaaaatgctcttataaacataggagatgatacttttaatttatcgatacttttaggaattgtaggaacagtattattttttagatctttggcaggattttttataaaattagttcaaaatgataaaaacttatatttaaaaaatcttaacactttcactttaagacaattaaacagcagaattaatacaaactatatatcaatgagtattatatgtttaatgttatttatttcaattggtatgtattctacagcaataggattaaaaagatctatagaaagttcgacagagcttcaaactccatatgatgtgactgctacagaattttataagcatggagaaaagacacactttagtaatgaaaaattaagtgaaatacttaaaaagctagattttaatgtaaatgattactcaaaagaatacttagattataatttttataattctcctgtgagttttattaaaatgtttgaaaatacttcagatgattttttatctagacaaataaaatttatgatagattctaatattcctattataaaactatcagattataataagttaaataaaatacaaggcaaaaaaccaatagatttaaaagataaagaagtaattttggttacaaatatatctgctatggagaatccaataaaagaatatataaaaaataataaaagtataaaaataggaaatgatgaatttaaaataaataaaaattaccaatatcaatctttaatgaatgatttagcaaaaaatgattttgtaacatttgtagttgaagataaatacgcagataaatatgatataagtcaaaaatgtttaagtttaaattatgaaggaaataaaaaagatacagaaaataaaataacaaagtatcttgaaaaaagtgaaaataaacaaattcaatatgaaaaagaccatgggtcaagcttattctttacaagtaaacaagtagttttagaaattaatatgtctaactcagctatgtttttatatattggcttatatatagggataatattcttaatatctagtgcagcagtacttgcacttaaccaattatcaggagcaacagaaagtttaggaagatacgaaatacttaaaaaacttggagtaagctcaaaaatgataaacaaatcaatttttatacaagtatttatatatttctcacttccaatagctttagccttagttcatagttattttggaataaaggtggcaaataatttaattaaaatatttggagactatgatacagtaggaactaatatatttgcagtaataagtatatgtgtaatttatgctatatacttctttggaacatataaaggatataagcgtattgtaaataaaaataattaattttaataaaaatagtattagctattagctaatactatttttaataaccacaatcatcaactttccattttgctgtcttgctatcccttattaatacccattggaaatcagagtaagttgaattaggatctaaactaccatttccacctgaagaatctacattaaaattagacattaatacaattgcattttcagcagtagccccattttcagagccacgaccacattttaaataaacatcaacaagatggtttgatttatcttcatcataccataagtcggtaagattacatcctttaaaactcttaaatttaacctttacacactctattgaatcttctatttcttttttgctaaaatttacagattttccgatagttactttaacatcattagtttcaccaacttgattacaacccactaaagaaaatactattaaaattaagctgaaaaaagatattacttttttcatataaatatatccatcctttttaagtttttattttatgattacaaagttaacaatttatttaaacataacgtagttttaaaaatatagcaatattgtataactatttttttatatttttatacttattaaatacgtatacaatatctggataacaacaacttcctttaggattatttacagcacaattactattttccattgcaccagtagattttattacttcttgtactgtactagccccttttaatattgaatctttaatgtcattttctgttacatgactgcagtaacatacatattcacctataacaacatctttgtcatcactatggttacaacaagaacatttctattttttcataaaattaattctccttatagtatatattctataaaatatatcttagcaatatataataattgtaaactttaattatattatacataatattcaattaccttatagaattagaaataaaaaatttaaaaagcaaagaaagagtagctaaggatataatcgtattgtaaataaaaataactaataaaaaagctgtttcaaactatattttgaaacagctttttttatattgttaagtcgctctcattttttatttttactgctttatcaaaaacttccccaagtacaaatcacattaaagcagaaattaagcaaatcatcattggtggagtaattcctccactatcacttcctattattgttactccacctgaaatagctgctgcattatatccgtttataaattcaaacactgtatttactaataaacagcaacccattattttaaatctttttacattctcttttacaaatggtgttataagtgtactttttattatttttattaaaaatagcaccacgattaagtacatagaaatgtagattaagtttaccatcgtattaagaattgaaaacaaatcaacagtattaaagttttgaataaccattataggaaaacctataaatccaatgcctaaaactattaataaaaaatacaatataaagtttaaaatatcctttgaaaatgtagctttcataaaaacaccccttttgataatatatttttattataaaagattatttatcgtttttcaataaatttttattgaaactaggtaaactatttatgaatgatttaaacattatatattgtttaacaaattatatagataatgaaccatttaaacttgctggaatacaagattataaaattatagaattttcgcctcattactttaatcaatcacctagtgaatggtttaaataataatttataaaaaattaattataactctaaatgaaatagtacgtattttaaaatttaacaaaagtatgtaaaggagggtatagtgaaacactatacccttttttacataccaaatatatatagatttgttgtttatatttaaaatcatcatttttatttttttatgtttgctagccaaatataaataggctaaaattatattaaaaaaagtaatttggggaatggagtacaatatggaagaaaaaataaatattttaatagtagaagacgacagcgatataaatgacttactagctgaaatcttggtaaataaaggttataatatcaggcaagtttactcaggaacagaagctttaatgtgcttagaacaagaaaaataccacttaataatcttggatttaatgcttccaggaaaaacaggcgaagaagtattgaaacatataagaaaagataaaaaaatgccaattttaataatctcagcaaaagaagaactaggaataagagcaaagcttcttagagctggagctgatgattttattgataaaccttttgaagtagacgaggtattagctagaatagaatgtaatctaagaagatatattgaatattctaatgatattaaaaacgttgaatcaataaagtacaaagaatttttaatagataaagaaactagaaaagtttttataaacgaaaaagaaattattttaacatcaagagaatttgcgattttagagctttttgtaacatatcctacaaaagttttttcaaaatcaaatctatataaaagtgtatggaaagaagagtatctaggagatgacaacactataacagtacatataagtaacttaagaaataaaattataaaatcaggaattaataaagattatataaaaactatatggggaataggctatcgaatggaagcataggtgatatttcaaataagtgaaaaataaatcttaaaaaaattaagactttttttatttttaattagatattaaagattaacattattagtaaatatcactaggagggattttatggaggattatatactaaaagccaacaaattaagtaaaaaatacagaggggagtatgtactaaaagatgtaaatataaatattaagagaggagatatatatggctttataggaaaaaatggagcaggtaaaactacaaccataagaataattgcaggcttagctaagattacaagtggaacaattgaaatttttaataaacatagcgaaacagatttatcaaaggaaagaaagagaatcggatcattaattgaaactccatcattttatgaagatatgtcagcttatgacaatatggagttactaagactacaaaaagggataccaggaaaaagctgtataaaagaaaagttagatatagtaggacttaaagatgtaaaaaataaaaaagtaaaagatttttccctgggaatgaagcaaaagctaggaattgcgatggcacttttaggagatcctgagtttttaatactagatgagcctacaaatggactagacccaatgggcattgttcaaattagagaattattaaaaaagctaaataaagaaaaaggaacaactatattgatttcaagccatttactaagtgaattgtatcagttggcaacctgttatggaataattcataaaggacatcttatagaagaaataagtcatgaagaattaaatgaaaaatgtaaaaaagcaatagaaataaaagtagacgatacaaaaaaagcttcttgggtaattgaaaacatattaaaaactattaattataaaatattaccgaataaagtaataaaaatatatgactatcttgataaatcaggagaaatatcaaaagccttattaaatgaaggtgttgaaatttaccagatggttataaaaagtgaagatttggaagaatattttatgaatttaataggaggagagacatgttaaatttacttaaagcggatttttttaggttatcaaaaagtaagacgtttagaatatgtacaatattaatgataataattacttgtgcttttacttttttatatttttcaaaagagaactttttaattattaatgggacttttaaaggagaaagactgtatggatttttcataggaaaggtaagggaaaatagagattatattaacttttttaggtcatcattaggttttacagcttttatatgtataatgaattttttcatagtttcagatacagtaatatcaaaatataataatggggtgttaaaaaatgtaatttcttatggtcatgacagaagaaaattatatttatcaaatacaatcagtagttttttaggagtattgataataagtttattgacaataagtttatctatgcttattctatgcaccttatttacaccagaaaaaaatatatctaaaagtgaacttataattatttttaaaggactaatacaattattaatcacattaggtgcaatgactagcgtatatacactaatagccactataataaaaagtaaagcattagttacatcaagtgcaattttatttacaatgcttggtagtccattattatttgatgtattaggaacaaatatcaaaaataaaattccaatatatatgcttttaaacttatgtggagatccatcagatttagaaaaatttaaagtttatataataaattcaataataataatattattagctacaactgttggctcttatatatttaaaaatcaagatataaagtgaaaaattaataagacttaaaaaataagctataaggggtaaaagatgttttggggagtattaacatttgggtttagcacagttattttatctatatatttatatttaatgaataaggaaataaaaaatatttcaaatcaattaaaaaattataattataagaacactaataagaaaatagatataaatttatttaataaaaatatagagtttttagctaaaaatataaataatcatatagatatatctaaagaacttcaaatcaaacaaattcaatcagaaaaagaatttaaaaaatcaatagctaatatatcacatgatttaagaacgccactgacttcaataagaggatatttacaaattttaaataaagatggaattgatgatgcaaaaaagaaaaagtatatagatattatagatagaagagctagagatttacaagatttattaaatgatttttttatgatgtcagtaatagattcaaaagagtatgatataaatttagaatctattgatgtaagtgaactattaattgaaagtattagcgatttttatgatgagtttaataaaaaaggaatcaatcctaaaatagatatagatgaaggtgaaaatattgttttaggagactatagaagtttaaaaagaataatagacaatttgataataaatgcaattaagcactctgaaggtgaagtaataattaatctaaaaaataaagatggagaaattatactgagtttatgtaatgaagctcatggacttttgggttgtgaagaaagtttattatttaaccgattttataaaaaagatggagcaagaacaataaatagcacaggattagggttatatattgttaaggaattgatggaaaaaatgggtggtaaagttaatataaagctagaagataattttttcaatatatattgtaagtggaaagctatataaaaataaaacactgatatttgcacaatatttaccagttccagaaactataattccacttgtttcatcaaatgagaaaatatgcaataccatttaaaaacatagcaacctatgcaatagaaacagcaggtagattaaatttagattcagaaataaagctagtactatcaggatgagtaggcatagatcttagatttatgaaaaatgaaaatatggatgagctacttttaaaagtatatcatttaattaacaaccacataattggatagaatatggaacgcaattaatttgcgttcttttttgagtgaattataatcaattaaaaagatggtatagtaaaacactataccatcttttttaattaataaatagatatttgattgtttatctaaaaatcagtatgtattttaaaaagatattttaaaggggtaacaattcattaactagatgatagacacaaatttgactatataaaaatttatgtataatataaatatataaatttatttatatggggaattactttaatttaaaacttaaaaaatacataaagaaaaggggatcttatgaaaaacaaaataatagtcggagcaattttcttatctacactgataatatcaggatgcacttcaacaaaaacagcagaaataaacgtactagcaacaaccgatttacatggaaacataccatatgaattaacatcttatgtaagtaacgaaagaaaaaaagataaaaacataaccgtagtagatgcaggagatttctttgatagtggcgtagcaataggttcaagtatggataaatattttaaagatagatcagactgcaatgctaataatactgaaaagtatatagaagctcctattgcaaaggatatgaaagatgtaggctacgatgctgtagtacttggaaaccatgaatttgtatctaacaataaattttatttagataatatgatatctgattttgaaaaacaaaatataaatgtattatcagcaaatacatataaaaaaaatggagatagttatacaaaaccatatataataaaagaaattaacacacctgaaggtactgttaaattaggaattttaggacttactataaaggaagtaggagaaagtaaagaatgggtaggagataaatttgtacctgctaagtcactagaattaaaagaccaaaagggttataatggcgagttatatatgaatgatttagtagaagatgcaaaaaaatgggttaaggtaatgaaagaaaaagacaaggctgatgttatagtagctgttgcacatacaggagaaagacctaaaaagccaaaacacccaggaaatagaatacaagatttagcacaacaagttgatggaattgatgcaatagttgcagggcataatcatgttcaaattaaacaacatgattacaaaaataaatctggagaaactgttatagttacagaaccaggtaagcatggagaatgtatttctaagataaatttaaaactagaaaaaaataataatggttgggatgtagttgataaatcaagtgagctaactacatttgaaaagaatcaagaagatgataagtatggagaatttatggttaagcttatggaagaagctgagaaaggcaaagaagttaacttagctaaaataactccttttgaatgggataaaatacatatctttaaaccacatacacctgttgaaaccgtatacaaaactgttggatataaatggagaaatatttcaccgtcatatagtgatgacatgatacaaatgatacttatgaaagataataagcctatttgctatgtatatggaaattcagatctaatgggattaaacctagactttgatgaatcagaatataaggacaatgttataacaatttatcctaacaaaaacgataaatttaaaattgaagaaggtaataaagaatttagtgttaatttaaagcatatataaaaatttaaaataatgggaatatgcatgaatgtggacacgatacgcatacctcaatgctacttggagctaatgaaaataatcaactgtttatgctatgtatacaaataatgaattacagggggattaaaaaatggaattaaaaccattaataggagtttcatatgaactgatatttcaaatatttaatacaattcttgttttagcaattttaatactaatcatatatatgatatataaccttataaacaaagttataaataaaaataaatatcaaaatagaattatagaactagaaaataaagtaaaagaattagaaaataaaataaataataaagtataaatttatacataaaaagtgtcataacttaagttatgacacttttatttaatcaattttaaactttcctattattgttttaccatcttctttataaactggaattattctaggaccttctttttctctttttttcatataagcaattgcttcttctggattattaggttggttagcttcattatataagtcaactcttcttacatatccttcaacatcatctaatccaataactgccattaaatctggttcaataatttctccattttcatcaatctcataagttccataagtatccccattttcattaacctcaattttatatatgtcaggatcaagctcaacatctttattatctaaattttttgcattaattaaataatttgtactaaaataacatcctgatatgattattgacaaaacacaaactgtatacaatttgattaatttcattagacatccccccagtttattatagcagcttattaatctaaatttgtaaatatttagaaaaatatacaaagaaaaagccttatgttatcatactatatgagagctaaaaacatacagagggggcataaaaatgtttaaaaagtcaatatttataccattaataggaagtctattaatattaacgggatgtgaaaaaaatttatcatcatataacaaaatgatggatgatggaaaagcagctattgtaaataatgactatgaaaaagctgagggaatgtttgatttagcactggagaaaaaatctgatgataaagaagcaaaaatattaaaagaacaaactgaaaaattaatagatgcagtaaaaatgcaaaaagaaaataattcagaagcagcaaaaaaattatgcaatgaaatagatagtatggatagtaaatcagatgtagttaaaaaccaagccaataaactaaaacaagaattagatagtttaaaaaatttagataataaagaagaaagttcaagtcaaaaaagtaaaacttcaaaaagtgaaaatggcatacttgcagataaaaaatacaaatacatagcaaaattaggagatattcaagatgagatagattcttatgctgaaaactatgaaactactgcagctatgagagaaggggaagctactgcactaaaactttgggatggggcattaaatgaaatatatcaagaaataaaagaaaatactaatcctaaagaaatggaaatcataaaacaaagccaattagattggataaaatatagagataaacaagctgaaaaagaatcaaaagaagctggagatggttctctttcaggtatagcttatgactctgcattagcagaacttacaaaacaaagatgttatgaattagtaaatacatatatgaaataaaaaaagaggttggaaatttccaatctctttttaaatttcatataaataaaataaaaaactaattagatatctaaatagtattgaaattaagttctgtttgttatactatatatataacaaacagaacttaatttaatatagaaaagtaaaattgcaactagggaggaatatcaatgaacgacacagggcttttggtaattatgttaccaacactattttttatgtatatatttttaataagtgtagatttcactggaggaagtagatttttttatgggtttaaaatatatggtttagctttaagtaaagaagataagcaaaaagtaatgaaaccatataaaagatgggtaagaatatcttatttaatatttataatttcaattttaataggagctttcacattaaaagataattttagaacatttatggacattatatttacgatatacagcatatttatcgaaggacttttatttataacttacactaaagttaaaaaattaagtcaaaggttaatgaaagaatcagactataaagaagaagaattaccaaagagaaccataactttagacacaagattattaaatgaaaaaataaaaatacaaaataaatttaaattaatattttcagtattattatttatatcagtattagctatagtatacttagctataaattacaataatcttccaaatttcataccaacagatttttcaggagactcaactccaacagattttgtacctaaaaacttaaaaactgtttttggtgtagaaattgctgggtttataatgataatattattaggatttatagcaatgacttgtttaggtgatgtatcatctataaaaaaagaaaagttagaaaatagtaaaaataaaatacttaagtatataaataacatagggtactctttcgtagcaataaccttatgtatagagtttgtaacaactataattcctataatagcatttaatcaatataaattacctggatatataattatcttaggaatacttatttttatgggaagtcttttaaatcttttttattcttatactatgttaagttcatttaaagtaaaagaaaaagttgattatagtagtgatgatagtaaatggatatgtggatatttttactttaataaagaagatccaactttcatagtaaaaagaagattaggaccaggatatactgtaaacttattacataaaaaagttaaagctttagtagctgtaattttactgttgtttataataaataaaatcttataaaaataacccctactaaaaaatcttaagtaggggttattttataaatttaattatttttttaagtctattacattttgaattaaagccttacatctaccgcaaccagtacctgctttagtaacttctccaactttatcaactgtatctgcaccatttttaactgcacttacaacttcttcaagtgaaacattcttacatccacaaacagatgctaatattttttcaatttcaccagcacatctaccacaaccagtagaagcacctgtcatttcctttatttcatctaaagtacgagcaccatttatcattgcctttcttatatctatgtaactaacatttttgcaatgacatattattctatctccagccataattaatctcctttttaattaatttaaaatttaaatttcacatcattataatatagtacccatatttatgtaatttaaattaaaaatatttaaaaaattttaccaattgactatataaaccactaatatataaaacttaactataagtggtactttaagcaatcacatattaaacatatactagtaatataaataaacatgaaaattataaaaaattaatgacataaaagaagaaactaggagtgagatatatgaaaatagcgatagtaatgggtgggatatcttctgaaagagaagtatctttaaaatctggagaagctgtatttaatggcatagataaaaataaatatgaagtagtaaaagtagtattagacgataaaaaagatatatttactaaaataacagacgatatagactttgcatttttagcacttcacggaaagtttggagaagatggatgtgtacaatcaatactagaagcaatggatataccatattcaggatgtggaccattaacaagtgctttatgtatggataaaaacatgactaaaaaaatactaagagattctaacttaccaacagcaccttggacagtagttagaagtgttgaagaaatagactatgaagaaatagagaaaataggatatccagtatttataaaaccaaatagtggaggttctagtgtagcaacatttttagtaaaatcaaaagacgaagtattaaatgcagttgaaaaaggtcttgaagttgacgattgtgtaatgatagaaaaatatataaaaggtggagaatacacatcatttatattaaatggagaagtattcccaacaatttctataaaagctaactcagagtttttcgactttgaatcaaaatatagccaaaatggtgcaacagaagaagtagtatacttagaagaaaaattacaagatgagataaatgaaatatctaaaggatgttggaaagcatttaattgcaaggcatacgtaagagttgatgttataataagtgatggtgttccatatgttcttgaattaaatacattaccaggaatgacacaaacaagtttaattccaagaagtgcaaaagctaaaggcatagaatttagtcaattaatagaaaaaataatagagtattctttaaactaaatcatataaaactaggcagtgcatttgaaagtgaatcatacaaaaatgaatttataaatttgataaattgaaagtcttttatagactttctttttttatgaataaaatttattaaactaaagtttgctatatataacttcctaagatttaaaattaacttttttttaaaattttaataaaaaatagcaaaatagttacatatttttacaaaaattgggtaaatattacatataaataaatatagagtcacataaatataataaaaattaaatcctttttagatgacaatataatttttaggaggtaggacatgttaaacgaaaatgacaaagtcaaaaaatctatgaaagacatagaagaaaaagcaaaagaatttaaagaatcaacaataaaaactatggaaaatatagaaaaggatgttaaagaaactttagaagcttctgataaagaaagagcagatatagttgatgaaatgatgacaccatttgaagaagatgaagatgtcaaaaaagcaatagaagaaatagaagaaaacaacgaaaatgaaaaagatataaatgaagaacctaataaacctgaagaaggaataacttatggctcagtaaaatataacaaagggaaattagaatataaaccttgtaaaatagttaaaaacttagatataacatctaaaataatattagtattagctgtaatatctatggtaataatagcaatgcaaaaacaacctgtactaggtacatttggtcaatacacaggatatgaatggcaacctatatctttagcatatggacttataagcggatttagtggatacgtattttacatattagttaatgctgcatctaaattaatagatgatataaataaaaatagacaattaaaagaatttgaaattttaagtaaattacaagaaaatgaaaacaactaaaatattaagttttaaattataaaataaacttaataaaaaaatcttggaatatataattatgtatttcaagatttttttatttacttacataataactttagtttttcaatatcaactatctttataacacctcttgaaagcttgactaaattatctttttcaaacctttttagcattctactaataacttctctagcagaacctaaatcatttgctatactatcatgagtgataaaaatatcacttgaattatttaagtagtattgatttattaaataatttgaaagtctattatctaaactaaaaaacactacctgttcaagtacattcattacttctgataatttattttgagttagattgagaaagaagttttgaacattaatatttttacttgaaagatctttaaaaaagttactatcaattataataactgaggaatctctttcagcttcaaggtttatatcgcatgtaagattttggaatacacatgaagctgataacatacatatatcaagatcaaacaacctaaataatgttatttcttttcctgaatatgaagataaaaaacttctaagctgaccatttactactaacaaaactccagtacaagctttatctttagaatatataaattcacccttactataattttgtatataacttgaggaaaaaagtttttctacttcatttttagataaatctttgaaaaaaggtaaattattttttaaatatgattctttatttatatttttcataacatcacatcctaacttacttaaattctatataaaaaatacttattagtatatatttatttaaaatcatttatataaatttattgtacttaacttatatattaacttattaaaatatatattttatgtgataatatcacagaatgaaaatatctattatcataatataaattatgtcttaaaaatataaattaaaaggagatataaaaatgacaaaaccatcagtatatcatagtcaaggatacacatgtgcagaatcattaataaagtcttataatgaagaatacaatacagacataccaatatcaataggaagtggcatgggagtaggaatgactgttggaagcatttgtggagctgtaaatgcagcgattgttataataggatttttaaaaggtagaaatgataaattagatgaaaatgaagctagaaaatattcaagagagttaatgagtaaggttagagaaaaatatgatacagaaatatgtaaagatttaaagagaaataaaattggatgtgaagaaataataaacttcacatatgattctttaaaagagatattagaaaactaaaattatttatatacaaggtgatttttacaatattagtagaaatcatcttttttagtttaaagattataaaggttattgattttagcgtatatagcaatagcttaggttatttttacttgttattactatatacactaaaatcatatcatatttgtataatagcctttaacaataatttaaaaaatttttctagttaactgaataagttactaactcattttctctgacattttctaaagagaattccattgtatctatatggttaaaaacacgtaaatataattttcctaaagtttggtcatatgcacacatataacttgtaaaatctgactcatctttatcttcagaaaaacgtacagctccccttggaacccaaacagaatttaaaatactaaataattgacttggagcttcttcatcactaacttctcctataagatttcttaaatatgctgcacgtacaaatcttgatggtgaagtataatctcctggtaatccaagcatacctgaaccatttgaaattggtgtaattactgtattattatttaaatgattttgttgtctattaaatccttgtacttgaatataatttcctaaattagtcatatgccaatcgaatgttggattattagtcattacacctacattattatcaaaaactctaaaacgtccattatttgttggttctaatacaactgaattacccattttatctgtaaaagtataatgggcagttataggatttcctttacctaactctcctaatgaaggaatatcatcaccagtaacggcaacttttgatatattttcttttatttcattaacactttcaaagttacttaaaatccaaggaattatttcaccactattaatagctgtaagtccttccttttctatattatcttttttatcccatgtacatgcatttaaaaataaaagtcctccagcaagccctttttcatttactccatcaaaaaataaagtagagtttgataaagttatacctaaaaaagcatattttgttttccatgggttactttgtgtgtctaaagtgaaatttttaggaacaatagttacttttgaatcaacatcaaatggattaaaagaagtatctaaagttcttccccaataaaaattatttttgttacttgaaatgtgaacatgtgtacacatttaaatcatctcctatcaagttattataactttttgcttagtatttttatatcctaaattatccatttcaaacagaaatcaactaagtaactttaagtgaatttttaaaattgctaattttttcataacatcactttgggattgataattctattatttaatttagctaatattaattattaagcaaagtattaatatctttttattttatttatttgaaaaattttctaaaatagtgtttaatttaatcaaaaaaaggtatatatctaatatagaaaactaaacaaatcaaatcttagattaaaaacagatctccttaaggagataaatatcctaagagcttaaatgctatttgcagtgagactctaaatgggttaattatttataatagagaatctaaatttgatttatttagttttcttttttatataactatcaaaatgtaagaaatgtttaaggttcctgcaagtcttttttaagattaagcatatatgattcattgtttgcaaatgaagattttaaaataggattagttataaataacacactacataatacaaataaaacaacaactaactttttcatatcattacctcttttcaaatatataaattatttatatataaatattaccataaactctttatattataacagttacaggcttgttacttaaggttactaaattgtaataaaaaagcatgtttaaaacatgcttttttacttatttatcgatttatatttataatctatatagttacctaaatatatttttaaaactcccataaaaggagctgaaagtatcattccagggattccaaagaatcctccacctatagtaactgctaatatagttaaaaatggattaagaccaagctgaccaccaactattttaggttctataaatgcaatttcaatttgttgaactagtattaaataaattaatgaaaataaagctatactagggttataaaataaatttattaaaacaatagtagtcatgcttattgcaggtccaaagtaaggaatcatattcataaaaactattaagataccaaatagtaaagcatattgagatccaataaaataaagtcctatacttgataaaattcctactataaaagagtctagcatttttcctgtaaagtattttccgatattattatttaaagtatgaccaaagtttaacacaaaattagcatgttttttaccaaaggtaatatataatacttttttataaaaagagaaaaagatttctttttcaagtataatataaaaacaaattataaaggctaacacaaactgtacaataaatttagaaatagaaaaagtagttgcaaatatttgacctaaatatccaataaataaattactgactttaggcataaaagagaatgctttatctccaatttcttttaatgtattagggtctatattttctaagttattgccaagatgaattaagaaatcttgagtttttgctgaataaataggtagtttatcaattatatcagctaaactatttactataattggaatagtaaagaatatgaatgaagctattataagtattaaacacacataagttataatcaatgcataaattctttttatttttaatttagattctaaaaaaacaacaataggtataaaaatataagctagtataaaagctataataaatggattaagcagtgatactaataatttgaatatatctaaaaagtatttatagttatctataagttttataagtatataagatacaaaaatagtaaaaacaattcctaaattaatctttttatctttcaaatacacacacccctttaataaaaattaaatcaatatatgtattatacaataaaagtattatgaatatatataataatggaaacaaatgttaaataaatttgattaaaatcgtctttaatttttaagggggtgttttttatagagtatgaagtaatagttagatataatggagatatttctatagttgcaagcgagttaggtgtatctgtagaattattaggatataactatgcaataataacttcagatagtattgaatcaattgataacttggtcaattatcctcaaattgaatacgtagaaagaccatttattttaactacacaagatgttcaaagtttttcaagaacaggaatatcaagatttaaaaatacaaatggattaactggaaaaggaactataattggaattatagattctggtatagattataatttagatatatttaaagacgaacaaggtaattcaaagatactttattactgggatcaatcatttccaggaaatccacctgaaggatttacacatggaaccttatacacaaatgaagatataaacaaagctattagaagagaaattaacatacctatatctccaactagtacacatggtacacatgtatcagggattgcatgccaagtagcaaatgaagctaatttaatagttgtaagagttggaagtattcaaacagatgtattttcaagaagtacagaatttatgagagctattaaattcatattggataaagcactagagttaaacatgccagtagccataaatataagctatggaagtaatgaaggttcacatagagggttatcattatttgaacaatatatagatgatatgacatcattttggaaaaataatatagttgtagcagcagggaataatgctgataaaggtggtcatagaaatatacaattagataatcaacaggtagaagtagaatttgtagttggagaaaatgagaaaatattaaatgtaaatgtatggccagattttacagatgaatttagtctatacttagttaatccttctaacttaagaagtcaagaaatatccttaacatcaggagagattagaaatgtactaggaggcactaggataagagggtatttttatccaatttcaccatactcacttgttagaagacttacaattcaaatgagttcagataataatattagccctggtatatggaagttagtttttactccaataaatatagtaatgggaaatgttaatatatatctacctacatcggaaggtataagtagagatacaagatttttagaagcaaataaaaatttaacagtaactgtaccaggaactgcaagcaaggtaataactgttggaagttttaattcaagaacagatatagtatctatattttctggagaaggagatattagcaaaaatgtgctcaaaccagatttattagcaccaggagaagatatattatcagtacttccaggaggtagtgtaggagctttaagtggaactagtatggctacaccacatgttacaggtgtagttgcacttttaatggagtggggaattgttaatagaaatgatttgtttttttattctcaaaaaataagagcatttttaataaaagaagctaaaagaaatgctttatatacatatccaaataattctatgggatttggaatgttagacttatctaatgttaacctagtcaacatgggtcaattcaaccaaagttatgatttaatttatagaaaaaagagaaaaaaaaaactagaaatttaagattagaattaccatacgatttaataaccttattccaagtagtacatggaccaaattttaaagaagaacttgaatctactggattagaatatatttattatgaaattagtgataatgaatcaattttaggattacatactaaagataaccaaaaatttagaaaattaattccagtaaaatcaatacaattttttgagttgactgcagttatgaatcaattaagcactataacaaggggtactgaaaatggtattgtagctagagaggaaataggtgcaaattttttacaaaataatttaaacatatctgttactgggaaaggtgtattaatagcaataatagattcaggaatagattatttacatgaagattttatatatccagataaaacttctaaaatagtatttttatgggatcaaactaaggatgaaaatccacctagtgggtataaatttggaactgagtatactagagaagatataaatcaagctatagcaaataatgatactactttatcaaaagatgaagatggtattggaacaatgttaagtggtatatgtgcaggtcttggaaatataaatagtcaatatgctggaatagcaccagatgcagaacttatagtcgtcaaattaaaaaaaataaatggaaattataataacgcaatattagaagctgctatacaatatgcatatgaaaaagcttacgaattaaaaatacctttagtaataaatatatctttaggaagtaataatttagtaggtgctactgagcgtattttaagagacactccactatttacaagaggtttatgcttagtttctccagtgggaaatgaaggaaatactcaaacacatacatcaggaagacttaactttataggagaagaacaagatatagaattagaaatatttgaagatgaagatttattagatattaatatatggatgaataaacctgataaagcgagtgtggcagttatatcaccaagtggagaagtaagtaaatttataaaagtatcaaatttcaatgagataacaggtatatttgatttagaagcaacttggtatgtgataacttatagatatccaactgcttactcaggtcagcagcaagtaacaataacattaaaaaatgcaactaaaggtatatggaaaataagattaagaggtgaatatataaccaatggaatatacaatgcttatctaccaaataaagcattaataaatcctggaacaaaatttagagattcaatcccttctcaaactgtaaattatccatcaacatataatgatgtaatttctgtaggtgcatacaatattattgataatagtatatggccttcttcatctaggggtcctactataaatggattattaaggccagatatagttgcacctggggtaaatataatttcaacgtatcctggaaatagttatgcaaccataacaggaacagcagtagcagcagctcatgttacaggagcagtagctttatattttcagtatactttagctgataggtattacactcaaaaggcatttactaccatggttagaacttaccttcatgggggagctagaagaattcaaggaataacatatccaaatgaaatttatggttatggagagttagatataagagggtcctttgatcaactaaaataatatataaataggaggaatttttattttggaaaaatcctatcttataatttaccaaggaagtatagaagatgtaactaatgatttaagaaataattcaatagaaagatttatgatattaaatgataatttattagttatatatgttcctattgatttttatgaaaatacactaaatgaaattataagtattgcatggtggcaaaggtcagtacctatgagttctctaattgaggtaaccaatggtatagaacaaggtgtaagtgtaacggattcatcaggaacggattatatatataaaaacccatatataacaactactggaaaagatgtattaatagcaataatagattcaggcatagattatttgcatccagattttagaaatgatgataacacgactaaaatagtatcaatatgggatcaagaaagtgacaaaaaaacacctccagatggattaatatttggaagtgaatttactagagaagatataaataaagctatatctgaaaatgataacacattaagtgaagataaaattggaactggtactatagctgcaggaatatcatcaggcaatggaaaattaaattctcaatataaaggtgttgctattgatagtgaattggtagttgtgaaattaagggaatatagagatacttatgcatcaggaaaaataaattatcaaaaatcagattttttagctggaataaagtatgttttagatgtagctaaaagggagcgtaaatttattataataaatctaactataggtttagcatcaaagtctataatagaattaacaatgctagaaacatttaacgaaatagtagaatcaggaattattgtagttagtggggctggaaatgaaggaaatacagatattcattatgaaggcatattaacaaatgtaaatcaaaagcaagatataataattcaagtaggagaacaaataaatttagatataaatttagtaactagtggaccagataaaataggtgcattaataatctcaccatcaggagagcttagctatcaaattatgtattctccagattattatgtatataaaggacgatttaatttagaaaatacaacttatgagatgcgatttgtatatccttggctagaatctggatatcaagaattaaatataaatctatacgacattaaaccaggtatatggactttaagattaattccagaatttattatagaaggaatatatgatgtttatttaccaaataaaaatataatgtcacaggaaactagattttcagatccagcgtctacgtctacaataacgatgtatgcagctccggaaaacgtgataaccataggagcttacaatgataaaactgatagcatatggataggatcatcaaaaggtcctataaagaaaagaggaataaaaccagacatagttgcagcaggagtggatataatagctccttataaaaataatagttataatacatcaataggaacgggagttagtgcctctatagttagtggagttttagcactaattattcagtatataaaagatgaatatgagttttatcaagggtctttatatacacaacaattaaaaacctatctaatgcttggagctacgaaaaaggatatatatacttatccaaacatatctcaaggatatggaattttaaatttaaaagatactatcacagcaattgcaaataattttgaataatgtgtattttataacttagaatgtaaaaactaatacaaaagaaaagaggtgaattatcttggaaaatgaaaaatgtaaagcattaaatgggtcagataacaaaagattaaaatctaatagaccagtaaaaaatgaatatactgctgcttggtctggaactgaagatttaaggtcagaaagcaatgtatcaattccttcactaagaaatgtagaagaagctaaagattgggttgacaacggaagtagattataatttaaaatagatacctaaaattttattaaaattttaggtatctatttttatgaattattttattcacttggaataagtatatattcacctgactttaatttataatccttagatactatatcaggatttttcttatacacaacttttctaaaatcttcgatattttctatattagtattataaaatttaattatatcatctaaagtttggccatattcaacaaagtgttttacaagatgtctattatccataattttatcataggcatttttatatggaatttcagaaattttattaaaaatagatacatttttaactaaataatcaacggaagtatctaaacaagttatatagttataaaaacctgattttaaagcttgagaaaaagaggtacactcattagcacttggacctataaataataatactaatacaaaaattaataagtatttcaaaaaaacacctcctaattaaaattattaataaaaaaatataaattaaacatatttgataaaaaattttaaaatatataaattttataaaaaataaatcgttgacttaaaaaatataagttggtataatcttagtaaataattcaaataataactataaagacattgaagagaagagtaaatataaaaggtagttaaagcgagttgaggatggtgagagctcaatacgaaatttatattgaagaacatctcggagtctctaaccgaaattaattaaagagtaggcttagacggaaggtcccgttatagaccattaagcaaagcttagctaagtggcctatttaggcaattagggtggtaccgcgagagtaatagtcctttcgtcccttttagggatgaagggatttttttatatttaaaataaaatttataggaggatataaaatgcaaagagaatttactgaaattaaacaactttacagaaacaaagaagaatatatcggaaaaactgtaaaagtagctggatggataagaacatctagagcttctaaaaactttggattcatagaattaaatgatggaagtttctttaaaaatatgcaaattgtaatagctgaagataagttagaaaattttaaagaaataacaaaacttccaataagttcatctatattagtagaaggtgaattagtatctacagaaggtgctaaacaaccagtagaaatacaagctactaaaatagaaatagaaggtgaatcagatagttcatacccacttcaaaagaaaagacatactttagagtacttaagaaccatagctcatttaagaccaagaagtaacactttctctgcagtatttagagtaagaagtttagctgcatatgctatacataaattcttccaagatagaaactttgtgtatgcacattcaccaatcataacaggaagtgactgtgaaggtgcaggagaaatgtttagaataacaactatggatttaaataatatacctaaaaatgaagaaggtgcgatagattattctaaagacttctttggaaaagaagctaatttaacagttagtggtcaattaaatgctgagataatggctcttgcatttagaaatgtttatacttttggaccaacttttagagctgaaaattcatttacacaaagacatgcatcagaattctggatgatagaacctgaaatagcatttgcagacttagaagataacatggaacttgcagaagatatgataaaatatgtaataaactatgttatggaaaatgctccagaagaaatggaatttttcaatagctttatagataagggattaatagatagattaaataatgttgtaaattctgaatttactagaataacttatactaaagctgttgaaatgttacaagagtcagggcatgaatttgaatacccagtaaaatggggagatgaccttcaaacagaacatgaaagatatttaacagagcaagtgtttaaagcaccagtatttgttactgattatccaaaggatataaaagcattttacatgagaatgaatgaagatggaaaaacagtaagagctatggaccttttagttccaggtgttggagaaatagttggtggttctcaaagagaagaaagatacgatgtattattagaaagaataaaagaaatgaatcttaatgaagaagattactggtggtacttagaacttagaaagttcggaacagctactcactcaggatttggattaggatttgaaagaattataatgtatatgactggtatggcaaacataagagacgttataccattcccaagaactccaagaaatgcagaattctaataataaattaatataagtgaaaaatagcgagctttttctcgctattttttatatattaatttattatataaattttatttagactaatataagaatataatatacactaaatttcagactgtagacatgtaaactttattagaatataatagtaataaggttaaaagctaaatgttaatcaggaggtatcgatatgtcagatgatagaataatagattttaataaactgaagaacaaagtaaaagattctgatgttgataaatttgaacaatatatatatagtctttatagttctgttatgtcaggaaaattaagtatggttgaattttctaaaaagataatggattatatgaaggaaaataatatatctcaagaaaaatttattaatattcaaaagaaatttatggagagatatggaatggactcgtctgaaatagatagccagttaaaaaactttggtatagattataataatatagattttaatgaaataaataattcgaattttgatgatataaaaaatagtataggattttatgataaatatagtcaaaaaataaaaccaaaggcttgtgtagagacatatataaaaaacgaccataatgatataaaagtaataatagatcaagaacaagtaatcctaataagtaagggtaaaataaatttagttgatgcagaattaaatgaacttttattatcttacaagaatatactaaataaaaagataaatataattatgtgcgaaaatacaactgaatatgattattaaaaaagagataggattaatcctatctcttttttagtgttctgaaagaccactttcactaaatttaccattaaataccttataaattttatttataggtttctttagtggtaatgcaattaataatgaaactattatatatatacataagatgcttatatctttatataatacaggataataaatcccacctattgattctcttaacatagatattgcataagtaaacggtaaatatggatttaccatttggaaaaacttaggagtaacttcaattgggaatgtcccacctgaaccagctacttgaataactaaaagtattattcccatagctttacccatatttccaaacacagataaaagagaatatactataaaagtaaatacaatacttgtaaatacagaacctaatacaagaagaactggatttacagattgaacaccaagtatatatatgtctcctaaacttactattagtgcttgaattacagcaatagtggtaaaagtaagacctctacctaagtatacttgatatggtttataatctccatgaacttcagctgataaaagtgaagataataaaagtaaaccaacccataaagataaaacagtgtaaaatggagtcatagcagaaccatagttttctatagggtataatttattttgattaacagtaacaggttcttttaagaagttcttttcttttactatgtcgtttttaagtaattttactaaatcatttaagtcttcttgattattaactttctttatagcatctgtaagttcgtctactatattttctactttaggcaatttctcttttgcataatttattccttcaatacctttgtcagacagtgaaaaagccgtatctaatatactttcagctttaggtaatttagactcagcatcttctaaagttttgattacattatcactaactgaatatcctttttcaaagatattatttataggagcagagattgcagaatcaaaattattagataaattagatgtaataccttttatatcatttcctacttttaaaactttatcaagtgcaccagatgcaggtgtttgaccactttgaagttgaccttttaaactatttaaagagttaactccttgtgtcacacttgaatctatatcttttaacttgtttatagtattagttaaaggatgatttggtgtaagtgaatttaacttatttaaaaattctattaatgatttatttacatttgataaattatttaacttagtagataaattatctgctaaagttagagcatcatcagtaccattactaatagaattatttaatgcatttgcagtattaacaacagaattagctatatcattaattacagatatatcattttttattattggagtaatgctatttatactactttgagagtttttcagaaactctttaacatcagatgataaacttttagatttatttaaagtttcttttattaaaggaatatccttttttatgtctttaactaaatcttgaactttattagctccatcagatgctaaatctaatgttttatttacatcaccaaatttgctttgaatctcaactaaagagttttctatatcagttaattttggaatttgaccttcaagttctatacctaattcattagaggcttcaaataaaatttgacttacagtttcaacaacagtttgatttatttgtagttgtattgttgaagctcccttatcagtgattttaggagctatagcatttattttttcattaactgtataaattaactttccttttttaacatctgaagttataagagaagttaaatcttttgaaaagtcacttggaatttctattgaagcatagtatgaaccatctttaacaccatctagtgctttctttttactaacgaacttccatcctaaatcactattttctcttaagtttttttcaagctcatctcctatattaatgtgcttatcttttacggtagtacctttatcattatttacaacagctactgatatattactagtactaccatatggatcccaagatgcttttatattaaaccatgcatataaagatggtaatatacaaagtgctcctacaacaataagcattgcatagttagtaaatatatcctttacgtcttttttgaatataccaagtatatttctcaatataatattcacctccaaaagtaagaattctaatgaatttaaattataatgtttttaaagttaaaagtcaatattaaagttaaaatatgtaatacagaattaatattatatagtaattataaccaaattaatttaatatattagcataaaaaaatagtccatgtaggactattttttatgctaatataagtctagctaataatgttataattggtagtgatattaaagttctagttaaaaatactataaataaatcttttaagttaaaaggtatatctgactttagtataactgcaccagtctctgttaaatatataagttgagttatagataaagcccctattataaatttagttaatatatcaaaagtatctgctgaaaccattatagatggaaggaacatatctgcaaatccaactaaaacagctggagcagcttctacagcattaggtatttgtagcagttttagtataaatactacagggaaagatatccaattaaatattggagtaaattcagcaacaacaagtgctaaagttccccatgccataacaagtggaagtaaagctaaatacatatctataacagttttaaatccattttttattattacttctaaagaaggcgcattttctgctctatttaaagctttagataaagcaaaatctattacgttttcgccttcaggtattaaatcttcttttagatgatctacattttgatatgtttcatccttaatttttgctagaggatatatacgaggcattataatagcacaagctaatgatgctatacacacagttccataaaatggaacaaaaagattcataagtcctaattgatcagctataactgtagaaaatggtaatgatactaatgagaaacaaacagatattatacaggcttcttttgcagtataaaaaccttgtttatattgtgtattagttatcataatacctaaagtaccatctcctaaccaagatgagatagcatctactgcagcgcgtccaggaactttaaaaattttatacataaacttagatattaaagttcctacaaaatccataagtccaaaatcaacaaccaaaggtaataagaatccagaaactaaaaatatagctaaaaggctaggtaaaacacctaatatagtttgaccagtaacttcagatttaataaattctggaccaaaaccaagcactgtcatagaaataaataaagcacctaatattctaaatgataaccaaaataaaggcacatctaaaacactttttaaaaaatcattttttatatttatgaatttacttaaaatagatagtatagcagaacaaacaattactacaagtgctatatgatctagataatttgcaaatgaaattttaagaagttcagctaaaaatccaatacctatatttatagaagatataccttcaataggtataaatttaccatagggaagtggtattacaaataaaagtaacccaattaatgatggtattaaaaactttaaaaaactacttgatttattttcattgtaaatatcaatatttttctccataaaacaatatctccttttaagtatttaaattataaatttactataaatgcatttatatttaaaattaaaaaagtcccttggctaaaagccaagagacgaatattttccgcggtaccactctggttgatagaataaatataaaattctatccacttaatctcttaaggcgagaaaacctatagtcatacttagtttcaaactatattctccaaagctctcttcacttaaatttcaatgttaagcttccaccatccttaactctctataaaattcacttaagctactctctttttcacagaatttttaatatttagtttatattatcgtaatagaaaatatagatattgtcaataaaaaatttataaaaagttttaagaatttaaagaaaattaatctaaaagaattttaataaaaaataaagcatagtatataatggtaataatcatatgttttggagggatgtttttgtctattaattatgaaaaagcagttgaacttttagaaaataaagaaattgaaaaatcaaagcaatattttttaaaagcatatgaagaaggatttaaaaaatcatcatattacttaagaaaaataagaaatgaacaaaacaattttattaaaaatacaaatgattttaagtatgatattataaaaagcaatttgggatatgaagttgaaataccaaatcattttaagaaaatagatactataaatgataagtgttttgataccataactttagaaaaagatgaaaattttgagttatacaatataaaaactcaaggatttttaatagagataccaagtgaatgtgtagatttaatttctatagattcaatcataaatcatatatcgaatatagatgaaattatagaatacgaaaatgaaaaaattagtggaaagattgtaaaaacaagagctctagatggcataataagttatactttaatgacagttggtaaaaatggaatatatgaatttaaaataaatgtagatgaatttttggaagaacagtataaaaatgtaatagataagatgtttaatagtttcaatattttaagtatataatataaaaaactatatgtttaaaaaatctaaacatatagttttttatattaattattattttttaaattttctatctcatcagctaaattatttaaatattcccatctttcatacttgtattcaagatctttttctaaagaagctttttcatcaagcatttcttgaagttttgtaaaatcagttgaatacttatctaaattatcatcaatagattgtattttatcttcaagtaaagctatatcatcatctatagtatcaaactctctttgttcattaaaagtaaattttagttttttattatttttaggtttttctttttttacagagttagaagatggtttaacctcaatattttcaatctgaataggttgactttctttatacactaagtactcactgtaatttcctgtatatatattaatatttccaagaccttcataagcaaatatcttattacatattctatctaagaaatatctatcatgagaaacacatataacaacaccaggaaactcatctaaataatcttctaatctatttagagtttcaatatctaaatcattggtaggctcgtctaaaagaagaacattaggtgcactcattaatgttctaagaagatgaagtctacgtctttctccacctgaaagttttcttatatgagtatattgcatagttccatcaaataaaaatctttcacacatttgagatgcagttactttttgtccatcagaagtttctatataatcacttacttcctttacatagtcaatagcgcgcatatcaagattcatatgagaatcatcttgtgagaagcatcctatttttacagtttctcctatttcaatatgaccactatcaggtttaagtttaccatttaatatatttattaaagtagatttacccataccatttttaccaataatacctattctatcagtacgagaaagagcatattctaaattatttataatttttttatcaccgaaagatttagatatgttatgaatttctattatctttttacctaatctactagatgcagtagaaatttctaaattatcttttctataagtaggtacatcatttacaagttcatcaaatctttgaagtctagctttttgttttgttgtacgagcacgagcgcctcgtcttacccatgcaagttcagttcttattaaattttgtcttttttgctccatacttgattctaaggctaatctctctatttttttctcaagaaaaactgagtagttgccatcataactaaaaagtttacctctatcaagttctattattctattagtaactctatctaaaaagtatctatcgtgagttatcataagtagtgaaatatttttattatttaaatattcttctaaccaatttatcgtatcattatctagatggtttgtaggctcatctaatattaataactcacatggagttataagagcagaagctaatgaaattctttttctttgaccgcctgatagttcagctactttttgattaaaattattaacaccaagttttgttaatacagtttttgcttcactttctaaatcccatagtttaaggctgtcaattttatcttgtaattttatcaattcattatttaaagaatcattatattctaaacttaatttatctaatactttttgataatcacaaagaagcctcatttcacttgaagttcctttaaagacttgttctaaaactgtggcactttcgtcgtaatatggattttgaggaagatattctatcctaactttatttggttttgttatatttccactatctgtttcttctacacctgctattattttaagcaaagtagatttaccagtaccgtttacaccgattaaacctattttgtcaccttcatttattcctaaagatatattattaactagtattttttcagagtaactctttgttatattttctaatgtaattaaattcatgttaccacccttattgttattttaatttactaaactattataacagtttttagattatataggaattttaaataaaaataagatgtagctttgtttaaccacatcttatttttttaaaacttttcttttaattttttttcttttttttatgtaagatctatcaaatgtatctaaaattttagattctgtattattttcttcttctaacttagccttacaagatatccttatttcagaagctaaagctaattcttcaccaagagctactaaaaatgatcctaatattcctaagttttcatcttcatctatttcttgagatattattgatgcaaatatagctactaaaatcatatattgatttgcaaaagtattacaattatcataataatttgtttttttaggcatagtacctcctttataattataatatatgattaaaatataaatgtgacacttgaaattattaaagaataagaaacatatttatataatatatttgattataaagaaacataatattaaaatagatataagactagataacatacatattgaaaagtggtgatgtagatgaaaaaaattaaatttatatacaatccaaattcaggagataaaaaaataatctataagctagatgatataatatcaaaatttcaggataatggatatatagtggttccatatagaatatctaaaaataatacaatggaaaatggactagaagatataaatgataattatgaatatattttagtggctggaggagatggaagcatagatagattagtaaattatatgaaaaaaaataatataaatttacctatagcaatacttccaacaggaacagcaaatgattttgctaatgtacttaatataccactagatattaatttagcaatagataaaataataaattctaagcctaagtctatagatttaggtataataaataaagattattttgtaaatatagcaagtactggtatgtttacggatgtgtcacaaagggtagatgaaaatttaaaaaattcaataggaagagtatcatatattataaaaggaatagaagatgcacttcatcttagaaaatttagtgtaagtgtaaaatcaaaagagttagaatatgaaggggatatgtatttaatattaatactaaatgggagaactgcaggaaatataagtttagcacattatgctatgctagatgatggtttattagatgttataatatttaaagctatgccaataccaaagactattccgcttattttagatattataaaaggtgcacctatagataagtataatgaaataatatattttaaaactgatgagctttatataaactgtgaagaagacatagtaacagatatagatggtgaaagaggaccaaattttcctttgcatataaaatgtgataaacaaggaattcaaatattaggaattgaatagttatattactaaaatccacattgatacatatgtggattttagtttatacttatgatagaaattatggtttaactttagaaaaaggagataaatatggaaaaattatattataaagatcaatatataaaggaatttaccgcagaaataatcgatataaaggaaaaagattcaaattttcatatacaattagataaaactgcatttttcccaggtggtggaggacaattttgtgatagtggaaaaattgacaatcatgaagttatagatgtatatgaagaaaatggtgtagtttatcatgttacaaaaactaagcctataaagatacataaagtaaagtgtagtatagattgggaaaaaagagaagatgggatgaatcaacattttggacaacatgtactttctggatgtttttttaaactatttaatgcaaatactgtagggtttcatttaggaaaagaatttagtactgtagatatacaagggatgttgactgaagaacaaataagaaaagctgaagaatttgcaaatgaaataattgaaaaggacataatggtggaatttttaactccagatagaaaagaacttaaaaaaatgggattaagaagagatttacctaaaacaaatgaacaaataagagttgtaaaaataggagatttagatataaatgcatgttgtggagttcatccaagatcaacattatctcttagaatgataaaaataaaaagatttgaaaagtgtagagatgctataagaatagagtatttagctggtaaaagagctatagattacagcatagaaaaagatagatatttaaatgaaatatgtagatatttaagttgtagtgataaagaagctataaaaggaattcaaagcttaaatgataaattaaatgaagtcatatataaaaataaaaagatagaagataaaatatctaattatcaagttaaggaaatgacagattctgcagataaattaggtgaagtttctttagttagaaagatttatgaaaatgaaaatgtaaaatatgtatcaaaagtagtttctaagttagtagaaaatgataatactatagctttaatgggagttaaagatgatgataaatcaagttttatatttgcatcatctaaaaatcttaacaaattaaatatgaatgatttattaaaagatgctataaaattagtagatggaaggggaggaggaagtaaagttttagcccaaggtgggggaaaagataatggaaatgttgaatcagttttaaattatgcatctatgaaaattgaaaatatattgaaataaaaaatagagtaggaatttcctactctattaatatatttttaagtttatctatatcaagtaactttacgtaatcattagtatattcaattaaattatcatttttcatattaataaattctctagataaagatggtctaggaacgcctaagctttcagccaattttgttttagttttaggcatttttataaaattacttttttgagatgtatattcatccaataaaaaacttgcgattttttgtctaatacttgtaaaagaaacagttttaacagctttattaagttctattatcttattagttatatcatttaaaaaagaaactaatatttctttatggttagagcaaaaatctataaaatcatatttatctataaacataacttcacttttagagttagaaataactgtagcaggatagatatttacatcagaaaaagttatgacttctccaaataaattaccgacagaaaatgatgaaatcagtattactttatctccaggtaaaaatcttttaatatcaacaccacctttaagcaccaagccaatagatgtacatggatgaccttcaagtgcaattatgctttctttatcataattttttattgtatatttagaatctttaaataaatctaatatttcaactttagttaaatttttaaacatgtcatcaccttatattttagttttttagatatattgtatatcaagatgatacttttattcaatagaatatgaatattaaataataaagtattaaataagaataaaaaataattaaaaaaatttttagtaatcaatgaaaaaaaataagagatagttgcatgatatataaatcaattagtaaaaaatcataacttacaagttgatttaacaagtatttgataaattatattttaacagtatgaaagattaaattttgaaaatttcaaattttaaaacccattatgcatagggtgtaaaaggttggtaaaaacgattgcaatgtatatgatagatatgtaataattttagtggagagatatttaaaaggggaatttttttagttattttaaagtaaatatataaaaagcttatatatttactttaaaatttatattaattaatgtatagaatctctaatgaaaattatttaaaaattactttagagatgaaagaatagggggatttaaaatgtctagtaaaaaagaagaaattcaagctggatttaaaaaatgggaagaaagtaaggttagtaaatctatatctagatttccagaaagaaaagaaagatttgaatttgatacaggacaagagatgaaaaggttatatacaccattagatgcagattttgattatgaaaatgacttaggttatccaggacaatacccatttacaagaggagttcaacctactatgtacaggggtaagttttggactatgagaatgtatgctggatttgctacagcagaagaatcaaataaaagatataaatatttaatagatcaaggatctatggggctttcagtagcatttgatcttccaacacaaatggggtatgattcagatgatgctatatctgaaggtgaagtaggaaaggttggtgtttgtatagattcactagcagatatggagatattatttgatggaataccattagataaagtatcaacatcgatgactataaatgcaccagcatcagtacttttagctatgtatatagcagtagctgaaaaacaaggagtaactcctgataaattaagaggaactatacaaaatgatatattaaaagaatacgtagcaagaggcacttacatatttccagtaaaaccatcaatgagattaataactgatatatttgaatactgttcgaaaaatgtaccaaaatggaacactataagtatatcaggttaccatataagagaagcaggttctaatgcagttcaagaagtagcatttacattggctgatggtatagcttatgtcaatgcagccatacaagcaggtttaaatgttgatgactttgctccaagattatcatttttctttaatgcacacaacaacttattagaagaagttgctaaatttagagcagcaagaagaatatgggcaaaagttatgaaagaacgatttaaatcaaccaatccgaaatcatgggcacttaaattccacactcaaacagcaggatgtacattaacagctcaacagcctgaaaacaacatagttagagttgcaattcaaacattagcagcagtacttggaggtactcaatcactacacacaaattcaaaagacgaagcactagcacttccaacagaagattcagtaagagtagcacttagaacacaacaaatagtagcacacgaaagcggtgtagcagatagcatagacccactagcaggttcttattatgtagaaagtttaactaatcagatagaaaaagaagctttaagattaatagaaaagatagatgaattaggtggagctccacaagcaatagaaaaaggatttatacaacaagaaataatggatagtgcatataaatatcaaaaagaaatagaaaataaagatagaataatagttggagttaacaagtttgaaatagaagaagaagcgccaaaaggtctattaaaagttgatcctatggttggagaaagacaaaaagaaaagataaaagaacttaaacaaagaagagataatgataaagttaaagagactttagaagctttaagaaaagcttgtaattctgatgagaatataatgccatatatattagatgcagtaagagaatatgctacattaggagaagtatgtggtgttatgagagaagaatttggtgaatacaaacaagcggttatgatataaggaggaaatttatatgagaccaataagagtattagttgcaaagcctggattagatggccacgatagaggtgctaaagtaatagctagagcattaagagatgctggtatggaagttatatatacaggacttcgtcaaactccagaacaaatagtagcagctgctatacaagaagatgtagatgtagttgctatgagtatattatcaggagctcataatcatttattaccaaaggttgtagaattattaataaatgaagaagctgatgacatattagtaattggaggaggcgtaataccagaagatgatattccttacttaaaggaaaaaggaattgctgaaatatttactccaggaactccaacatcagtaactatcgagtttataaaagaaaatcttaaaagagcattagcttaaaaaggagaagttatgaaagatatagtgagaagggtactagaaggtaaaaaaagagattgtgctagacttatcactattgtagaaaatgaacaaccgggatatgaagaggctttaaaagacatatataaacacactggaagggcttatgttataggtataacaggtcctcccggtgcaggtaaatctactctaactgataagttagtaaaattaataagaaaagaaaataaaaaagtaggtataatagcaatagatccaactagtccttttactaaaggagctatacttggagataggataagaatgaatgatttaaatacagataaagatgtatttataagatctatgggtactagaggaagtttaggcgggctttcaaatgcaactcatgcagccataaaagtgcttgatgcttatggatgtgattacatattcatagaaactgtaggtgtaggtcaatcggaaattgatatagtaaaaactgcagatacaacacttatggtaatggttccaggactaggtgatgatatacaagctataaaagctggggttatggagattgctgatgtatttgttataaataaagctgataaagatggtgcgaaaaaaacttctttagaaatagagatgatgctagattttaaaaaaaattgggattttagaccacctgtaagtttagctatagctgaaagtggggatggaatagaagagacttttgaaaatatattaaaacataaaagttttttagaggaaagtagtaaattaaatgaaaacagattagaaagaaatagaatggaggtcaaagaattagtacaaaaaaaagtatataaattagttaaaaacttagaatacacaaaagaagttgacgaattattatataagactataactaaagaaacagacccatattctataagcaatatgttatttgaaaaaattacaagataatttaagggggaagtagtatgaatatattaagagttgatcatgtgggaatagctgtaaataatttagaagaaactttaaaattttatgaagatgttttaggacttaaatgtgaaggtacggaagttgttgaagatcaaaaagttaaagttgcgtttttaccagttggagatacagaacttgagttgttagaatctacttgtgaggatggaccaatagctaaattcatagctaaaaacggtggacgtggaggcatacagcatgtagctgttagagttgatgatatagaaaaagctatagaagatgttaaagagaaaggatataaaatgatcgatgaaaagccaagatatggagctggaaatgcaaaaatagcattttgccatccaaagggaactgatggggtattattagaattaagtgaaagaaaataactagaaaataaaatctttgggggtggttttatgtcacaagaaaaattgaatttactttatgaaaaaagacgaaaaatagaagaagggggaggacaaaagagaatagataaacaacatgcatcaggaaaattaacagcaagagaaagattaaacaaattatttgatgaaaattcttttgtagaactagatgctttcgttaaacatagatgtataaattttggtatggaaaaacaagaaataccaggagaaggggtagttacaggatatggaaaagttgatggaagattagtatgtgcatttgctcaagactttacagtacttggaggatcattaggggagatgcatgctaaaaaaatcggaaaggttatggatactgcattaaaactaggggcacctgtagtaggtcttaatgactcaggaggagccagaatacaagagggggtcgatgcattagctggatacggagaaatattttataaaaatacaatagcgtcaggtgtagttccacaaatatctgcaataatgggaccttgtgcagggggagctgtttattcaccggcattaactgattttatatacatggtagatcaaacaagtcaaatgtttataacaggaccacaagttattaaaactgttacaggggaagaagtaactgctgaagaactaggaggagcttcaactcataatacaacttctggagtagctcactttatagcttcaaatgatgaagcttgtataaatcaaataagaaaactattatcattcctaccttcaaacaactcagaaaaagcacctatagttgagtgtgaagataatccaaatagaaaaaatgacattttaaataatataatacctgaagcttctaataagccttatgatatgaaagaaataatatatgaaataatagataatggagatttttatgaagtgcaatcattctttgctcaaaatataataacaggctttgctaggataaatggtgaaagtgtaggaataattgcaaatcaacctaaagtaatgggaggttcacttgatataaatgcttcagataaatcatcaagatttataagaacatgcgatgcctttaatataccaatacttagcttagtagatgttccaggatttttaccaggaacttctcaagaatatggaggtataattcgtcatggtgctaaaatgctttatgcatatagtgaagccactgtaccaaaaataacattaataacaagaaaagcatatggaggatcttatcttgcgatgtgttcaaaagatttaggcgcagatatggttttagcatggccaactgcagaagttgcagttatgggaccaagtggcgcggctaatataatatttaaaaatgatattaaaaatgctaaagatcctaaagaaatgagagaattaaaaataaaagaatatacagatgaatttgcaactccgtacaaagcagctgaaagaggatatatagatgatgtaatagagccttcattatctagaataagaatatcagatgcaatagatacattagcatcaaagcgtgaagatagaccgattaaaaagcatggaaatatacctttataggaaggtgaataattatgaatattagccaattactagaagcggtaaaagatccttcatcaacactttcaatgggcgaaaagttattagcaggtgttagtgttgcagtactttcaatggcagtagtttttattgttttagttgtaatagctttaattatagctatattacaaagagatggaagtaaaaaagttaaagaagacaatatagaacttataaaacagaaagaagatgaaataaaagacgttaataataatgaagatttaggggagttagtatctgtaataacagctgcaatagcagcaacaacaggaaatagcactaataatatagtagttagaaaaatacaaagaagtaataatactaaaacaagttgggaaagaatggccaaaaatactactaagtaagtaaaacagggggaaatttattatgataaaaaaatataatataactgtcaatggaaatacatatgaagtggaggttgaggagttaggaatagaagcatcaactacaagacctcaagcaaataatcaaacaatacaaccaaaaccacaaacagcaccaaaacaacaacataatccacaagcaggagcagtttcaggtggaagtattttagcaccaatgccaggaactataaatgatgttcgtgttaaagttggggataatataaaaaaaggtcaagtattacttatacttgaagctatgaagatggaaaatgaaataatggcaaattctgatggaacagttaaatctgttaatatatcaaaaggagcatctgttagtgtaggagatgttttaataactataggttaaactagaaaattttaaaagggggacttacccgtgggagaagttattaataattttattcaatcaatgggtattgttaatatggactggcgacaaattgtaatgattttaatcgcttgtgtattattatatttagcaatagcaaaaggatttgaacctttactattagtgcctatagcttttggtatgttacttacaaatcttccattagcaggtgctatgaatacaccagtatcctcaataagtgatctttcgctaacaactgattcaattaatggatcaattgcgacaaaatctccaggagggttactatattatttatatcaaggatgtaagcttggtatatttccaccactaatatttttaggtgttggagctatgacagattttggacctatgatatcgaatccaaagagtatattattaggagcagcagctcaatttggtatattttttacatttataggagcattagttttaggatttacaggtcttgaagcttcttctataggaataataggtggagcagatggacctactgcaatttatttaacaacaaaattagctccacatttattagcacctatagcagttgcagcatattcatatatggcattagttccaattatacagccgccaataatgaaagcactaacaactaaagaggaaagaagtatagtaatgacacaatcaaaaccagtatctaaaaaagttaaaataatatttccaatagtagtaacaattgttgtatcattattactaccatcggcagctacattaataggtcttcttatgtttgggaatttacttaaggaatgtacagttacagatagattatcagatactgcaactaatgcacttatgaatatagttactatatttttagggttatctgttggagcatcagcagaagcggaaatatttttaagtgctcaaactataaaaatatttgctcttggaatagtggcatttagtataggaacaggatcaggggtagtttgtgctaagttaatgaataagttcactaaagataaaattaatccacttataggtggagcaggtgtttcggcagtacctatggcagctagagttgctcataaggttgctcaagaagaaaatccaagtaacttcttacttatgcatgctatggctcctaatgtagcaggagttataggatctgctgttgcagcaggtatactattaagtttatttggataagatatagaaaggatatgattaatttcatatcctttttatattataaattttaacaatatatagtataaaaataagttaagtattattgttataggtataaatatagtaaacttaggatgtctagttttatgcctaaaaatgtacattcccatatatgtacctatcccacctcctaaaatagacaagtttataagtgtagcttctggtatcctccattgacctttaattgctctatttttatctatgtacataagtaaaaaagttataatagacataataataaaataaagtgttaaaaatttcataacaatcctcctagtaatattataatataagtaaaaaaataagagtcagattattttttgtaatctaactcttattttttttatatatattcttagaaaggttattatttattgtattaaaatttttattagcattattaatatttgaagaattatttaatataaaatcaatctttttcaacagttccttaccgacaatataatttttatcttgtctatttgatttacttgaggttaataaatatagcataaaagtcctcctaaattaatattattaaaatgattgactagtattttattaattattcaataaatatgtatataataaaaaatttgtataaaacatattaacaaacatacaaaagtacaaaacgtgagtacaaaattacaaatacatattaaatgtaaaacaatacaatattagtataaataatcaataagaaggggtatgattataaactatgtctaaaaaacttttaggaatggaattaaaaagattagaagattgtagtgggataaatacagcaaaagaaatagttcaacaacccagtacatggagagaagctgtaaaaaatttatataataataaaaataatataaaaatatttttagaagaatttttatctaaagataattatagaattatattaactggagcaggtacatctgcatttgcaggagaaacatgtgaaccttacttaactaatatattaaataaaaaagtagaagctatagctacaacagatttagtagcaagcccaaaaaattattttataaaagatataccaacacttttaatatcttttgcaaggtctggtaattccccagaaagtgttcatgctgttaatttagccaatgaacttgtagatgagctttatcaagttgtaataacttgtaatgaaaatggcaagttagcattaaatactagagaagatgaaaaaagtttattgcttcttatgccaccacaaactaatgacttaggatttgctatgactagcagctttacgactatggtactaagctgtataggaatttttaacataaacaatataaatgattttactaaagatgttgaaaatttatcagcatctgttgaaagatttatagaaaataatatagataaaatatctaatttaacagatgaagattttgaaagaataatttatttaggatcaggaactagtaaaggtatagctagagaaagtgctttaaaggttttagaattaacagctggaatagttaatgcaagttatgatacacctttaggttttagacatggaccaaaatctgttataaatgataaaagcataactacaatttatatatcaaatgataaatatactagattatatgatattgatttagctaaagaaattttagcacatagaaaaggtgacaaagttgtactggtagggtgtgatatagaaaatagtttaaaagaaaaagcggattatgcatttgatttagaaaaaataaattatacagtaggtaatgaagcattacttccacttcagcaaattgtctttggacagatattatcatttttaaaatcagaaaatttagggataacgccggataatccatgtccaacaggtgaggttaatagggttgttcaaggtgtagtaatttataatttataaaaaggaggaaataatatgagtttaatatcaactaaagaaatgttattaaaagctcaaagagaaggttatgcaatacctgcatttaatatacacaatttagaaactatacaagtagtgcttcaagcagctagtgatttaaaatcacctgtgatattagcagcgactccatcgacagttaagtatgcaaatgaaaattaccttttatctataatagaaaaagggagtaagttaaatgatatacctttaacatttcatttagatcatcatgaaaatgtagaagatataaaaaatataataaaacttggttgtaagtctgttatgattgatgcatcaaaatatgaatttaggaaaaatgttgatattgttaaagatgtagttgattttgcacatgagtacggggccacagttgaagcagaacttggaaagttaggtggagtagaagatgatttaaaagtagatgaaaaagattcatttttaacagatccagatgaagcttatgaatttgttatattaactggagtagattcattagcagtagctataggtactgcacatggtttatataagagtgaacctaaattagattttgaaagattggaaaaaataaaaagtttagttgatgttccgcttgtgcttcatggggcatcaggggttccatatgaagcagttcaaactgcgatagaaaaaggaatttgtaaagttaatatagctacagaacttaaaatacctttttcaaatgctataaaagaatattttaatgaaaatcctaatgcctcagatccaagacaatatctagtacctgcaaaacatgctatgtatgatgtagtagttgaaaaaataaaaatgtgtaagagtgaaaataaagcaaatgataacagttataacatttaatccatctatagatagattatataaattagataaatttgaaattggctctgtgcaaagagccaattttgttaatccaacagcaggcggaaaaggattaaatgtagctaaagtcttaaaaaaacttggggaagatgtaaattgtataggttttttaggtggatttaacggtaaatatataaaatcggagttagataaaataggaattaaaaataatttcatacaaataaaagaagagtctagaatttgtttaaatataatagattcaaataataaaagtactgagattttagaaagtggaccaaatataactaaagaagaaattgatgaatttgaaaattatttgagtgaagttttagaagaaactgaaatactagttgcatcaggaagtttagctaaagggttacctaaggactattacttaagaataggaaatttatgtaggcaaaaaaatataaaatttatattagatagtagcggagaaagcctaaaattaggtattaattcaaaaccttatcttattaaaccaaatattgatgaacttgaaaatttaagtaaagttaaaataaaaaatgtagatgatattataaatacatctaggagcatattacttacaggtgtagaaaatgtttgtgtatctatgggaaaggatggaatggttttagtaaataaagattttgtatacaaagtagaaatacctaatataaaaattgtaaatactgttggaagtggagattctagtatagctggtttctcattaggcactttaaaaggatatgatttaaaagatactttaaagctatcaaatgcctgtgggatgtcaaatgcaatgcatatatcaacaggagatgtaaatttagaagatataaataagtttatagatgaaatcaaagtatatgagtatgtttgtaatgtttaatatacaaatatagggggagaatctatgtattatatcggtgtagatggaggcggaactaaaacgacctttactatgatagataaaaaaggttataaaatagcacagtataaaactaaaacaacacactatgaacaaataggatttactggagttgaagatgtgctaaatgagggatttaataaaattttagaaatatcaaatgtatcaaaagatgatatagaaagtgtttttctaggattaccaggatatggtgaagtaaaaagtgtagcaacaaatatagataatattgtaaaaaaaatattaaaagagataaagtttaaagtaggaaatgatgtagaagtaggtttagctggatctttagcaggtaaagaaggaataaatatagtaagtggtacaggatctattgctcttggtaaagattcaaaaggtaagactattagatgtggaggctggggagattatattggtgatgaaggttctgcatattggataggtaaaaaaactattgagatgttttcaaaagaagctgataaaagaattgaaagaggtttaatctataaaaatataaaagaaaaattaaacacaaatgatgattttgatataattgattatgttttaaatgatattaaaaaagatagaactcaaattgcacagttttctaaattatgttttgaaagtgcaattttaaatgataaaaatgcattaagtatatttaatgaagcaggctatgagcttagtttacttgttaaaatgataataaatgaattagaatttaatggtgatatattagtttcatattcaggaggagtatttaaaagtggagatttaatattatcaccacttaaaaaatatttaaatgaatataatataaaatttataaagcctatattaggtcctgacatgggatcttgtttattagcatataaattgagcaatgaaaatataagtgaaaatattataaataacatggttaataatttagaatataagtttgtataaataaaaaattgaggagtttaaactcctcaattttttatttatacataaatttagcatatgcagtagaaaaaatgtaaaaataaaattttatatagatatctataaagtatagtttaattagctgatttccttggaaataagagtataatgagttttaatatttttaaataaagtatataattttttatataaataaaataaaatttatataaatatcttaaataaaagtataagacaatattaatttaaatatgttaatattagggtataaatctatttagaaaaaaggtgaagatatgaaagcagaaattataacagtaggaactgagatattattaggggatattgttaatacaaattctcaatttttagcaaaagagttagctagtattggagtagaagtttattatcaagaaacagtaggagacaatgaaactagattattaaatttattagaagaagcttttaaaagaagtgatatagtaataactactggtggattaggacctactaatgatgatataacaaaagaaattgcagctaaatattttaaccaagaattagttttttatagtgatatatgggaaaatataaaatcctattttgaaaaattaggactaaaaccaactgaaaataataaaaagcaagcttactttccaaaagattgtattatagtagataatccaaatggaacagctccaggtgtaatattaaaaaaagaaaataaaatgataatattacttccaggaccaccaaaagaaatgattcctatgtttaataatagtgttaaaagttatttacaaagtttaactgactacaaactagtatctaaaacgttaagatttattggtataggagaatctgaattagaagagaaattaattgatattattaatagtcaaagtaatccaactatagccccatatgctaaagaaaatgaagttactcttagaataactgctaagtctaaagatgatgaaaaagcaaatgatttaataaaatctatagaggacaaaattaaagatagagttggtaaatatatatatggatatgacgatactactttagaagaaactgtagctaagttattagttaaaaataatatgactatagctgtaagtgaatcttgtactggaggcatggtttcatcaaaacttatagattatccaggtatatcacaaagttttattgaaggatgtgtaacatattctaatgaggccaaaatgaatagattaggtgttaaaaaagaaactctagataaatatggagcagttagtagtgaaacagctatagagatggctgtaggtatagctaaaaacttaaatacaaatattggactttctacaacaggagttgcaggaccaggaggaggtactgatgaaaaaccagttggattagtatatataggtatttacataaatggagatgttaaagttaaaaaatgtaatttttcaggaagtagagataaaataagaagtagagccactaatgaagcattgaatttacttagattagaacttttaaagtaaaaggagtagacaaatgataaaatatatattttgtgatttagatggaacattataccataatggaatatcaagagaagatgctaattctatagaaaatattgaaaatgaaggcattgtatttaatatagctacaggaaggatattttctcaagctgtaagaatgacaaataatgatataaatatgaatggatattatatatgtgaaaatggttcatatatatatgatagtaatcataatttagtttttaagggaactatagatgataatatagtaaaaaaagtaatagctgagtttgattcagatatagcaactatgtattttaagtttaatggaaaagttgttttattagaagaaaatgatttctttaaaatttatacgaatgagtatatagtagataaagaattttcaaataaagatacttacgataatttagtaggaaatataggaatagtttctcaagatatagaagagttatatagactagagttatttttaaaagaagaatttgatgaagttttagatatatatttttcatcagagcatactctaaatttagtacctaaaggagtatcaaaacatgaagctataaaaaaggtatgtaaaatattaggagcaagtctagatgaagtagctacaattggagattctccaaatgatataagtatgcttaaaactacaaaatatagttttgcaatgataaactctagaaaagaagttaaagaaagtgctaactatattgctaactctgtaagtgatgctattacaaaaataaaatatataaataaagaaatttaacacataggaggaatttatgaaaaaaatattagttttattagctgatggatttgaagaaatagaagctttgacagttgtagatgtattaagaagggcagatgtaagatgtgacatgtgttcaatggataatgattatgtaaaaggaacacataatatacaagttaaagcagatgtaaatataaatagtatagatataagtgaatatgatggtgtagttttaccaggaggattaccaggagcatataacttacgtgataatcaaaaggtaaaagagcttgttcaaaattttaatgaatataaaaaaataatagcagctatatgtgcagctcctgaagcattagaaagctttggtatattagaaaataaaaaatgtacatcatatcctggatttataaaagataaaaataagttagattatatagaagataaagtagttgttgaagatagtaatataataactagtagagggccagctacagctatagaattttctttaagtatacttaaaaaattaggttatgaagataaatatatggaaattaaagaagatatgatggtaaatttctataatagttgtaaataaagaaataaagtaggtttaaatttaaacctactttatttctttatttatatgttttcgaataagtctacttgccctagattgagatatatttagagctgtagcaagtttataagaactaggatgattttcataggctttttctattaatattttttcatagttattcattaatatatctaatgaactgttatcatcattttttattaaactatcatgacttaaaactgattttggcaaattatctatatctattgtatcagaatttgaagtaactaatatattttgaattatattttcaagttctcttatgttaccaggataatcataatttaataaagtatttataacttttgtagacatagttttatttaaattaaaagatttagagtattttttaaaaaaatgaaaaataagttctaataaatcttctttacgatttctaagtggaggaatttttagttctacaacatttatacgataatacaagtcttctctaaattttttttgatttacacaatctaataaatttacattagtagcagatataaatcttatatctacttttttagtttttactcctccaacagatataaaagttttatcttgtataagttgtaaaaattttgattgtaattcagatggaatatcgcctatttcatctaaaaataatgtacctccattagctaattcaacaagtcctaatttaccttttgaattggctccagtaaaggctcctgattcataaccaaataattcagattcaagtaaatttggagatatagtagagcagtttatagttataaatggtttattagctctagggctatttaagtggatatgcttagctagtgttgtttttccacatccagattcaccgagtaataaaacgttaacatcagttttagctacatttttagatatctctaaaattgatttcatactatttccctttatagtagtatcattatatattaatgattgagaattacttaaagaatctattttgtttttatattctttaagctgatgtttagtatgtttaagactattttttatttcatttaattcacttatatccctagaattttcaactataaaatctatactaccatttttgttaaatacaggcgttgcagttattataagtgattttccagttatagttttttgctccatagatactttttttccatgtttaactacataaggaattggtgtttgatttgagtaaccagcttcgtttaaaaacatagcggttttacctatcatttcgtgtctattaattccataattagattcgaatgctttattgcaataaaccatatatccatctttatcacatacaaatatctcatcatgtgaagcttcaagtattttttcaaagaagtcattatcatatatcaatttcaaatacccccaaaattactattatgtataaattaactttattatagtatagtgataagtcaaaatcaacttaatatctaattgagatttgtggatttataaatatataagtcgaaatcaacttggattaaattgatatataagtcaaattagacttattatatatttaaagtattgaacttatatgagatttcaacggatataaagtgaatttatattggcatgagaattgctttaataaaaaagtagaataacttaataaaagggggtaagaaaatgaatcaaaaaagtaaagggtatttatttgtagtagttgcaggagtttgttgggctactatcggattatttgcaaattctttattaggacatggattaactccagaacaggtcgcatttttaagattatttttaggattttttgtattatttatttatagttgttttaaaatgccaagtgcacttaaaataagcaaaaaaggtttagcttattgtataatggtaggcatagtaagtcaagcagggtttaatatgtgttattttaattctatagattctataggagtatcagcatctgcagtacttttatacacttcacctttatttttaacttttttatctatagtaatatacaaggaaagacttaataaaattaaaataatatcactggctgtttgttttatgggagcaatattggctgttacaggtggaagtttaaatttaggtcaacttaatatgaatggtattttactaggaataatgtctgctataacatatgcttgtatgtctataataagcaaaggtgcacttaaagaatgtgaaggtataacattattaatatatggatttttaattggatctatattaatgatacctctagcaaaaccttttgaattaatttcatatgcaaatgatatgggtgtacttactattatgttagggttaggtattataccagctgctgcagcatatatattctatttaaatggaatatcaacaggaatagatttatcaattgctggaattttagcttcaacagagctaattgtatcagtaattataggatggacaattttaggtgaatcattttctgttggaaaattaataggggttatatttatggtattatcagcattaatagcaattaaaaaacctaaatccaaaaaaattaagcatagtgtaaatgagaatgagttagaaccagtaagagtataaacaaaaaggcttaataattaattattaagcctttttatatttaattccttggtaagaatctctatcacgcatagtatcgtctattgcatttaaaacttcccatttttttaaactccacataggacccaccatttcatctcttttaccatcaccagtaagtctatgaacaatcatttcaggaggaagtatttctagttgatcacaaactaaatttatataatcatctttttccattaatgtaagtgtattattatcaatcattttttccataggagttccttttaaaacatgaagtaaatgaatttttattccatgaactccaaggtcagctacagctttagctgtttccatcatcatattataatcttcaccaggaagtccgtttataatgtgaacaactgtttttatattatgtttttttaatttttcaacaccttctaaaaatgtattataatcatgacccctatttataatcttagatgttttatcatggatagtttgcagccctaactcaacccaaagattagtttttttattaagttcagctaagtactctaaaacatcatcaggaagacaatcaggtctagtagatatagataatcctataacgtcttctaaattaagtattgtttcatatttatcttttaatacatctacaggagcgtgtgtattcgtaaaggcttgaaaataaccaatatactttgcattaggccattttttgtgcatcatttgttttatatcttcaaattgcttaattaaattgtcatttgggtttccagcaaaatctccagatccttgtttactacaataagtacatcctccataagcaatagtcccatctatattagggcaagaaaaaccagcatttatagataccttaaacactttttctccgaaagtatttctaaggtaataattccatgtatgataccttttattatcaaaggcatatttaaaatttgtcaagttaatcaccttttctttagttattattaaatttactatacaatattatcataaaaaatatttatacacaaatcagtaattatttaaaaaaataaaaaatagtaccttaatataaggtaccacttttataatttttttaatctatttccaatagataataattggaaaccaattaaaactaatattaatgataagaatgtagctataaacccagataagaataagggagatactattaatagtaatccgcagattaataaaaatccattaaatccattgaattttatataaggattattttttcctttaattagtagcataagttgatttacaacaagaaatgcaccaagtatagaagaaaaaaatccttgtactttttgagggaatacaaaaaatagtatagctacaattagaagtattatttgcttatctatatacggttttatattttcctttgattcatatcttttaagctcatttatagtttttagatttaaatatgctaaaaataaagtaatagcacctaaaccaaatgataataatttaatacctacacttctaaataataaagatatagttccaactactaatagaattattcctaaaattataaagttatttgcattttcttttttattaaagctattaaagctaaaatttatattcatatctatcacctctttaattattaaagtgattataacaaaaatttaataagtataaaatagtttatttaaattttatataaatttgtaatgcaaaaaggacttgtatcataaaattttattatacaaaggagggagttatttgtcacagatagttgctatattatttgctgtattagcaggtggatcaactgcattagaatcttttataaatggagaattaggaaaaaacacatctccacttatagctacatttataagcttggttgtaggtgcaatattttttttaataagtatttttttaacaggtaatacgaattcattgttagatttaagttctataagtcctaagtttttacttggaggtatatttggaggatttataatatattttacaactaaagctataccaggattaggattatctaatacattaattgttatcgtagtttctcaaattcttataggtttttttatggatatagtagttttaaaggaacaaactatgcatttatataagtatataggtgctatattattgtttataggaacattttttatagtaagttaatatatatctaagatatatatttggcaaaataatcatatatgataaaataaaattaaaatacatattaagagaggtttaacagatgaataataaatttattatgtcatttagtggaggaaaagacagcacattagcattatatagaatgataaaaaaaggatataaaccattagcacttttaacaacaataaaaaaagacattgataaatcatggactcatggaataactaataaattactagaaaaagttagtgagagtttagaaataccacttttgaaagtagaatgtgacgtatgtgagtatgaggaagaatttgaaaaggcacttttaaaagcaaaaaaaatgggagcccaaatttgtgcatttggagatatagatatacaaaatcataaaaaatgggatatagaaagatgtgaaaaagcaggccttaaagcagaatttccattatggcaagaaaacagagaatcattggtttatgaatttatagatagtggttttacaactataataaagactgtaaacttaaaatatgtaagtaaagatttattaggaaaaaaacttactaaaagtgtggttgaagaaataaaatctactggtgctgatgcttgtggagaaaatggcgaatatcatacatttgtaattgatggacctttatttagaaatagtatagatttcaaaagtaaaggcatagttatagaaaataattatggacacttagatataatataatgtaaaagctatcttaaaattaagatggctttttatttttagtaggtaaatataactatgggaattatgtaaaatagtaaccattatataaaactatatttacgctaataataacattacaaacactaaattgacttaagaaggtgacactatatgaaatcatctaaggaaattaaattttttattttttttattataactatgttaatagtattattaccaaatgatgcttattcaatgcaaaaaaatgaaaaaatacctaaggaagttattataggaggagaacttttacatcttgagttaaatactaacaaagtaataatatttggagttagcaaggattctttgcttaaaaattatgatttagtagaaagtgtaagtggagatatagtgagaaaaatgtttaatcaagaaaatgttaaaataagatctaaacaagatttaatacagttactaattactatgaaagaaaaagacaaaattaaattaaatttattgagaaatgataatttaattactgtaaacttagacaagtatcaaataaatcctactaatttaatagataaaattccttacacagctacattaacatatataaatcctaatgattataaatttaagtctgtaggacataatatagatttttataataataaaactatattaaataataaaggtgaaatttacgaataagtaaaaatgaaacagaacttatttgcatagaaaaatttataaataataataatccaaataaaattttagatagtatcactaaatttttctataattctcaagtaaaaaaaagatttaaatatatagtaagtgatatagaaacaaaaataaaaaaagtggatgatcatttataaatcatccacttttaagcgtatatatctgaaaattctacatctatcttttgtacaaacttttcttttaaaattgtttcatctattaattctaacttatttttatataatttattaggtatattgactataaactcgctaccttctcctaatacactttttacctctatacttcctttatgtaactctactaatgatttaactaaagatagacctattccacttcctactttactatttacgcttttatgtttaacttgcttgaatctatcaaatattttatgtaagtaatgttctggtattcctattccttcatctttaacacttatttttatattatttttatagtctttaatagttacttgtatagttttacctttttcattaaattttaatgcattggacaataaatttaaaactattctttccatcttatctaagtcaaatcctataattttttcttctacatccgtatcaaatattatattcatctgattttgattagcaaaatcgctaacagaatcacatatactttcaacaaactttactatatcataatttttaggattaaattctacgttttcataagctaatttagtagagtcaattatattatcaactaattttaataacctatacccattttgctttattatagttaaatatttatcatctttttctccagttttattatttagaatattatacctataatttagcatttgaacagaactaaatataagatttaatggtgttcttaattcatgtgctatattcgctaaagcttctgatcttattttttctatatcttcttcatgtttttttctttcatttatatttctagctacacctataactcctaaagcatctccagattcagatattattggtgtttttatcgtttctagatgtataatttctccgctatttaaggtaaccttttcataatatgttttagtagtcttagactccattacttctaaatccttaagcctataacttttagaatttatgtcaactacaggtaattctccatcagttttacctattatttcacttctgtcaagttttattaatttatctgaataacttttattgcatccaatcaacttactatttttatctttgtaaaatatataatctggcacagcatccactagagtttgtacaatttttaaattttctagttctttattttctataatccataatacatatctatctttatatactgacgatatagatattttataccatccacctaaggaaggtatatatgaatcttgatcttctttcccttcttttaaatttttatctaatattccaggtattacatcttttatactctttccctctatgtcagcaaattctaggtttaataattcacaaattttatcatttaagtcttttattataaagtcagtaaacatttcattttcatctttttcaacctttccatataaatatggaaaaggacatgtctttaatacttcactacaaaacttaaaatttagcatatccccacccctaataaaaatactctaattaaattatagcaaggttatatataaatttcattataaaattgttaatattgttaatattttgttagtaagtctgtggattacttttttgcattataattttataatttaagtttaatatttattttattttttatcatttaaaaacattttccttacatatttttctttataaatgcaataaattgcctcctagtcctttatttttttctcaatttgaattaaaattattaataatagtaattatataataataatacaaatttaatagataagaggtaacgaatatgtcaaatgaaaataagtcatcaaactttataagaaacataatagttaatgatttagaatctaaaaagcacgatactatcataactcgtttcccaccagaaccaaatgggtatttacatattggtcatgctaaatctatatgcttaaattttggtttagctgaggaatttaacggtaacgtaaacttaagattcgacgatacaaatcctgttaaagaggatgtagagtatgtaaactctataaaagaagatgtaaagtggttaggttttgactggactaatttatactttgcttctaactactttgatgaaatgtatgaaagagcagttttacttataaaaaaaggtaaagcttatgtatgtgatttaaatgctgaacaaatgagagaatacagaggttcattaacagagcctggtaaggaaagtccttatagaaacagaactgttgaagaaaaccttgatttatttgaaagaatgaaaaacggagaatttaaagatggagagaaagtattaagagccaaaatagatatgtcttctcctaatatcaacttaagagaccctgcaatatatagaatttctcactctcaccaccacaacactggtgataaatggtgtatatatcctatgtatgcttttgctcatccattagaagatgctatagagggaatcactcactccctatgttctttagagttcgaagatcaaagacctttatatgattgggttgtagctgaatgcgaaatgcctaaagttcctcgtcaaatagaatttgcaagacttaaccttacaaatactgttatgagtaaaagaaaattaaagcaacttgttgatgaaggtgtaactgacggatgggatgatcctcgtatgccgactatagcaggtcttagaagaagaggttatactccagaagctataagaaatttctgtaatgaaataggtgtagctaaagctgattctactgttgatagccaaatgttagattactttgtaagagaagatttacaacctaaagctcctcttgctatgggtgttttaaaaccccttaaattagttataactaactatccagaaggccaagttgaaatgcttgagatagaaaacaatgctaaagatgaaactaaaggaaagagattagttccattctctagagaaatatatatagaacaagaagactttatgatagaaccagttaagaagtacttcagactattccctggaaacgaagttagattaaaaggtgcttactttgttaagtgtaatgactttataactgatgaagagggaaatgtaactgaaatacattgtacatacgatcctgaaactaagagtggttctggatttactggacgtaaagttaaagcgacaattcactgggtagatgctgcttcttgtgttccttgtgaatttagattatttgaaccattaatattagatgatgctcctgaaaatgaaggtaagcatttcttagaacaaattaatcctaattcacttgaaattgttcaaggtcttgtagaaaaaactgctatagaaaatgctaaacctcaagataaattccaatttgtaagacatggattctttaatgtagatgataaatatactactgaagataagttagtatttaatagaatagttcctttaaaaagctcatttaaacctaaaaagtaattaaaagctccctatagggagcttttttatatctcaaaggttgaattatctataaattttatatctttatctaaatattttatatcctcaactaattttaataacgctaaatcctttttcttagcttctatcataatatcaaaatttctattactcttttcttttgctaagtatataaaattcataaaacttttactatctataaaatctgcatgttttctatcattatcaaattccttaggacttgaaaaatgaatttttggaggtaattcttcattcttccaagtatcaaaaacctcatttattatatcacttaatttttctccatcatttttacatatatgatgatgaacatctaaaaccataggtaattttacactcttacatatatcaagtacatctctagcactaaatactttatcatcattttctaaaatcaacctacttacaacctctttaggaaaatactttaaattatttacaaatcgcttaatactctcttcttttccaccttgtgaactacctatatgaattaccatttttccatttttataattgatatcatcaaataatcgactttgaaattttaaactttttatagtattttctacaacctcatctcgtaaactatttattacattaaattggtctggatgcgtatcaaccctcatattattatcttttataagtttgcctatatactcaaaatcttttttgaaatactttctatattgaaagtttacttctggatgtgtccctaagggaatcaagttagatgtaattctataaaaatgtatattattattaatattatatcttaaaattttttctaaatcttctatatttgatcttgtaacttccttaagtttatttactctatctatactattatttaatttagtatatctagcataagttaatgtgcttgatgaagttacctttggtaaatttaaagctatagctacatatcctagccttaccttcatataattctcctttcaaatacaaatttatagatttagcttttcctttaaagccaagattattacaaaaaagaaccctataaatttatagagttctttatttattatactaaatatttatttactatttcatttacttcatcttcattttgagataaatattcataaaactctaagttagagctttctattgcttttgacatatcatataagaagtttggcacatcttttcttaatatatctccatatactttacctaacttagttttatcttctcctacgcatcctcccatatgaagttcaaatgcatcttctgttttatcattaactctttttttcttaccagcaaatcctataggagatacttgatgtgttgcacaagagttattacatcctgaaatgtgtattcttggtaatgtgtcacttgtatagtttttctctttcaaataagctattatttcacttaaagtatcttgactttctgctatacccatctgacaaataggcactcctatacacgctgtactttgttctattttatattttccagtcatgttttcagttaaatctaaaactattttagcttcttctccatttaaattccttatatagaatccttcactcatagcaagtcttatttctatatcatccatatcttttacagtatctattattttatctaaatctgatacttttaattgtccatttactggatgaacataaactgaatataatccattttgtttttgactaaataatctattgtcttttatattagattctataccctttttattatattctttaggagttaagtttaaatctaaattgcatttttccttaacttcttttaagtgttttttataacactctattaaagcttcttctcccatttccataagtatatatcttgtacgagctttgtttttattttcataattacctttttctataaataaattagtcatagcttctacatgatataatacatcttttggctcaactagttcatcaaattcagcaccttttataggatttttacccattccaccagctataaataatctaaaataatcttttccgtctttttttactgctaagaatcctaaatcatttatagtagcgtttgctgcatctttaggtgaacttgaaaaagatacttttaattttctaggtaatttataagtagtgattttactcataaagtgttcatttacttttgttgcataaggtgttacatcaaaagcttcttctggatctacccctgataaaggtgatatagcaacgtttcttgggaagttaccacctccacctctagtgtacatatccttatgtataccttcttccattatgtcacaaacttcatctatagttaatccatgcagttgtattgcttgacgagtagttaaatgtatttgctctaaattatatttatgtgaaaaatattgaactaactttaattgttctaaatttaaaattcctgatgcaactctaagtcttatcataaaactttgtccatcacgttgagcgtaaacccccatacctccagaagcatgtttaaaatccatctttgacatttctttttctaaaaacttatgtcctttttctctaaaagctggaatttcatctaataatacttgtttataactttccatattatgtctccttttccaatgaaataaaagtattttttctatatttttattttatgacatttttctacaaattagaaattgattctttctattataatcattatgtttttcaatgattataatatttacatactaacaatcatctacttgttattttataaaatttttactttatattatatggttgcccaaatttataagattataaataaaaaagctatccttttaatatattaaaaggatagcttttaaactattttttataaactccccagaaagtttcaattgtatcatctgttggaggttttgtaattttagatactataataaaagaaagtagtgatattaataaaggaagaactatagtgtgcatcccaaatggtcttggccaaatatagctaaataatatatatgttatcttaaaaacaaagttattattactatttaaaacattttattataatctcttatttcattaattcaacttacgtagacaaaatgtagacactctgttgacaatcaaattttcattctaaattaaataaaaaataataggtaaaaatagaagaagcccttatctattcgcagtagataagagccacaccaaaaaaacattactaactaattttcaagttattaatagtataacaaattagataaatactatgcaagcttaatttttatagtggctttaggtttcttctattcaataggagaatgaaaaaatgagtacaaaaaataaaagatttaatataagtcaagaattagaaaaattatacatagaaatcccatcagcattaatatatgaaccaaaatacaaaccaaataaagaaattggtaaaaaaggactttctaatgatgccaagatgctttatggtattttattagaaagaactcgtctatctgtatggaatgctactgaaaaaaatgatactagatttatagatgaaaacggagatatatttatttactttgatgataaatctatagctgaaatattaaacttatctgagaaaaaaggtagagatgtaaaaaaagaattggtaagttataatttacttgaagaaataagacaaggtttaggtaaggctaatagactttacttaaatatagttgaaactaataaggaaaatataaatttgtatagaagtgaatttaaaaaagtagttcataataaaaaggaatcggaaagattaagaattgagaaatacagaaaagaaaacgctgaaactattggaaatactttgaacggcaaaattgaccgtacaagaacagtcgaaagtaccgtacttgaacagtcagatttaccgtcaagtaataaagaattgagtaagactgattttagtaagactgaatttaaaaaatcagttgttgttataaatggcattgaaaagaaaaaaacaaaagcttatgaaatacaacttaatgaaactaaaaccactcaagaaaaagtaaacttactaagtgatattcaatacatgacagaacatacaaaagctcttatgcataaatttatagaatttaatatacttgtttcagaagctcaaataaaaatgttaaatgaatgtgtttatgatatagctattaaatcaatagacttgacaatagcaaaagctggaatgacattctcttatttctatgagatttatttagctaaagaaaaagaagatatagaagccttatcttttggttggtaaaataaatttaaataaggagtattgagttatgagatatggaataagaaaaccaagtataaagaaagttactaatgctagaactacaggtaaagttaaaagaattattaaaaagctgttatccctggatatggacgtaaatatatgggatggattaaaaatcctaaaaaagcagcatataatacagtctataatacaattacgttctcgatttttgatatattcaaattatttcgttgaatttataatagacatagttagataaaatgttgcaattgtagatgaagatgaaataaaactggactatgtattagataattcaggtcaaaacaaagaaatgatatatgatgttgatgggtagtaataatatgaatactcaggtaaagtataatagtatactgtgttatgtaattttatagaataatttaatacttattttagttaattaataattttaaaatttcttgtttactcttctggaaagttgtgttaatatgaaagcaccaaatagcctaaaaccagctataccaacgtttatatgatattatcatatactttttcactttactatttgatattattaaacaatatttgggagaaaataagatatgaatgaaattgaaaaaagaaagaaaatgttagaaatacatagtaatttaaatactatacttgagattattaaaattttcaaagaaaatactagtggagattttagttttattaattgcaaactagatagtttaaatgatatagagaataattataaaaccatacaagataatcaacagaaaaatattaatgaattgagatcatttaatattaaaatcaataatttagaaaataggctaatagaaaataatgttaaagatgatattaaggacttgatgaatatgatagcttattactaccaagggattataaatagcattgataccactatgctcattgaaaaaaattcttttaaagtagattcagataaatttaatgatatattaaatgctttagatgatactaataaaatgcaagttgtcaaatatgcggaatttctattaagtcagcaatgctaattgtaaattggtattagctggattgtctctagttttgataatacccaattttaagtctaacttagacttaatttatgtttaaatactatatggttgatatagagtttaaatagtaccaaattgaaaaattctaatttggacttattagtaattatattctagatagagataataaacaatgtttacgttgatgatgaatatgaaaagctaaagtgcttattaagcacatcaggtcaaaatagcgaaatgataataaatgtagatagatatgaaaaactgaaggcgatagtatcgcactcaggtcaaaatagagagatgtggtttctaacagaagatggattataggagatattaatttaaattaacttactattatataactcaaaataaagacgacaaatttggaataaaaaagaactagaaaatatatctagttctatgaaacttatctattattccaacagtttgtgcagtatactgttgcttgttgaccatattcttcacctggtgctatagattcaccacatatatcacaattgaaactaaagttttcttgttcttcttctagcttttgttcctcttcccattgttctttttcttctatatgccaagctttgcaaggtttacacattgcaaatccatcaacataattaacatcactcttagccattcttgttccacatacttcacaagcaacacatccacaatgataacttcttccattaaatgtcatttgacttacaggataatattctccacaatcataacattgtcctttttcaacttgcttcttagacgcttctttattttcatttttgttcttatctctataaatttcttttaagaattcctctagtggctgatcatctttaatctctgtaagttctacacttgaaacacgccacatttctttagttgttctatcaaccctaattactacatctgcttctggaacatatggattattcccttctagcaacatacaatatttaccatcatgactaaatccatcattctcaaaccttgctaaatttatatcttctttgccatatttcttatataaatcttttactaatttttcagcttcttcaactgttaaaagctttacttcttctaactttttttcaactcgcttaggttgttgattatctattgagtcatttgtatcttctacactatcacatcctaccattgttaaacttcccattatcattaaccccattatcatatttttcattttcataataattcccccaaatttattattcgaaatatattttaataatttttaggtactctatttctatagtattattatgaacttgttattgttaatactcttctacttgtattcatattattaatttattttattctcaaatataaaattttatcttaggacatgcacaatttaaactacttttttcatacactctattaagcaagtgaataacaagcgtaagcgttctaaacttgtttagatgtaatgaacgaccagcttaatcgtttagagtggccttaggctcagtctgtgcaattttttatatacatataaatcattggaatttcaatatttttacaagatgtgaacttatataagtaaataaaaaactacccacaattttaagcaggtagtttagctacaaaagaactatagtttgtatcttcattttttattaaacataatgcattatatctttctaattctactaaatcagtttcatcatagccatctttttcaaagtgagttcttaattcattaaaggccttaacatcacaacctgatataagtagaaatgatgatccacttgctaatatggcatttttacacttactagtacattggctcaaataatgcatagctaaagttggtacaagattaaattttctagactcaactaatatattttccataagtagctgacaattataactttgatgtatttcatttacgaatagctctgtttttatttcagtagctcctaattgttttgctaaccatacttttgataaatagaatgtagctataacattacgaatcactctagagttaaattgtttttcaggaattttaattaatatcactttcccttgatttatagcatctacaaagtcaatattactagaactatctttagaataagcaatcttcgtatacatattagtcttaagccaggatactctatctatgataccatcaattttagaatcatagttttctacaccagatttagtaatcttcgttaagtctctaagatcatctaattcatcaactaatatactttgcgcattttcatttaattcatttattaaactttctctctttctcggattagtcagtgtatctattacatctttaaagcttgcgttttctttaagataaaatactacagtacctgctgcataaaggtatcttagcattctaggggttaattttgtgttatcatcatttatagcatctaataatatttgaatttgttctgacttttgcatggctatagctattttagaataatcatctaggttgggatttatcttatgttcattgaatacgaacgattggagttgatttatgttagagcagtctatttctaataatttatcaagtggagttatatcttttatattgttagctaattgacattgatctatataatcaattactataagtcctctatttgctgcaataatatctttagccatatttaccatataataatctttaccggctcccatacttcctaataatactctacctaatcttgatatctgattatctgtagaataatatgctttctgtattatatctttgcatttaaccgttcctattctaatctctccatcttcgagacacttaggtattttacgctctagtactttattatgatttatcattttatactgttcaattaattctctacctggtaagctaataaaattctgacactcttctactgtagtcttatttatacctacattattaataactggtctcataatatcaatatcttttttaacttccttataacgaaattcgttgtcatctgatatagatttaaagctattacacatgcttattcctatttctttttctttcttcttatttttagatttagatattactagagtttgactcttacatatatctctactagcttttcttttagtgctactagatggtattttattaacattaagaaatagttctttatttttggcttttttattagattgaatgcttcctataaagtcctcaaaataagatattataaactttagagctcctattcctatatctgctatatctttagttttcttaagtgaatgccctttttcaaacttctctatattgtctctatataactttttgaaataagtatcctctctatctcctgttggtataaaattatagaatattcccgtcatgtcatcgttatctaagatatctataactgccatattagcgttcaataaatcattacttcttttgtctacattgagacttaatatatcattatgagtatacgttaactcatattttgaacatgaattaatatctataggtatgttatcgacttgtttaatctctatattcttccagcattctccgaacttagttctaaatttcatgttatggactgtaggtactataaaatagaattgtacttcttccttagtaatatggatataataactagatttcatgtaactttgtattataagtttcttatcttctcttttaattaacttatctgccttaataaacattttgttaactaatgctgctattgaatctgttgaattattcttatttgatttagtaggtattagttgatatattgaatattcttcttttttaatctggatatatttactaagtgacattgatttgacttgattcttaaacacctagaatcaccttccctatgatttgtattataagatgtatagcccatgctaatattggtatatcttttcctttcttccatccgaatataaataatattgcagctactaatccagctattaaacatacatctgagcttaattctgttatagtagttattaattccgttaaaaactcattccatttatttgaaaaaaactcttctactcctttaaatgggttaaagttccattctacatcaaaagtttgtttaaaaggactcatatacatacctcctaaaatttaaaatcatataaagtaggataaaactctaaaaacaaataacctatccaaaattgaatacctgcaaatgatgcttctctcatgttcccaccattcaataagcaaataatcatttccttgattcccattcccatacatgcatatttagctaaatatgttaacttatctatgatagttatagccatatctcctaatccgccagtagcatatacagttatagtacttgaattaattaatattgtaattagaattactaacctcttatacatcaatttatttctcttgatgtgtcctatgaatttatcaattaaaagtacatcttctcttgaataaaaatcacattcaactaattcaacttttttatactctctaactttagaaacttgaccacataccatttcagttattgtgttaccatttactaatatcttcataatatgatcctcctattttggttataataatctcatagaatttatctggaggtgtttaaggatgatgaatcctcacttgtggaaagcattaggatggttctctttggttggaatcttagatttaattcagaattcattacattaattaaaggatatcatatacatttatagaatatattatcgaattatattttttaattcacttgaggtttggactctatggactgcactcctggagtcctttaattttaattaaaacttccattcacctttacgtttcatttcttccattactaattgtttaataaaagcactttgacctatcattgcagaattatctttgatgtagttataaatacttaattcctctggtgtttttttaaatgatactggtattctcacttcctcactcctttgttttgacatatgagtcatcaccctttcttgattgattttgtttgtttctaatacattatatgtataatcgcacaaaactgttacattttaaactaaaaaaataaaccccttaatatacgaggtttacatttaaatactttgtattatggaaataaaaattatataaataataaataagttcattcctaaatcaaagcatttagaaacaatttcatttttagtttttaaaaatccaaatcttataaatcttaatttaaaaaaggaatacctctttctttcatataatttccatctacctaaataatttaaacccatgaacaaattaaacttaaatgcgtgattgtcattagcttttccatctacgttatatcttggtttgtatctatttatcatatactgttctaccaatcttgcatctgcgtcactatttaccttaagatattcaatctttccaaccttactgtaacatttttttgaaagatgcccttttattccaaaatgttcatccattcttttttttatatctctctttgttttcccaacatagattacttcattagttataaaatgtctaaatctataaacatatgccatacctacagtcctccttaaaacatatgtctttattttatggagttatatgaaaatctataactttttttagcagtttttttgagtaaatcattgaaaaaaattaggctataaatactcaaattaatgaatatctatagcctctcgattttataataatttaaacttctgcgtttagttgaacttttagtattaactttagtaattcctatatatttattaatcacattttaatatcccctttttatttaaatttgaacataaaaaagtggtataaatcaatatacatctctaaacatactttgtcactatattttctattgtatcaaatgctctcgttatgaaatctctcttttttatagttgattgttttcttaatacattttcgattacttcatccctatatattaaaacttccatgtactgaatcatattttgaattttgttttttgctatctttaaattattttctaaattgattttatcattttctgatgggaaatttggtttagaaataatatcaataatagattttatagtagatttaaattccctatttaaagtatttatatttaatacaatagtatcatttgaattaatgctactatctttactaattatatttaactcttttacgcttaatttaacatttccatagctatctatatctaaggtcttatttccatttccatctgtcacaataagatttctagcatctatgtatgtaccttttactgttcctgaatctataacatctgcgttaagagatcctattaaagcactatttattgctgcattctcaaagtattctgatccatctgctattttagtagttgattctgatacttgagatgaaaactctgtaaatttaccatgtgtattgcaagctctaactctataataccaagtttgtttaggtttaacttcatgtaaaaatacactggcttgacctttgaatatcatattatcaggagttgggttaaaattctctaattgacttgcatatacttcataattgtagtaaatcttattttcataagtccaacttatttctatagttgaaaatctacccttagttgaaacaataggtatttctggaagtgtatttgggaaattactattatctatagatggcttatccttatctcctccaccagttgaattaccacctataacactacctaaattatcagttatagacggaagtacatgacctaatattatttcttttgtagcttttatatctcttatagaatatctttcttcaactattctactttctacatttatatcatactcttcatcaactattattatagaatcgcctaagtttgtttttaaatgttcatatccaattacaccagataaatcatttaccaatactttatatgatactgtcggttcttttgtttcttgtaacttgtcccatgtagcttgaagcaattcttcggtattttctatatctttattttcatatattccttctattcttccccattttgatatagcgtctaaatcctcaatatacttatttcctagaggtttattagcagggttatttggagtactccactctacatcttcaaatgtaataagtcttgtatttccaccattttctgtttctaaagattttcctctaccatataacactgtaaaatgattatccattatctcattttttacaacttcttctacatttgtatcataggtaaatcttattcctgtatcttcaccaagtctatgttttatatcaacatatctgttagctatagctgtattatcttcatttaattcaaatctaaaatctatttctccaccatatgtatttaatatctcgtttatagcttttaagcttgatataaaataataatttaatgttcctatatgaaactcatcaactataccaactttatatttagttccttctaatgcttttgttaaagcttctttgcatgtcccgtcaactattctcttatcttctattatcttatcgttcaaactataataatcatgctgacaaaatacatttacctcattactatcactataacttgtctctacttcttctatcgtaaaaagttggaatatatcattttcatcacgaaatccaaccttattttttctaatcaagtttttactgttttttatatctgtaaaaaatttatacgtatagtctttatttaaaactctcttgtattcatcatcataaaaatcatctattatttctaataaaacttcatctttgttaaatatatatagcataatttaccacctctcatataataaaaaaagagagggataacctctctctatatgtactcattcctatattttatttctactaaagcatttcctgcttctaaagtataatgattctttccttctgtaatttcatgaaatctactatctaaagttaaaataggcatattaatttcattatttctaagtattttctttgtttttaagtttatttcaatagtttccccttcattaaaatcgcctttgaattttatatagttgttatacttactattttttattccaagcttaacttcagagcatctacttgttattgtaaattttatatttgggtatgtattcgctaagccctcataagttaatataattgtatttgatgtattgctgtttcgtgttgtttgcaatttacgttttaaatatccaggaaatactaccttattttcaaactcagatatcctattaggatttagacatataaactctaacgtaaatataccttcaattatgtcatttttaatatctccagcattatttactatggccatataatactcatcttcgtagcctggtaaaactaatttagaaggtttccaatcatcacctttaacccatttaactatagcatttaaatcatctttttcaattaagtgacctttttcaaagatggtactaagttctaatttaattactttattaccaaactttatctttttatgttttgatccatgattagaagatgctaatatattatcaacatctcctagtaattgtatctttatatctttaagaataatgaagtcaggtatccttacattattaaaaaatatattaacgtgcataagaataaccccctcttctattatttctagttatttctctttgcatttctttagatactatttcggctattttcttaatatctgattcagattgcacctttatatttgaaaagttaatgttaatattataatttgcgttttcatttgaagaatttgaaccttttaacgcatttctaactccaccttctacgtatccatataacttatcaattggtaaaaccgcctctggtttatttcctattccattgtttgcatccccaactccatgactaccaaatatggttggcttagtaaaaatcgctcctttatgatgccatcttataccaaacttaggaacactaggagggttcaatccaaatttaccagtaattgttatatctggaacttttagttttggcaaagaccaagtaaaattaaaaaatccttttattttatctattgcactctttacagtatctttagctgtatccattaccccttttatagtattttttatattatcaaagataccttttactatctgttttgcacctgctaaatcaccactaaatacagctttgataagtcctataacttgttttacatggttaaatgctccagtaaataaagtactaattacagtctttattcctgtccaaatagtgctagtaactccttttatagtattccatgctgcagatataatagatttcatatttgatacaagtgtttttacattatttactgcacccgttactaaatttactataacatctttgatagcttgccaagtgcttgaggctacggattttatattatcccaagtagtgtttatccaagttttagcttgataccactttgacttaacccattccacacattgtgaaactagatttgatacagtagtttttatattattccatatttcacttgctttagcagaaagttcgtcccaatgtgttgctaaatatatacctgctccaactaaaagtgctataactgctactatcgcagctatcactccaacaacaggtaaagacattgcactaaatgctaacatagccataccagccatacctataaccataattatcggcccgactatagctagtaaaattcccaatccacctacaaccattaatatggtttgaactaattcaggatttttatttgcccaatctgctactttttcagcaactccaacaaacttttgaactaatggttctaatactggaagaagcttttctcctatggatcctgcagtttcttttactgattgccataatagttttagctgcataccaaagccgctggcctcttgttttgctagtccttgagcagaagatccttgtctcataacttcattataaacagccatcattttttctgtatcagataattgattccaagatttacctaatccttttacgaattcactgttttctaatgatgcagcagaaacattgacgccaaacgcatctaaggcttcgtagttgcccataagtccagatttaaatcttcccatagcttcatcaaaaggcatatctgtaacagcagctaaatccgcaactaaattcatagtttcgccacttaaattggatgtctctttagttgttagacccatgttcttataaaatgtagacattgttgttgcactgtttttatattgttgacttgttaaacctatagattttgcattcttagcatttgcatctatactcttttgaatagacttgtctaaattattgtataagaattgttgtcctgctacctcggcactccagtttgcacctgccataactataccacctatagatgttactatacctgcacctattgcggtcattgtttttcctgttgaaactaaaccctgacttacattactaacaaaatctctatttattttagaaccacttgaactcattttagagtcagtgttattagcttcttgttgaaccttctttaatccttgtatagctttgtccttatctacattaatcgtccaggacatattacctaattcactcaattacatcacctcttttttaaaagtaaaagatgataaaatatcttggctttctttaataatctcatctctagttttatggttatttttaactttggtgatatttaccgctctacatttatccttatattctttaaatggtataaacttctcagacattaacatttgactattccaagtcatatataacctatcatcaaagtacttctctacaacagaatcgattaaatctataactgaatctaaatcttcatctaatatctcaaaataacagttgtgttgtgcaagaatccctttcagagcattcccccctacttgttcatcttcttgaacaaaccctgaaaagacttcgagttaaatactgccattatcatttctacaacctcatctatttccttttcctctatttccttctcttttacgccatatatagtagccatagttttattaaactctttctcaacttctggtaatttttctattatatcaaatgcaaattctatacctaaatcatttaaaactacatctatatcagatatttgtttagctatatcaacatgttcatttagtaaccttatagtaacttcttctgttatatcctcctctttattttcgtttctggaatataactctctaaataacatatctttcttagcactcaactgtatctgctctttagacatttttattatcttatcttttatattcattttctttatcaatccaagtagtgcgaaacctatttttgttgtaatttttatatccttcataatttcatcctttctgtatttatttaataaaaaaaagactagaagttaatctagtctaaacttgtttcggataataaacatcaataggcatttcatcagatcctatagtataagcacccacaaatgccattttaaatcctgcttcttctccgtctttttgttcaaatgctaatccttctcctgagtaagcatttttaatatgtataatacatggttgatctgacttatatagcttaccaactaacactaaatctctgtgtgttaattttttacctggtatatatttatcaaattttgatgaacttgtactatcttttacaaatccatttgctaaaaatacagttggagtggcttctaatgcttcagtttcagctttaacttcccatcctaatattctatccataccagctatctttttaccatttctaccgtcaaattctatttcccttatgtttggtttggcttcaactttcaatccacctctagttacacctagaactttttcttcagttaatatagttgcaaaatcatcaggattagacatatctatatcgccataataaactgtggcaacatctaataataattctttcattttatcacgtcctttttagtatttatttaagttataacttaatatccaatgttcatattcatcgtctttagtatctatcaaccagactggtttcttagttattctaatattatttattatttttttgttagtttctttatcaatagtatcaactagtaataataattcattaagtttagactttaatgatacaaaatgaatatctaaagttataacatctttatattcatgacctaaaattgtatttaattcaaaatacatcccaacttcattgtcataatcaaagtctaaaggtaactcttcattaagacattcatgaaatgtatttaaatgtgttcctatttcttttatggtgtctatcattttaaacacctcctaaatttctttctaatatagctttaaactcacctatttgagactccattgatcttctaaagtgaggtcttccacctctattcgttggtttgaattccaaatgtatagcatagtctaatgtggtacctatcgttacactaaaattatctgttatatatgtataactacctcttaactttccagtatcaacaggacaattagcttttacttctgcaactcctactattcccatttcctttaaagacttttttatagcctctctaatcttatttataatctgatctgtattatctattatcatttatgccccaccaaagaatatattttatattcaatccaatccgctttcttattaattttataaagttgactatcaaactctataatagaatttaagttaatgtcatcatcacaaaacattataaaaatactcttcgtatcttctccgaaagttttttttataatttcaaatgtagaaggttgaatatcacaatctattgccttgtctattgtaaatgtatctactttttgaaataaatcattagtaatagtagattttttcattaaattaactttaaagtcataaaacattacatgagcctcaagctaggacatggcaataactttattaaatcttctgttatcataaatggattagatattgtatctgagtaggtaatacttctttggccttgagactgagattttatatttctatttataggtttggaatagtattcttttgcccttcttacaagctcatctactacaaagctaataatagcattattttcatctattgaatctttgtttaagtgttctttaatagactctaaagctataaatttgaatcttttttcatctataagcatataaacacctactttctaaataaaagagaaagcagatattactccgccttctcttcttctttacttccagttttatttctagaagatatagtttcagctattgtataatttaaagcgactatacctttaggtcttaatactttagcaccgtatacaactaaccctctcacagcttctccaaatgaactttctaatcttaaatgttcaactttgtctaatattttatcatatcctaaagctgatttatgcatagcaaatattttacttgctggtaattcttctgaagatacaacttgaagtccatttattctttgtccttcgactataccatttgctaaaacaactggattagctgtaaatctaggatctttagctaataatcctaatatttctgcattaacaacaacgaatctgttagatttaggagctttattcttagataattctgttcccatgtctactatttggtcatatatatttgatgcatttacagtagaattagttaaagtttttccggcctctgatacagctttagctaatacatctgtatcaactttttccgctaataattctgcatgttgttctgtgttctcttgtaatacaggtaaattagtttgtgctttatctacatcatccatttttatagcgaaatatttcttcttatcaaatattaattctacatctgtagtagttgcttcatcatatgtaactttaccttcataatcctttactgcaccttcaccaacgacactaaatattaccttttcaccctgcttacttactggcttaacacatatagcatcagctacagatacgttgtgatattgatttaatattgttgcttcccataatgttcttttgaatcccataaattttcacctcaatagtctttcttagactatcctttcataattatttttttaactttctttagttcctaagtttaaaggcataaaaaaaagacctagttttgtattgaggtcttattgactaaattttatttaacatttccataacttgttcagtggacatattgtcagcactgtttaataaatcttcgtatgaagagcctatagcagatccacttggaggagtataatttgtatttgatactctatcttctacttttttatctatataagttttcatagattcttcaaatatagatatatttgcattagttacttcttcatcgtctgccaataaaaaatctatcatcttagacggtatatttttttctgttaaagtatctttaaatttggctatcatctcagctttagcttttgctttctccatctccttaaacttattttctaattcttctatctttaattgttcaggcgtcttgcttggatttctctttaatatctcagcttctattaacttttgcatatcgttctttttaaagttatctaatgcagtttttatagatttttggctatgtttatctttttctgaatctaaccaactcttaacctcttttatttcagatatttctatatcttcttctaccgagtctaacaactctaatatttgtgatttcttcatttatttccctacctttctgcccatattactgctaaaacagcaccaataaacgcatatatagtgttttcatccattataagccgtatatggatgttttgaatttttctaatacaaatatatcctaaaactaaaataaacctcttataatatcttataacagttcaattaatttaagctatttttagccttccatttttcataatccacatagtcaatgtgtttgttgatagtagtattgttttttcttttatttggtttccaatctctactaggaattaatatcatgcatgatctacaattcggatgtagtggcggaattggtttgttattatcatctactctaaatgttttaccatcaaaattcctacatttctttgatgtcttataatctaaagtagccatgaacaacatccattctataccttgttgttttgcaaactcttcatttgctttttcttgtaccctacacacttctgtttcagttaatcttttagcacaataagcattattaccgtacctgtcttttatctctttatagattctgttaaccgatatcctaccatttaagaagtcgttagccatactctttaaatctttttctaattgttttttattcttccacaatctatcactccatatttccccatcaacaacagtgttaataattttcaataactcattttctgtaagtattgaaattttagcaatagttcccaacgacaaaatatagtttcttagattaaaagcttctttagtaacagtttctagtacatattcagtggttttcttttctaacttaacctcttctttaatagcttcattaattattttatttaattctatcttaagtaattgtctatctttgctacttaaattcaaactttcttctttaatgttatattcaagcataattaaagctaatttattaagtaattgatctctattagtcttttgaagtttatataccttcttcaactctttatcagataagtcatatcctaatttattaacttctaatattaattgttgaaatagattattcatttaaatcaacatcctctaataacttgtcaccttctaaaacagactcttgctctacttttattttagctaactcatttttagcattttctataaatgataattggcttaatcctgtttcagttgataatttatcacctaattgagatattatctgagccacaagtaaatcatcttgaggtatattaggagtaaatttaacttttatatctctataatcataatctttattaaacattatctttaggtagatgaataacactttcaatctagtttttatacaattagttaaagctttttgatttaatttacatttttcctctagtgagataagcctacttcttaaagccaaacttgatgtattagattgcattttctcattatgatttatatgagctgtcaattgatacatcttatcttctaatgtatttaatgtattttgaatgaatgaatcgtttatatttttaattagccaatccacatcgccatctttaggtgctagtataatacccatagttttcatttcttttgcttcttcttcgtcaatttgtgaatttatcaattttaaataagcatttctaaaatcacttatttcattagatatatcagataaattagtctcataactatcttgtaatcctttgatatcattatatatggtatcttttataccttcttcacttaattcagctattccaacaggaactataccaaatatatgtggagtaggctctttaactttagtaaattgattatccaagtgatatataaacttattatcatatacatctatgtactctttgtcctctaaggtataacaatgcgcaaaatataacaattcatctctttcattcttagctacaaatgcatttcttggacttataactctagcatataattccttattagagatataatacaattcatatgttaatccatataaaatcatatttttagctaagtttgaatcatgatcttctttccaacattctaaataataatctatatcattaactatagactcatttgaaaacttacttatatatgtaatatcgttacccactgaataactaacttcctcttttacaaacttctttaagaaattagtatttgctttattgttatttctttcagtaaccattttgtaattcttcattgcatctgtattacctttataatactcataagctctattatactcagccttttgaagtatccatttattataattcttttttattaactctatattcatctattcaccgcctttttacgcacaaaaataagctcctaaaatagtaaactcctatctagcaactttatctttcctacaatttctatattatctactctatttgcgaattccgccactatatcaatagcatcatcatgtagagtatacttttgtccctgaaattctaatatttgatccgtaaattcacgattattggtagcaaatattatctgtccattattcacattatctataattgtagatattttctcatctttattttttcgctgcatttcatttataaattctaagtttctgttagataaatctttatctttttctatcaattcctttatcttgttaacatctgcaccttgaaaagtattcttttcaatgtaaatatgagttatatcttcgtattgttttaataaatcaattactctatcacagtattcattgaatgtaaatttatctaatgtcatatttcttatatatttgaagtcattatctgcggatgaacctactatcattgcagtaaagtcacttctttttgtttgagttgatgctggatctatacaaagcatagttttaataaaattatgttcttctatttcttctactgtttgagttctaatagatttaaaccatttttctcctatacttgtagcatcgttcatcatctcagacataaatgcttgtctattttcccaatacgaaatggctatatcattaaaacaatcccatttctcttcccataatagaggaaattccatctcatctatatgattctcatagaatactttcgctgtaaacttagcattattatctttatcattaaaataaagtcttttacactccagccacaaaggactttctaatatatcttctactgtttggttatcttttaatataatagcccttttaaaaactgtgtaataatctttatttctccttaatctagaaataagacagtccccatgtagtacagtccctatagatataattttagtagcagatttaattttcttaccatctctataaacagcagtatctcctacttcttctatttcttttgaccatcgattaaattttttctctcttgattcatcagataatatatctttttcatcctgatagtcatctgctataacagttgtaggccttatacctttaaagtttgcacctctaacagatgagcttgagcctactgctcttatatacattccattagcaaattctatttcattagcattaactttatactttttagaatttataagcgatccaaattcatcaagtatcatcttattttctttgaatactttctttatagaatctataaactgacatgcatcatcgtccttcttagctcctaataatataaactttgatttctcatagcatataagccaaactgataaagctaaatcacatacggttgtttttgccattccccttggacatactatattaagtttatctattgtatcttctataaatacggtattcaatgtatcccacatttcgtaatgagtaggtgataattctctagcctcatttccatctttaactacaaatacatctctgagatagtaaagacagaaaaatgatatgtctctttcccccaatgaccttgctatactatctaatttatcaacattatttcttattgtattttcagctatctctttattataatgtttagatagatacttgtttaatatgtaaatattatattgttcatcttctaattttaagttatcataatatatcaaactctacaccacctcctcgacttaaaaaatactaagaaattttatataggttaccgtgtcgaaactccaagaatcatatttagaagtatacccctctagactttaattaattaagtttgcaatttatccttcattgttgcaatattttcaactataccttaaatctatcttttgaggatagttaacttttcacaacgtagtatttgcaatacttctataaatcattaatcaaactttactttattaagttatcattcaattaattatattaactctcttagttgtaatgatttaattacttatattttattattatatatctatgtatatacttaatatttttaagtcaacatatctgttacatcaatattaataccaactctaatttatattgattatacttaattaatttaggtaagctatttatattatcctattctacttaacttaaataagtttcatttttcttatcttttttaatagctttatctaatatactaagatcaaactctttcttatcttctttattttctgtagttatctccgtcttagtcgtagtatttccaagtactctattaactaagtattgtagagcatttagtttatttttctctgacttccctgttaaggctatcttctctaattctttgatataagtctctaaactcattgctatactcttctcagatttagatttaatatcattaacgaatctgtcaacttcagccttaaattctttcttctctttccaatcatatacagtctgtctactaaccttacaaagctttgcaatatcaacaatcttttctccttttgctactaactcagcagcatatctttgttcttcagtaagcataaaatcaccccttacatcttgacatttatccttctacagtttcccatattatcataggattggtctctatttcattcaatctttccgctaagcaagaataaactttaccatctaaacctcttcgtgcatcttttacttcaagatctattgtttgttgagataatgcaaaattaactctatcatcaacttcgtttaatttattatctacattagtaattaaagtatctttagaattatttatatctactatcttattatcaatttcagtcattctactagcatgttcttcttttctaactttctctgacataattctattattttctttagcttttcttacgtcttcattcgactttacttcttcttctagtgttttaacattatctactagctttattaataaattgtaattactatcatcgactatagtgtcatctatttctccgcacaatgcttctctaactgtatatctgaatttactactatgtgatatgtcttctccatttttcatttctatttctacttcataatatccatcatcaatcgtacactctacaggtaaatttaactcggctactccatttgaggcatctactatatctaaactttgtggagttatcaaggtattaggcttttgaatattagctataaacgaacatcctgttatatcaactttttttccattttctaagaaatctacatatatatttgatacatttctatccttatctgcaaacactataccttcactttctacttttcctgattttatatcaagtttaattctataatctttgtctaatacactcatttacatcacctcttttttatactttgttctattgaatttacttttaataaataaaaagagatggaaatccatctctttttatttattaaaatctaatttatatataaatctatcctgttttttggtcgtcattaggactataattaaatccaaatgatttttgtagtttatcctcatctaaatatgtaaaagcataacattcatcagcatatttcataatattacactgatccttcttatgtataggacagtaatcatatgtcaatgttttttcgtccttagttatcttttcatttatatatatgtggtgatttgtatctataaataatggtgaaaaaatattttctgtccattctacgacgattctaacactacttctcttcgcttctaacgataattgatacaatctttgcccactaattatttcttctatttttctactattaaatccatactcttctaatatacttttaatagtatcacttttttctattggatgaaaatgaaattgtctttgcattgttctatttcctataaagtcttcttttttatagttagatacagttgtaaaaaattcaaatactgaacctattctatctatgtaatctttttcatctttaaaatgattattaaactctctatctatttttataggagtaaccttaaaatctccaaatgtaaaaagtatagtgtctttctcattaagtttatcaagagattcatttttagaatcttgcattttattattttttggctttataggattagatatattatattccatgttaccctctaactctctttgaataataattaaatatagaactatctgatattacagtatttcctgggtcaaatgtagacagtcctattctactttctttccatggttcttcttggtgtgttatatcttctaattcatttccatcatgaattccatatacatcccaaacttgatctaatatacctattacatcatcatttaagtttaagcttatattttcaacttttggtatctcattccatccattatttttatactcatcatataattctctacatacaggaccatgaacccatccttcaaatttactttcgaataataaattttgtatttctccatcttcaggattatttagtaaagttaaaatccatgaataagcataataacatattttttgtaattttttattagtcattgcttcttttgataaaaaatattctgatacatctttaatattgcttatataattaggattttgtgatattttaatcccatattcttgaactgccgttgctgtattcatttcattccccctaaatctacgacatttatacttatctaattcgattactatagacatgttatcaactccattaatttttttaattatctccaatatatatgaatttattcaatttaaaattactttatgtttaaaacatgatctatactctcttctttttattattataccatatttttccataaacaatatataattttttattttcaaaaatattatctatttcaagtaattatatacaaatccttttaatctatattatttacatcaaaatacatatttatttcaatcagaggaacagtttttaagagactgtgccaaaactctatatataatccctaaaagaattaaaggaggaatttattacactgtctttatcttcaatttattataatctgttatatctattccactattgatagcaaatgatttagcaacttctaatacttgctcatactctgattcttttatacagcttattttagatgttttactctttagtgtagattctttgtaatatcttcctgttcttgcataatactcttcattcaatttattcttcttatgtgtttgtctactagttagatttatacctagcttattatttatgaatgagtagaatgatccatatacataaccaatatctttacatatatgtctagctgttatatttataatcttactcaattctttattaaactcttcaaatgttaggttattattaactacttcttttaacatgttagaagtatgtactagctttaactttatttcttctttttcttgttgctctcttatccatgcctgagctctagcaattggatcttctatcatataagattctattcttacttcttttaatgtattttgcatagtatgaaactttttaacatacttagctgtaaatatcattcctttttcaccttgaaacttatttgctaagaaatcacatcccattttagatactaagtattctctgtttgtttttccgcttgcgtcaacatatgtactttctataaaataatcactcacgaccatttggttgtcagttaaaatagctattattcctcgtctatcttttctaccgtctaactttctaagtaccatatcatgtgttgttttcaacatttcagctatatctcttgtacttattctcatttcttcattacttactacctgtaaatctctcttcatattcctattacctacctttatttattatttatttgtggcctaacccacgtttttgattggtgtgtaatttttaagcagaactacacaaactgcattaaggagaaaagattgtatgtaaaatttgcaatattaaacacaactcttatcaagttgtgcaaatcattggggaggattaaaatgaaattctagtgttaagaattatgtttaatactgcaaatgtatatatttttttatatcatctaataattcaaaaggttgctgaagcatgtacctctacacacttcagcataggtaaaaggaatttttaaattatcaaatcatataaaaaaattggaggtaggctaagataatcctcatcatcctagcctacatagacaaattaaattttgttcattgttttgaagaattaaagaaaaaatacttattatgtatttctcttcatcacttccatgtgcgaagctagcgatagcgaaaagcaagcacactatattaattcactcattaaattattacattttaatatgcttaaatatctatgaaattcaccactcgccttaaatttaactcctaatttattagctacttctagttgtctataactcaatctataagacttccaatcagcttttttatagaagctcttaacaccattttttttacaataattctctacatcatttaaaagctcatctaagtcatcattttcaaattctaaagtcaactcatttaactttttattacatttaaatactctattttctactaaatataagtcatgatctatatcaaagcttaatatagatactttcttacctttaatttcagtctcaaaaaagtctaaatccttagaagtcaatatattcatcatcttcattgtcctccaattcaattccatcttctttcattttagataatataaaagcctctactctaatatccttttcttcctcggccgaataatagtcttctattaactcatctacagcattttctatttcagttatttcatctctaaatttagctatatattcttgcgcaactattaaatctattttcataatttctaccttctttaaattaaatttttacataaaaaaagaaccctattatgagttctcttgtattcttttgggtgtaaacgataaacctgtttacaccctcgctacgaacttaaaaaccaaagttcttagcgaaaatataacaattcttatttctgagtataaaaatgggggggattctctaatataactatatattaaggaaacccacccaaaattaatttctaaactatatattgaccttttttacttccttgatgattattaaaccattcaattatactatcatttgattttctacattctttaatttgatctctatttaacccacttccatatataatatccttcattcttaaaacagttccattttcaatactctttagatattcaagtaaaatctgaggattagtcttatccttgccttcaactggttttctttccatagttttcatttcattaaaaataggcggtctatatttaattactttggcgtttatttctttaccaattacatttacaatgtcttcataaatctcagaacaaattaaatatgcctgacacatttttgtattactaaaatgtctacactttatcctcattaaattttgaatcgtatcaactataatatcacttctcataatttcgttcattttgtaatcagtaaacagtcctttatcagctaatattatttcttgaattctattataaattacatctgcatcattaattttgttaaattctttataaatgtcggttaatgctatataagtttctaaataaacatagcttgattttcgatttaaaccacagtgaactatacaatccctatctttccagttattctttcctttgatatccccaaaataaatcaattcctcagtgtgtaaattttttttaaattcttgaaataaaccacttttttgaccatatgtagctactaatacatctttatctaaaacttcatttatgtatgtacttatagtttttattaaatttttcttcttttttaaagaattttgacttgtactaacttggatattatgtaagttgatatcacactctttactatcatcttctttaaatagtttaaatttattagatatatcataatgaatatcaagtctagctgtagcatcaaatattatatttttacacttgtctgtatcgaatttttcaatattattttcaattaaaacaaactgcctggtattatctttatccttatcatttgaggctataaataagcaacctctttcagatatatccttaagtcttattacatcttcatatatttttttactcacatactcttctaatttactcaaaaactgcttatccatagctacatttaaaagttctgattttccatttcctgatatccaattacaatcatattttgtgtataaatttcttaggttatcaaatttattataaatcttcttccagtaatctattaaaaaatctttatcttcacctttatgtaacatttctaatgctacatttatatcagttaaatatctttcatctatagtgtaagtttgtattatgtaaggtttttcatctataaatttaatttttctatgacccccagcccatttatatagttgatttctttcatccttagtcattttaaaatacttttgagttgaaagtagaactataggatatttaaactgtttggttaattgctccttaaattcaactctactatgcttatatgaaatctcatcatcagtttgatcatatctcataaaataacatctatctttaagatttttataattttgaatatctgttaatctatctaatttatcagttacaactatagctccgaaactgtcaacttcaggatgtttgttatcaaataataaatcttgtgagtcattcactaaattgtgtaatatacactttataagcgtagattttcctaatccgcatctattgtaattgacatctataagttcatcatcttcaaaattaaaaactctttctattattcctcttgcaaattcaatctgtttagaagttgcatcagttatattatctttatactctgctaaagtaagttttatttttaaattttttactatacttccgtaatcatatatttttcccatctctatacacctttcatcatcaatatatttttcaattatcttataaacttcttaccgttcaaacttttcaaatcttcaactatagtgtcattaaattcaaataagaatatcataaaacttttattatttttatctctatctattcttactaatctatgtcccatatctaataattcattagcgtgcatgaagtttctaactaattttaattttttatccatatcccgtacctcctaaaatttgtttgttcacccttttcatatgccaaagttggcgtagacaactgggcataaaataagaataataaagggctaagaaattaatcctaaccctctataatcttatatgcatctcaatataagatttttttagtttaactgaatctaaattgtaaattccatcgtaaggaactacagtattagggtaaattttacccaatgaaattctagtttcaagtccaaatacaattgcaaatacttccccgttttcaacttttatttgagttaaattctctattatttcttcttttatttctattttcctaatatcagtcttaactttaaccgctacttttctagataatgctctatttaataattcatctttacctaattttaactcttttaattcaatatcttctttcttatagttactaaataaaaatctatgatctccatttgtacatcttgcatatatactaccttttttgttattcttttctagtaagtaagcatctatttcatcaaacaagaacttcattataaaagttgatgtaatattagctttattattaaatttgactactttatttcctttaacatttcctgcagctcttaatatttcttcctttgtatatttacctttgatttcgttctcatatcttttttgtatatctaactctatcttagcaactttaggttttctttcaaaaatacatctattaaattcatcatctatattttctttaaactctttatcgactttataccttatatctgtttttttagtttctcttaattcctttagtcttatagattcagtaagctttgctcttttcttatgccaatcattgcttaactcagttaatttatcttttaattcatctgaaacttctacatctatttttcttaatatttttattaaatggtcatcatcatacttttgttcaaataactctctaattttgtatccatattggtcatttattcttcttgcaaagttatttaataatgtattagaatcttgagtctttctatattcaacagttttatctaacttcttatattttgcgtgatatataaatcgaggctttaattcgcctttatttttaatatattcatctataaattttaattcttcatctatttttaatccagtctttggactatcaatagctttcatttgagcataaagaaggaaatataagtttaccttctctttttgaaaattatgtaatacattctgtctatgatcttctgtattataaggttcttttttgcatttagatattcctaacttataatccctttcaatgaagttatttatatccgccttatctattccatccatgtctttatatttattatataaattttctcttatatcaaattcagacattagtgcattttcatatctccattctggaagttgtctgtgcatacggttactacatattgatcctacgttgctcaattcccctattttatttccacgaccttctactattgctttatataagttttcatcagtgtatatttccttattagaaccaccgtcaaattgatttctaaagtgccatataataccgcctattacatcttctattactgagttgtatactatattattatcaatacataaagtaatatctaggtcttcgtccataccgctctggcgcatcattgtatcatcgaatgcatagaagattaaatcattacttaaatgaccaaagtatttatctaacaatctattctgtaccaattcagtttttatattttctccaggactgtttaaaggacatctggctaatacacgcttacctatttcccctggtacatagttagtatgcttttttaatccatttgaactcatctctcctattaaacgtcctttatcatcatatttaggctctataagtgactctatataagaaataggatctttcatagctgttttgtagttactattgtttaaatatatactagctcctgctaacatatgaactttcttattaataaggttatctactacacctttaatcattttagtctcattaaatttctcatcatgttgtaaaagtctatgagctttcgtactagcagataattcagtttgattttgtcttgctatatcacccattaatattcttcttgtagctaaatctccgttaatagcttttatatatatttcttcactttctttagctatttcatttaattcatcagcagttaaagctaaattacctattacttgatagttactttcacatacattatcagctttttcttttgaatattttattatgtagaaactctcaaataactctttatatctctcatctttatttgtaaagtcatttattgatttttcatattcctcataactatcgaaccatttacaccacttagtttgagattcattcattattaaatctacctcaaataaattatgcttttcaccccatctatcagctatccataattcttttaagtcgtgtacttctcttaagtatttcttccagtcaaatttaactaatagacctttactttgtaagcctaattctcttatgcctatccaagataaatcataatctatatttgctttatgcctatcatttaattgtctctttattttttttattaactctggacttataaatccacttccatccatagctatataatctacaggctttctatatggttctaatgctgagttcttatctccagattcatatgcagctttgactttatctaggtctaatatttctgtattctcgcctttttcatttttaactattttactaggaaattgtaagtaattatttacaaacttatatgtcatttcaggtaaaattattctttttatccctggtaaatggactctttctccacttgataatgctagtgatattctagatactatatctttattaatgcataattcagtaccttttttcttatttatattccctaatgaaatcacatcttcaaatatatctttaaattctttatatgtactatctataaaaaatgcttccgattcagttcttaattccatatctgcttttttcataagtccggcacttgtagtaagataaaaataatgattgttatcaaaatctatcccgttttctaataaatttaaagcatcatcgtaactttgaggtatgtgtacttttataatttcttctatgtttttccctaatctatagtcttgtttgtttaattcattagacatatagatttcaaatatatctaacataaagttacggcctatcgttattgttccctcaacatttacatctgtctttaattcaaattttccttttttctgataaacttctctaattttaatttgttccatattcccttttacctccaaatttttaatatattacccctcaatttaggggtatccgtcctaattgtaaccccttacaatatatataccttataatcgaaggatttcgtaactgtttttggtctaccgttctattctatataccctataactgcgatatatcgtggttatttttttcgaatttttttattaattacaatctttacattgagataccctggatgagtgtaccttcataattataataggaaaaaaagttgcactttttacgatatatccaacataaaatcatataactgagtttcatttatatatttccgctcatctctggcgaatgttgaaatttcaatgttttaatgatttatatatcaaagtccccatcgtagtgattaatcttttcgtctaattcttttttatattgatccgttatatcacttacaaccaaagttggcttagttggtatatcaaacccatcatactcatattgcaataccacgtcatacattcttatatgtctattgttatgttctataaatattattttaaacttacctactatccaataagcccatttattttctattgattcatattctacacttaatatcttttctgcccacgcaatatctttatatttttctaattccttgaagatttttacaaattgataatctccgggtaaattagatgcaaaattttcttccatcttttttaataaagtgtcaaaagtatttatctcattcattttatgtctctcctcatctgtacaaataattccaaattttcatgtatttatgctacttcttttttatagtcatttattattaaatttggtatccattccaaatctttatcgtcatagtcataaaaattcggttcgtattgtagtaatatttctatagagtcatctaatacaaatctagctactgtataatagatattttcatcactaaattttgttatttctgtgtaattatctaattgtaattcatctaataaattatagaaagccttcgcaccttctacattagttaatttgtttttcatttctgttaataagtttttcatattcatttctccccttgtttttatttgacactcttctctcaaagggatataatctatattgcgagtatagaggtgctatatcctttttggagtagtgccttttttatttttagtattttattgaggtgtgatttccccaccctttcgagtagggattattttactttttcttgatagtgattgttttttctattttgtcatatgtaacttctacagctctgtcttcttgagtcaagcccatgtctttaatgaatgaaattggtatcgttaattttgttgacatacttcctgatcctgacttgttaaagctaatatttaagtctctagattctttcatttcctcacctcttaattacattatataacgtaacgttatttgaatcaatatatctgtactaactttcgtaaaacaaatatcgacattatgtgcaaataaaaaagatagccttaattggctacccttacaatatatatacatcataaaaatcgtaatacaaatatcgataaataacaaaagaatagctatgatccctatagttttttaaaatacattatatcttttattaataccatccattagtaaatattctaaatttaaatctttacaaaccttattaacagtttttatataagctaaacataaaaactcttcttcttcagttttacattgttcactattttttatgtgattcataatttcttcatcttcaattttattaattagctcttcatactttttatatgtagaatctatagtatttaatgtttctaatcccaatatactttggtcaaatacaatattctcaatatttttctttaactgtatatattttctttcagagtcataatatatacgactcatatagttattatatatatctataccatttttacatattttactttcgttctctgctaaaattttaatcagtccattttttttatttattttatctatattagattgagtatatactttcatagcgtcaaaattaagatcttcagtaatctctattttataaactgaataaaacctatctccatcaaattctattttatgattcatattcttaataccccctgattttgttttagtacttaattctgcatctatatctaaaatcctccaatttatatttattgaatttaaataaatttatgtgatatattaatgtgtgaggtgatgaaataaaatgaaaggaagtgtaagaaaaagaggtaattactatgaatactcatttgaaattggtagaacagttgataaaaatggtaaagtaaagcgtaaacgtaaaagtaaatcgggatttaaaacaaaaaaagaatgcgaattggcactaattcaagctatatcagattttgaaacttctggaagagtaatatctgaaaataaaataagtttagatgaatatttacaatattggtatgataattatgtttgcaaatcatgcagatataacacccaatatacttatcgtaatttcatcaaaaaccatattagcccttttctaggtagctattatcttaatcaattaactccagctataatacagagtttccttgattcattatttgataaaggtttatctaaaaaaacattagagtctatttttaaagtattaaagttaagtttagatatgagtgtttatccttatgaattcttaaaagataacccatctaagtatgtaaaaataaagtataaatttaaagatcctaagattaatagaatatcattagatgacgcaaaaaaagtattgatttatttaaaagaaaattattattttaatttttacattgcttaccttatatttttacacactggtttaagacgtggtgagtgtttaggtttacaatgggaaaacatcgactttgaaaatagaattattaaggttagacatcaagcattatatgctaaaggtaaaatagagttagttgaatgtaaaactgcatcatccgtagctgatatattgatgacagaaactttattcaatgaattgctttcatacaaacattttatagattgtaagaaattaaatcataattttgtttgtataaatacagagtatagacctatgacttttataaatttgagctatatagttgagcgaatatccatagaccttaacatacatgcaaatccacatgcattcagacattgtcacgctcaattaatgctagataataatatcccaattaaagctattcaaaatagaatgagacatagtaacgttacaactacactgcaaaattatgtcactagtagcgaaaagttagataaaaatactgttgatgtaattgaaagtgtgctataattaacgaaaaaacgacctagcataaaaagctaagtcgtcaaaatgtagtcaattcaataaaacttatgaaaatttgattgtctattttttataaactccccagaaagtttcaattgtatcatctgttggaggttttgtaattttagatactataataaaagaaagtagtgatattaataaaggaagaactatagtgtgcatcccaaatggtcttggccaaatatagctaaataatatatatgttaaaataccagttattatagatgctatagctccacttgcatttgcccttttccaatatagtcctaaaacaattggccataaaaatgtagctattattcctgcatttgcatatagatttaaccatactattaaatctggtggttttatagctacaatgtatataattatacctaaaactgttgtaactaataaacttatagtagcagtttttttagcatctttttttattttaggatttatatagttagtatatatatcatttactatagaaccagaagcaactaatagttgagaatccacagtcgacattattgaagctagtggtcctgctaaaactatacctgctatcacaggtggaaataattgaatagttatagttggaataactaaatcgccggattcaatccctgtaactaaagttctagaaaaagcacctactaaatgcattcctaaaagtaataccatagatactatagttccatattttattccatcgtgcaaactcttagtatctttataactcatagccctttgagaaacagatgggataccaactactgcaaacccaactaaaatccaaaaagaagttacccatgccatactcatatgccctggagttacaccaaacggagttataagtcctttatttatactttgcatattatttataattctctctactcctccaccagctattagtgttcctataaatattgcaatggttgcaatcgtcattataatcccttgtattgcatcggatatagtaacagctctaaatccacctattactgtatgtacaattactgttattccaaaagctgtaagggctactttataatcaattccaatagctccttgtaaaagtcttgctgctcctacccattgtgctgccatcgctgctataaaaaatactactatagatatagatgttaatataactactgagtctgatttatatctttctcttaaaaaatcagtgattgtcactgcatttatttttctagctataattgcaaattttttaccaagaactgcaagcgtaaaataacctgttggcatttgagccatagctaaaaatacccatcccaatccttgagtataagccgttccaggtcctccaataaaacttcctgcacttaaataagttgtaaccaatgtcatagctaaaacaaacccacctaaatctcttccacctgtcatgtattcatccataaatcctttttctccggcagctttatttttagctctatttacaaatttcattgaataaaaacctactacaaacacaactataaagtatattataataggaattaaaacttgaaagtttatagatttcattatttatattcctttctatattcttttaactcatcttcacttaatccgtccaatgacatatttttgaaaaatttatttatcattataacggttagtatagaaaatagtactcctcctactatacaactcataaaaaaccatgatggaaaaccaaacatatatgtatattctgatacaggttttgatcctaaaccatagccaaatccaaaccaccatattaaattgactatacctaatactagtcccattatagcctctttattacattgtttatatctaggatcctcttcaaactcttttccttttctcgtcatatagtgtatctcctttactcatatttacttatttaatatgtccaaaataaacttttcatattttagaaaattattctagtatacaatatacattaaaaatataccttatccatgagaatatgtctataaaatattagaaattatctaaattcatattaaaattaaacataaaaaaacttgcaaaattaaaattttgcaagtttttttaattaacaagtagctccacctacagtatgtaattgagcttctaatatttcttcttttctttcaagtacttcatcccctaaaacttgaacttctatgttttcaacacctattctatctatcatatctccaaagcgttctcctgttttaccttgttctctatatataagaagagtcttttctaatatattcatcatttcttcttcactatgtattcctgatataggagttcctggtcttgaagctttaccccatttacctcctaagtatatctttaaaccttttttcccctcatcaattgcatcaaaatgacattttcctatacataacccacagttattgcatttttctctatctatgaaagctttaccatcaactatgcttatagctcctaccttgcaattatctctaggaacacattttttacatcctgaacacatatcttcatcaaaatctggtacaaactgtcctattactccaaaatcatttaaactaggctttatacagttatttggacatcctccaactcctattttaaatttgtgtggtaattttacatcataccatttttcataaaactctttatgaagcttagttcctattccctgtgtatcgcaaagtccaaatgtgcaaactgtacctttacatggaactataggtcttactctagaaccagttccacctgaaactaaattatccttttttaaatgctctttagtattttctatatcttcatatttaattccaggtatttctaaagtaagtcttgatgttaatgatatatctccacttccgtacttcttagctatttctgcaacatttattaattgatcggcagttatagctccattttcagttataaccctacaagaaaaatgtttcccatcattatttgataaaaatccttgtcccttaacttcttttctcattgcatctgttattttcataattaatttacccccatttcagtgtttatatctctatttaaagctaatccgccttctaaaatttgtacatccttatatccaaaatgtttcattctattgtatgctaaataagctcttttacctctagcacaaactaaaagaattttatcatcatactcaaactcatctaactttccatttagcgttgctaaatctataaatggtataccttctaattgagtttttttatttacatctgctaatttataatcttcttgattttcaataaaatcattgtaccttactatttttacagctccatcaattttatttaaaagtacatttgccacatgtcctaatgggtgtatagctgttgaaaaaggtggtgcatatgctaaatctagattctgtaaatcaccgattgtagcattaaaagttattgctgttgcaactatatctatttgtttatcaacatttccttctccaaatatttgagctcctaatacccttttactatttttatctgctataagcttaataattatcattttagaatctggataataatgtgctttatcatctattggaactatgacactttctacttcatagcctaaattttttgcatctttttcagttagtccagttcttgctgcatttaaatttaataattttactattccagttcctaatacaccgttaaatggagtcttttctccacttatagttttagcaacacatcttccttctttatttgcagatgatcccataggagaccatacaggctttccacttagtatattttttactgttacacaatcacctactgcatatatatcttcatcattagtttgcatatattcgttaacttttatagttttatttacctctaattctaaaccacaatcacttgcaatctttgtattagctcttatgccaacagccattactataatatctgccttcatagctcttttatctgttcttactttctttactttattatctccctctatagaaattaatctttcttctgttaaaaccattattccattttccattaattcatcttcaacataagaacatacctcatcatcaaagcctggcattatgtgatccatagcttcaaccaaagtcgttttaactcccatttcatgaagattttcagcaacttcaagtcctataaaccctcctcctactaccacagctctttttacattatcattttcaacaacttcacgaacagctatagcatcatttggagttctcatataataaactccttccaaatctattccttctataggtggttttactggatctgcacctgttgctataaccaatttatcataattaaatttaacttcttcattattatttaaatttattgcatttactattttttcatttctatctatagataaagcctctattcctgttttaacttctacctgagtcaaatcagaaaaactcttcggagtatttactatcaaatctgatttattttctataactcccccgacataatatggaagtccacatcctgcatatgaaatattctctcccttagttataagagttacatctaaatctctattttcacgttttagttttgcagctgttttagtgcctgcagcaactcccccaattactaatactttcatattacccctccaaaaatttatattaattatatttttaacaagttctatttaactaaagtgtatcaactgtatagtataatgtaaaattataaaatcttattgatttataaatttaacttatagtacactttacttatcaaaagtgtattgggggatactatgatagattttagattaaaaacatttatagacttatgtgaaactagaagttatacaaaaacggcaaagagactatgcattactcaacctgccgttagccaacatatcaaatacatagaatctaaatataatataaaattatttgattacataggaaaaaatttaattctaactaagctaggtcaagattttttaaataatattttaaaattaaaaaccatgtctttatctattgaaaatgatttaaaaaattcaaaatgtatatctaaatctttatcatttggggcaactcgtagtattggtgaatttgttatgccaaatattataaaaaattatttaagagattgtccaaatgctaatttatccatggttgttgataatacaaaaacattattggatatgctaaaaaaaggtgttttagaattttgttttattgaaggtcattttaataaagcagattatgaaactcacttatttagttatgaagattttatttttattgcttctcctgaaaatcaccttgctaaaaaatccaatttatctattgaggacttatttggagaaagtttaattcttcgagaacaaggttcaggtagccgagatatctttgagctgtggctttatgaacaaaattattctcataaaaattttaactccctacttcaagtaggtaatattaatttaataaaagatttagtaaaaaataattttggtatatctataatttataaagttgctgtaatggatgaattagaaaaaaaagaattgataatgctagatataaattctatgaagttatctcatgaatttaattttatatatttaaaagattctatattcgcttcagaatatgtggacttttttaataaaataaacaatttttaaacaccttaactactgttaattctcacgttttagaaattttaaatttatatttttatttattttaattttttaattttaaaaaacctgttgcaaaaaccttttctttagcactataattcaaatcaagagctggataaatatttaattaacaatatttatttttagggggggtttttatgtcaacaggaatgttgatgggattaggagtttgtgcaattttagctagtatttctacatttttaggaaatcttcaacatatagttggtgcacctatgataggtttatttctaggcgctttattaggaaatataaagcctgcaaaaggagactataaaaaaggaacgacatatgcagcaaaaaaacttttaaagtttggtattattttagctggtgctacacttaactttaatgcaataattcacactggtggaaatgcacttccactaattattacaaatatatgtatatcattcttaactgccttattggttggtaaagctctaggagtttctataaatacaagaagattggttggatctggtactgctatatgtggaggcactgctatagctactgttagtccaataataaatgcaaatgatgatgaaatggcttatgctttgacagcaatatttttatttgatgtttttgcggctctagcatttccatttatagctaatagcttaaacttaactccagatcaatttggcttacttgctggtacagctataagtgatacatctagtgttgttgctgctggtgatacttttgcaaaacttataggtatatcttctgctgctgaattaccagttatagttaaacttactaggactactttcttagttgtagtagctattgtatttacaatcgttgttgtaaatgaaaaaagaaaagaagctcagcttgtaagcgcaaacgctttaggcgattcatctaatgaacctaaaaaatcttttgggaaaataattatagatgtattcccttggtttatactaggctttttaggtatggctatactaaatacatttggattttttcctgaatccatatctccatttttcaaaaaaggttataaattcttggtaactactgctttggtaggtgttggttataaaataaatataaaagatttgtttacaaaaggtgcaaaacctatgattttaggtggtataacttggtgttctgttgcaatagtggctatgggttatgtgcttatattaatgtagattttaatatgttttttaagggatgacaaaaatcatccctatcttaatttattttctaaagttaactgttctaacattatctttattatatttatttatatttttagataaagttccttcttttaatccaaataactcttctatatcttgtggatatatgctaagaccatagttagctaaattattcataaataatccttcattcattaatttactttcaattaacatatcaaatgattttttaagtaatattggatgagtagattttatattatcatctaatggctcttttttagaccatccttttttatcaatttgattcattaaatacatatattttttgtaacttacttttcctaattgatatcctcttaaaatcatagcccatataggaactatccactttttctttagctctatataatcttctaattcatgtactccttctaaatcttctaaaaagctttcttttggcattaaaaatgcacatgcgaattcatcttttgaaaactttttagattggatatttgcttcaactgatattatatatgccaattcataagctaagtcgtaatttcttataggagctgattttttgtcatttcctaaagctataaagtatctagattctttgtcgatactttgtttttgactaaaagctaaagccccttttttgtctatatttgtagctgatataaatataccatttatttcaagtaaactaaccatatttcctataggtccattgcctaaatcaaaaaattctcttactttttgagctaattcttctatatcatcatttctatttaaattattaggtaaattcatttcagggaattttatatatccttgtataaatttaagtaatctgtgagtcattactaatttttcttttaaagctatatcatccactcttggtaatgtagattccgttctaatatgcgtattttcaactactacatttacagcatctttttcactaaagtaatcttttgggaaacttaaggcattagctaatttcatttcattttctaatgttggcttatatttatctccttcaaaagctaatatatcctttttgtttattttagtttcctttgctaaaacatctacagtctttcctctatatactctagcattttttagtttctttccgttaaatatttttttactcatattattttacctttctatttatgtcaataaatctaatattgcatcattagataaatttttaagcactcctgaatctgacaattcattacttattatatcatctattaacttgcttttgttttcttgaagcttaacaattttttcttctattgttcctttagctattaattttataacttctactgtttgtttttgtccaaatctatgtgctctatcacttgcttgattttcaactgatatgttccaccatggatcaaagtgaattactgtatttgcagaagttaaatttagtcctgttcctcctgcttttaaagatattaaaaacacttttttattaatatttttattaaaatcatctactaatttaattctatctgtagctttagtttgtccatctaaataattatattctatgttttctttatcaaggacaactgctatattttgtaatacacttgtaaattgagaaaataccaatactttatcatcattttctatgatgtcttttagtatttctatacaagcacttatttttgagctttttcctttatagtcagttacaattaagcttggatctaagcataattgtctaagcttagttaaataagacaatacagtaattttatcattactttcatatttatcttgtagctttctttgtatttcatctacgtaagttttatatatttttctttgttctttacttaattctactaaaaactttttttcaattttatcagacaattcttttataacctgctttttagttcttcttagaatgaaaggttttataagtttttttaatcttataatattactttcatctcttataaagatagcattaaacttacttacattgtataaataccctggcattatgaaatcaaaaattgaccataattctaataaattattttctataggtgtacctgtaagtgcaaatttacatttagcttttatacttttaactgcatcagtagttatagatgttgggtttttaatattttgagcttcatctataattatataatcaaaatttatattttcatatttttcacagtcatttcttagtgaaccatatgtagttagtaacacatctatgttctcaagattatcaattattgattctctttcttttttacttccatgaactatacctatgtttaagcttggcgcaaaattttcaaactcacttttccagttatgtataagtgatgttggagttatgacaatacttttacatccttttttagacagtaaaaatgttatggtttgaagagttttacctaaacccatctcatctgctagtatacccccaaatccacaataatctagtgttttaaaccaattaaaaccttctaattgatagtctctaagattagcttttaaatcaccaggaacttcataaactatattttcaatattgttgaacttatcaattattttattaacattttcaataccatctatatatggaagtttcttttctgttaatatttcatttatatacatagctttactttggtgtatattcatttcttttatgttattagtaaaacctaaactttccataagtttaaacatttctttagtttcatcttcttctagatttatgaagtttccatttttaagtttataaaatcttttattagctttaaatgcttttagtatttctttatattctttgctatctacatcttctatcttaaacttaaattctaagtagtgatttatttcttcgcctaatccaacttttatattaaaagaattatatacttttttttctttgaatttgtctgagtaataaacttctccaatgtttttaagcctatttatttctttacttaaaaaattatatagttgcgcatctgcacctctaaatacatacttatctttgtctttttcaaaataatttgtatatagtctatatatggctgcttcttctttttcaacatctctaattacaaatttaccttcatcttcaccttcgtagtacatttttacattgcaaattattttagattcttctaaatcaaagtaatattttacaattaaatcttttgctatattattagttatactgtcatctatatttatactttttgatatttctttaagttttggtatcaaacttgttagacattcacttatttcttctttttcaaacgctatagttttatgttcttttaaaacctcgtatatctttttataataaattccattcatatctgaaagcaaataaacattgccttcataaaatactacatctcctttatttgataaaggtattggtagtttttcgttgtttgatataactattttatcttctactttttttatatctacatttattggaacattactatctatgatttgtggattataagtttttctgtcaaaattaaaattaaattctttatacctcatacactccataagccttttaagtaaacttgagtttaatatcatatatctattttttcttgcatttatattgtcagctaagcttaatccatagtcttctataaactgtgccaagttttcatcatcctcaaaataactacttttagggtcatatacaaaacttcttccataaactatgctgtttccttctattctcgctgctgcaaattgcttaaaatcttttagcgcatacattttatcattgcctattttaaattctgcttctaaggtatcatttaggtaatttgttatatctacttctatattaactttttcctttggaattactttaaaataatttaataaatctttatttataaatcttgtatttactttaggtttagttttttcttttatatcaagagtttttagctttaaattatcaactatatttacttttagttcatcaattccttgtaaagtgattgatgctatatgcttacatataaagttattgtggagtgtagtgttttgattgaaatcttcacaagtacaaccactacttataatctctttattatctatgtctataattaaaaagctatcataaatttctctttggtatttagaaactatgcttccataaaaactaattttattttcttctttagaataattactttcttctatgtaaccttttttataatagtctcttcctctatctaatctatacttatctatattttgtagtaatacttcatttactattttaaagtccatttactcacctaatttcttttaagtcatgacttttattatatattttttgttaaaaataataaagactgtagtttattatttttaaactacagtctttatattactttaattttatctaattattatcatttcatgtccataaattttatcaattttaaacttaattttgttattatctttaataaaatttatactttcatcactttggtattttctaatactacttatattaaaatcctctatttctaaagtaaattcaatatcaaataaaggtattatatcttctatagtataaatatcttgagatcttttttctgttatgtaatgaagtaaatgtagtacataaccatcgttgtctaaatcatattgtaatgttgataatatggtagatggtccattgtggcttaccagtttactgttcattaataaatcaattgcatcttttgtaatttctttacaccatctagctgcattttttctatatatactaaatataggatgagcaaaataaattttatttttatgtaaagtagcagctgaattacctatctttttactagatggagtatgttggtgagaacaaaacttaccatcttctcccctattaaaatatggatttattgtatctaataagatagctgaattaacacactttgtatctattttacttaagtacattacaaattcttcttttggtaaactttttcctattttatcatttggcattataaagtctctatcatactttgattttcctaatcgcttatttccaaagaaatctatttcttcatttaaatctaaactttcatagcttcctattacttttcccccattttccacataagcttcaagtctttcttttaattttaaatttccttttatagtatctggtatgattattaatttgtagttattaaaatcaatgttcatatcaataatatcaaattgatatgataattcttgtaacattctaacagctcctactaaagcttgagatgttcctttttcattgttaaaaccttctggtgttaataatccaatttcagatataactttaacatttgataaatatttttctttttctttaacagatttatatacttttcctattaaatcataagctgattttgataaattcccatttggatgtaattgatctccaattgaacatttacatccttgtgctagcatgttaaaacattcaaactctaaggctgcttggttttttaaagaatggaagtctccccaataagtatggaacttccctgtcatacctaatatttcctttcctaaaagtcttgcaaatcttacagttgttgggaaatgatcataaccccatcctccacttggaagtgactctagctctagatgtgtaaatgaatctaaagaatcccaaaatctaggtcctatatgtgagctattataaaaaatagtagcatcttttactttagagtttattaaatctgttacttcttttctaaattcatttaacattatatttgaataagctagtctttcttcttttatgttaatatctatatttaaattcttcatcttttctttacaataatcacaactacaatctactgcaaataaaatatccataaaaaatccatctatattttcacatcctactgattcaattatatcaattatgtgttctttaaaatattctctatatggtgaatttaaacatatcgtattataaaagtgtggcttttctacattctgagtacaaattggatttcctttgaaatctttacttaaccactgaggataattttcacttatatacccatcccattggacagtcgtgtaaattgggacttttatgtttagttcatgacatgcttttatttgttcaattaataaatttttattttttaaatttgggtgaatcatatctggtttatttctagatggataatataaccatccatgatgacacctagcaaagcatgttatggaatttacatatgctttatcaagagtttgtgcaaatttattgctatcaaaatcaatacctatatcatcaatatattcacttgtatgaaagtctaaatgtatttgtctaaagtttaatttttccatgttatcccccttattattaaattttaaaaataaatttaatcttcttaataataattctatttttcatattaatatacctactaaatatttaataattattaaataaaaataaggtagctttttaggctacctttaaatgtatattttagttagttatttgcttagttaaagctccttgtctttttgatgatacttttttgtctactgtttgactttcttcgtattctgattcaaatgcttgatttctttgattatgatttaccatagcttgtaatgattgagcttcgtttttatactcatcatattttttagattttttcatataatcaccctttcttaatttcttaagattaggttatgatttttgaagttttttaaacgatataaaatttaccttattagtttaaattaagcttcttatttaatgtataatttaaaattaaaaacaaaataataattaaaaatatattttgtaatattccaagagtcattactttgataaatgctcccataaattctaaatttgaaatatctggttttaatcctatattattatttattgtatttaaaatagttactaagctacttattgtaataaaaatcaaaattgctgagatgtttttgtacttagcaaatatagataattgagatattgcaattgaattatagactataaatattattatagatactatacttataagcaataatattgaaagtataataactattaaatctttattagtacgtgttaactcttggaaactaatcactttatcatctatatacaaggtaattcctgatccatacattactcctatagatgtcgcttgttgaatcataaataaactatacgaaattaaagtaactataatagttgcaataatccataatacagacgatatatatttagatagtattaacttagtactacttaaaggaagagtaaacattaaatatccttcatcttctagtaaattctttttaaacctttgtatacatattactatggttaaagtaattaatgctacaagcaatgccatagtaactataccaaaaatttttttgttagataatgatatttcactgcttataaatatactgtttataatacacatacctaatatagaaatatacattggtactaaaactttagcagttgctcttagctcatatttcagtagttttcttaacatttaaactcctccctaaataaagcatctatagacatacctttattttcccttatatcatctacttcaccctttaatataatttttccattagaaattattattacttcatcacatatattttcaatttcatttataagatgtgtagatattaaaagagttgagtcttcattataattttttaatatagtttttattatataagctcttgatgctggatctaccccaccgatcggttcatctaatatatataatttcgcatttcttgacatagccaaaattaatgctactttttctttagttccttttgacatagactttattttttcatttatatctatgttaaggttttcaatcatatctttagcttttttcatgtcaaaatctttataaaaatcactaaaaaactttaatacttccttaactctcatatcttcgtttaaatgattcctatctggtaggtaagatattatttctttagtttttactgatggctttaatccatttattttaactttgcctttatcacattgagttaatccatttatcatttttatcatagtggttttgccacttccatttggtcctaatagtcctactatctttccctttggaatatttatatttaaatctttaaatacttctttatccccaaattttttatatactccttcaaattccactatactttcattcattattacccctccatgatattagtttttataatgtttataatctcatcttttttatatcctaattgtattaatttttcttttaatgaatttatttctttgtctgctatttcttttctcatgttttttatcttatcttcgtcacttgttacaaatcttccacttgttctttgactatgtaggagcccttccctctctagctctgccaatgctctttgcatagtgtttggattaacttctgcttctgatgccatatctcttacagaatttaatttagatcctatttcaaattcccctgatattattttaaattttaatatatctactagttgtaaatatataggtttattattgtcaaattcccaggtcaagttttatcacttccttattgtattaatcacttaatacaatagtataataatttaatatcacacgcaacaatatttactaaatttatttaaataaaaaaactatcttaaaatacatataaaacttagtattttaagatagtttttttataatgctaatgtttccttttgtataacttcttcttgtatagttttagtaactccacattcttcattagtatacttagtttcaaaattagcaattttttttacatcatcatgtccatttttcatggcataactataatacgcacttttcatcatttctatatcatttaaatgatctccaaaaaccatagtttcttcataacttatatcaaacatctcttgtactttttttattgctattcctttgttagctcctaagctatacatatctagccaatatttacctgatggagttaatgttacattttctatattttcttttttaaatctagaataactatttgtttctgcatcttgcatatcaaacatattaactttaaatattacatcatctacatctagtaatgaatctacttttataactggaacattcattggaaaatgtatattaagcaattctattgctttattattttctaaatataacccctttgttccacaaagcacagggtatgcatcttttacatcacgacctatttttacaagtttgtctatagtatctttttccaagaaattagaatatatacacttgtctttataatatatagctgttccattttcgcatacaaatagtaattcctctttatactcattgaatttataaactatatctaaataatttcttcctgtagatatagcaaatattatatttctttcttttaaagcttctatagtttccttaaagtcatttggaatttcgtgattactatttagtaatgtcccatccatatcagttgctattaatttaaccatgatactcctcctgtttatttagatatttttataaaaactattcctataagtatagctacaaataaagaaaaaaccgctctatgtgttttctttaatttgtattcattataagctaatgttatttgttgaagcgataagccaactaatatcattttagttataaattcccctgcaattatttttaacatggataaaaaggcacatataaatataattacacataatcctatgttaagttgttttaaattgttattataatacattcactaccccctagactttacttattattattatacataaaaaatgtaaaaactaaaagatatgcatataatattacaaatatttaatatactgttgtctatatacttaaaaagctatacaatatagtaattaatatttattaatgaaagaggaaattaaatggatgaaaagttttatgagaaattattaaatataaatactacaggtgagaaactttggaatgaaagtataactcattatcatccttatcaagctacctcatacatcgcccttgatatattatttaaaaattatactatgaataaaagtgattatgtagttgactttggatgtggtaaaggaagacttatattttatctaaatagtttttttaaatgtagtgttactggaattgaaatggatgaaaattattacaaagactgtttaattaataaagagaattacttagataaacataaaaggttatctactcaaatagattttaagtgtatgctaggtcaagattataaaattaaacctttagaaaataaattttacttttttaatcctttctcaattaatatatttagaaaaatcataaacaatattttagattcttatgacgaaaatccaagagttatagatttaatactttattatccttctgaagattatatatattttcttgaaaataatacaggatttttactatttgaagaagttagactacatggattatatgaaaaagattgttgtgaaagatttttagtttatagactatattcataatttagtaaaaaatagttggcaacttgccaactattttttatcttctttgtttttaatttttcttattattaatattgctaatactattattaatattagtatagctactgataatattaatatattttttatattcggtacttttccctccacatgtatgttatttaaattatttaatgtaaagtcccagttatatgtgtatatgccattttttacagagttagatgtagcatttgattcagtaagttctattggtacatttaaatgaagtcctaaattaaatcctgaaccaaataaattaagcactcccatttcttctttactcatatttttttgcatatagtcttttaattttatattaacatcatacattgagtataagaatttctcatttttctttatgtctataatgtcagcatattcactaaggtttttgttatcctttatttttaaatcggtaatatttcctagattttcagttattttaaaaccactttttcctgattcttttattttttcaacattatcaaattttgattttaaatcttgctcttttatattttccattaaataatcgttacttaatatttgagtagatacacttatatttccttttttatccacatttaaagttatatctgaatctacacaacctgttaaaattacaacagtcataaacattataattgatattagtaattttttcatattttcccctttctttagtcataacttttattgtttgattatataatagtaaattatctatgttttgtaaattactatctctacttctaattatatattcattacgttattatatatttatatgcttaaatttatttattgaaaggaagataattgtatgtataaaataaaacattttaaagatttaagtacaaatgagttttatgaaatagctaaagctagatatgaagtttttgcatgtgaacaacatatatttgaagaaaatgattttgatgatgtagataaaaattgttatcatatttttctcgaaaaaaatgataacatagttgcttacgccagaataataccaaaagaatttagttcttatgaagatgtatctatcggtcgtgtattagttttaaaagaatctcgaggatatggtatagcccgtgatatgatgattgaagctattgattttatcaaagataatttaaaagaagaacatataactttatcagctcaagaatacataaaaagtctatattcatcccttgggtttaaagaaatatctgatatttatgatgagtgcaatatacctcatgtaaaaatgagattataaaaaagctattttaaaatagcttttttatatatttattatatcctgtgatatttgcatatttttatctctttttagctgatatcataagaaacattggtcttttaaactcatttttaaagtatggattttcatctaccatatgttttgatggtactggttcagaaatttgtataatattaaatccagttttaataagtgtatttatataattttcaaaagttctatgatattttataacatcttctcctaagaattttgtatttctaataccttcactttgataattatcaattggccaatttagtatatctccatcttttgagtaattccaatcttgagtttcatttgatgtaaatatcggatgttcaacggaaaatataaaatctccattgtcattcatactattataaataattttacatatcttatcaaaatcttttatatagtggaatactaaagaactaattactatatcaaatttctcttttgaaaaatttatatcttctataggtatacacttgtattctatattattataatttgtgctttcctttgcacggtttaacatattttttgatatatcaattccaagtactgaaattgccccttgttcagctgcatacatacaatgccatccaaacccacatccaagatctaaaacttttttacctttaaatgatggaaacatattttttaaaatatgccactctcctgctgattcaagacctttggtcgaacgatccatttggctatattttttgaaaaattcattatcatcatatttattttgcttcatgatttttccctccccataaatttatttagtaaacaaataatatcatttattttaaatgaatatcaactcatatatgttatttatctttttagatatagcttattacttatatatgagataattttaattaatataaatttatagtataatgttaaataatgctaaagagaaacattattcaattttagttaaagatggtaaaatatttaaagttggagaaaaaatgatttattaaaattcacaagtaaaaatacacaaatgatagatttagatgtaatttagataatgaaatcagacctgtaattatacatgcttaattgcttcctaaagatcaattcgattcagtaaaatctcttaaaatgataccatctttctttttagcccatgtttaccattggggagatattcatattaaaaactttggttttaaaagagctagtgaaataagccttgctaattcttgtttgaaaaaaatataagatttacactccatcaagattctccagttataaatcctaatatgctagaaactatatggtgtgctgtcaatagagtaactaaaaatggagtgttattaggcgaggatgaaagaatttctccactagatgccctaaaagcagtaactataaatggcgcttatgaatatttcgaggaaaatacaaaaggtagtataaaagaaggtaaattagcatatttaattattttagataaaaacccattaaaagttaatcctatggatattaaagatataaaaattttagaaacaattaaagaaggtaattcaatatttaaaatataaataaaaaaacattactgaaagttttaattttcagtaatgtttttttatttatattttacttgtagtgtttattccattttgaatcataaaaatcatgacttgcattacccccatatgctttatcttctctataaatatattcttctatgtcttgataatatttatttgggttattattacaataatttctgcaatcttgacaataactaaaattatataatttaggacaaataataaatagcaaagaaatatcaataatatttttttcaaaatgtctaacacatatattctctaatccaataaaaatagattctatgatgtctttgcactcatcataacaaaggtcttttaacaatacaaattcacaaaatggaatactccaatgagctgagtgaagagattgttgacaattatcagctgtatatattattttgatattttttttacctgttataaataatttaggacctaatatcgtatttaaaacagagtaatcctcaatacatattttagcattaacctcgtttatgcactctatatcaggcttttcatctggaatacataacataatatcatctaaacattgtttatagtatttttcacatttagagtttggatatttatctaaagatgtaattccagtgatagatatattatcaaacatatccactcccccttaatttaatttttatataaatattaaaatacttacttattttatatatgccatttatttaaatattgttattatatttattgaaattttaatgttgtatttattaaaaaacagtaacaatatttaagtaagagtgtataaatttaattatggactcactatttattttcatactcttttattttttctttaatgtagtctgctacttcttctctaggtattcctaaaacaactgaaaactcatcattgattagaccttcagctactttcataaacctattatctatttgcccaagttttttcccatttttcatagccttatcttttttttcataaatacctgctattaaagttaataagtctgaacattcatgagtttgcaatagatttttataataaatttgtaataaccttgaatttttctcattacattttttgtcttttatataagggatactttcaattaattgttgaacttcttcataattaattaaacttctcataaagacactagtatctattggtgtgaatattttcccattttcatataatggtttaagtgtatagtaaattctttttttgttaatacctgaaatattgagtacacccacatcttctaccttacataccccatcatttccataaataatatattctccaatcttatacatcctctacatctcccatcttcctttatattttatatataaaaataaaaatcaataaatctgattatacttgtactctatttttaaatatataaaaaaagaccctcgcaaggatctttaaaaacaatatatatattataatatagttatgttttcagcttgaggacctctagcacctttaactatattaaagtttactctttgaccttcttctaatgatttgaatccatcagtttgtatagctgagaaatgagcaaatacatcatctccaccttctactgatataaatccaaaacctttttcgttattaaaccattttactattccattagtcattttgactatctcctataaaccgatcaagatttttcttgatttacttttgtattactacaatatttattataacacaaataataaatattagctagttttattatttttgatgtattatatattctaattgtactattctaattttaaatatttcttttaaatgtataatacgtaccatcaaaataacatatataaatgcatattattaaaaataaaaccatcactatatttaatacaaaagctttatctcctacataatagttaataacttggttatttaagatataataattttatataaaaattgcaaatcctacattactatgaatatcaaatttataaaatataaaaaatctataaaataaaaacaggtattgatttttatcaatacctgtttttattttattctttactatgcatattataagtaatttttgcacttttgggatcgtttctatcccatctttcttcaaatgtacgtttatatccaattgtttttatcttccactctccattaattttttcatagctttcacgataaaatgctccgcctctgattcccatgtttctatctaataatattaaattatctcctaaataccagtatgcaaaagctttagtatcactttcaaactcgatttcaggagtatgacattgatgcatagttatatgttctggtggcatacaagttctaaagaaatttacaacttcttcttttcctgtaaaagaaagttttccatctgagtaacttgtagttacatcctcacaaaaacattctcctattgtatcccataactttgaatctaaacaacgtaaatattttccctttaaactttttatagcttctatatctttaagtcttgtaatttctttttccatctctattaatcttttttctagcttttcaatcgtactcatactgtctcccccttttttaatttgcaagtactttttcgccatctggattttctacatctcctatttttcttgcaagtgttgctcctgcctcaatagcatgatgcacttgtcctggcttatttgcatctcctataacatgtacttcaatatcttttagctcctctgctaaattatttactggttttgcaccacaacagaaaattattttactaaatccacttagcacttcttcttttccatctttttcaactataacttttgtaccatcttctgtgatttctaaaagttttgtattagtactcattacaacacctttttcattaagcatttttataagaggtaccttattatttgggcatagatttggtgcaatttcacctaacatttcaatcatatggatttgtacaggtcctactgcattgtgcaatattgtttctgtaacttcacatcctacaagactgcctccaactacaagaacctttccatgtattgcatctttaacttttgcagataatacatcactacctgtaataacctcaatattttctatgccttttacttttggtataaatggagttgaaccagttgagataatacatatatctgcatttaatttttgtatatattcagctgttgcttctgtatttaattttacttcaacattagatttttcaacttgagtttttaagtatttaacccatcttgttaaatcttgtttgtgaggaggaatagatgcaagatttatttgacctccaagtctatctgacttttcaattaaaataactttgtgacctcttttagctgcaattcttgcagtttctaatccagctggtccaccacctactattactacatttttctttatttttgcttctgtaatagccatttctttttcacgaccaagctcaggatttatcgcacattttgcaactgggttagatctttctcttgttatacaaggtccaccacaacttgcacatggtcttatatcttcatatcttccttcaaatcctttatttacaagttcaggatcagcaagtaaaggtctaccaaatactactccatctacaacgtctctttcaactaaattttcaccaagttttatatcattaatcttgccaactacaaatacaggtactttagaaacttttttaatagcttcagcttcttttatgtttactcctggtgattcatagtggcaaggaattatcttccaacataattcatattgagttccaccagaaatttcaaaagcatctatccccgcttctacaaatttaggcactaaatacaacatatcatttaatgtgtttccacctaatactctttcatcacctgaaattctcataagtatagggaaatcatctccagcttttttctttatatttttaattacatcaagagcaaatttagctctaccgtctaaatttcctccatagcaatctgttcttttatttctaagcggcgataagaaagaacctgctaacatatatgcatgggcacagtgaaactctactccatcgcaacctgcttctttagctcttcttgcagcatcaccatattgttcaattatagattcaatttcttctactttaagttctctaactgattttcctaaaccatttatatagtttgaagaagctactggtgttttaccaaacatccatgaaatagattcaggtcccgggtgtgtaatttgaggaaataattttgaaccattagcatgaatttcagctacaaattctttaaatgtaggaataaatttatcttctcctaaactaattgtaaatcctagatatggaactgagctatctactgtaactgcatctacaacaataagacctactccacctttggctctttcaatccagaagtctttaagtctggaacttacatttccatctttttcttcataaccaaggctcataggtgccattaaaactctgttttttatttcaacattaccgatgttaattggtgtatatagtttaaaattatccataattacttctcccctaaataaattttaatagttgttttgaatttaattaagtgtaattatttccaatttagttgttttaaattttattattttgaattaattgaatttaatctgattatatttgaattgatttaaatgtaactgttttgaattttactgaaaataataagtttttaagtgattaaaatatatttcaattttattctagcaatactttccatataccgcaacattattttcaaactattttcttatgaaaaattattaatacattgtaaattcagtatttttattatatgcttaatttatttttcaaattttttagctattatttatttttcagttgttgcgctatgtggaatagttttttattatttttttaattttcattaaattatgctatactataagaaaaaattatatatttcgaaaggggtttatataagtttgtcttctttacaaagtttagatagggctttagatatgttaagtcttattcatgcaaatggtggtaaaatgtccgtttcttctattgctgaaattatgaacttacacagaagtactgttcatagaactttaaccacaatgtatcaaaaagattttttgtcaaaagatcctaaaacaggtctgtatacaataggtaataaagctcttgttcttggattttcagctgctaataatttaccattagctactactgcaagaccatatatggcatttttagctgaaaaatacaacaattcagtttctttatctgtaattgaaggttcaaatgtttttgtgataggaaactactctggttactacactacaactttttattcactacatgatgaccctctaaattgcgaggcttatcgtcctgctgtggctcattgtatgttagcttataactgccagttggagtcttgtaataaagcaatacagatttacctttcaaaagtatctaatagcagattcaaggataactttttcacaaatattgatgatttagttacttacttaaaaaaggtaaaaaatgatggttatgcttatgaatctggggagtatcatttcgatgaactttgctactgtgcacctattttaaataatgggaaagctatagcaacacttagcatatacggacacaaatcttacttaaataagtttcataaacaagatattattaaagatttattagatatttcaaaaacaatatctgatttgctttctaatagttaaaaaagttgcaaatattaaattttgcagctttttttaattttttataaaaatttataattttaattttttaaaaatttattgacaaattaaattatgtatcttacgattatctcaatagttgttttgaaaattttaatcatttctaataatataattatttcgaatactcaattctattaattgaataaaaatttatttatcatcttaaattaaattttttagttttgttttatcttctctagtttataaatccattgtaactgttttgtaaataacatataaactaaatttgaaaggaattaattttatgaaactaaaaaataaagttgcaattgttactggtggatcacgtggtattggttttgctatagttgatagatatgtcaaagaaggtgctaaagttgcaatatgtggaagtaaagctgaaactgcaaataaagcactaaatcttatccaagaaaaatatcctaatgctgatgttatggcagttcatgcaaatatgtcaaataatgatgaaatcaatgaaatgtttaaacaagtagttgataaatggggctatgttgacatattagtcaataatgctggtattacagctacaaaagatgttgatttaatgacagatgaagaatttgaaaaagttatggacgtaaatgttacaggaatattccgttgcacaagagcagctgttaaaattatgaaagcccacggtggtaatataattaacacaagctctttagtaagtgtaaatggtgctggaagacaatgtgcttatacagcttctaaatttgctgtaaatggtcttacaagatcatttgctagagaacttggtaaatacaatataagagttaatgctgttgctcctggttctgtggctactgaaatggtaaaagaatttgttacagatcaaatggttgaatatatgagacaaatgactccacttggaaaaatggctgagccttatgaaatggctggtgcttatgtataccttgcttcagaggattcttcatatactactggtgcaatattaaatattgacggtggaattgtaatgtaattttataagtataacgtataactaaataataaattttaatagtgaaaggtgatattattatgagctataattctttattttctccatttaaaataaaagatttagaaataaaaaaccgtgtaatacttccagcaatgatgacaaaaatggcttctcctactggacttgttactcaaaaattaattgattatcacgtagcaattgcgaaaggtggatgtggacttaattttactgaggtttgtgctatacacacaagtactcatggtaatggttatttagccctttacaaagatgaacattttgaaggtatgaaaaaacttatagataacgtacatagcgttggtggtaaaataggtgttcaaatttggcatggtggtcaagttgcaatagctctacttccaaaagatagaactcctatggttacagaaggtatgactcataaagatataaaagaaattgttgattgttatggaaaatcaactaaaatggcagtagaagctggctgtgatgctatagaattccatgctgctcatacttaccttcctcatacattcttaagtgctgcttttaataaacgtgatgatgaatatagtggttctttagaaaatagagcaagattttcacttgaagttattcgtactatgcgtgctaatatgccagaaactatgcctttatttatgcgcgtagatgcattagatgattatgttcaaaatggacttactatagaagatgtaattgagtttttaaagatggctaaagctgaaggtgttgatgtaattgatatttcaagaggtaataataagtctgcagctttaaaatatgaagttccttcaattgacactcctcgtggatataacattgaaaatgtaaaaaaaatacgtgattctattaaaatgcctgttgttggagttggtagaatcaatcatccagaaattgcaaataaatttatagaagaagaaaaatgcgatttagttgccataggtcgtggtcaaattacagatcatgaattctgtaataaagcaagagatggtaaaactgatagtatacgtttatgtgttggttgcttgaaggggtgctttgactctataatgaatccaaatattcctacaattacttgtatgagaaatcctatggttggtaaagaaggtcaacctattactaaaacaactagccctaagacagttttaatagctggtggtggtataggtggtatgatgactgctaacatgctaaaagttagaggtcataacccaattttatgtgaagctagcaataaattaggtggtcaatttaacttagctggagctgctccatataaaggtgagatgcttgatgctgttaattgggaagctaaagaatctactcgtttatgtgttgatgttagattgaatactgttgtaactcctgaattaatatctcaaattaatcctgatgaagtaataatagcaactggtgctgttgcttcaaaacctgaaataaaaggtatagaaagtaaaaacgtatttacttatgaagaagttttatctggtaatgtagaactttctggtaatgtggttatacttggcggaaaaatggtaggtttagaaactgctcaatacttaactaataaaggcgtaaaatgtacaattattgatgaagctgaaagattaggtggagatttaggctggattagaagtatgaatatgcttgaaaacatgtatgtaataggtgttaatcaagttactaatgctaaggttatggaaataaaagaaaatgaagttgtatatgttaaagatgaaactgaaactagtgttaattgtgatgctgtagtagttgctcttggtgcaacttcagtagctttagaagatgttcaatcaaaatgtagagatttagaaatacctttccatgttattggagatgcaaaaagtcctcgtgtagctttaaatactactcttgaaggtattgaaattgctcttaatttagatagtgaaaatgcacttaatatataattaatttttaaccttattttaaaaaggaagtagataaatttatctacatccttttttattactaaaaaaacttttttacttctacatatttcatatggctatataaatatttgatacattatttatttttcaatttatttattttatttaataagctttcatattctttttcatattcttgctttttatttatattatcttctatacatagcatagatattatatggcttaatttgttttctaaaactaaaattttatctttgtctatttgttcttgtttatcaagctttactatagtttttgacttttcatattcatttaaattgccattaaactcccttaaacttttatctttaatttcaattatatagtcacaaacagaactaataaagcttctatcatgagatactattaacatagttttatttgtacttcttaaggatttttccaaagcttccattgagataatatctaaataattagttggctcatctaataatagtaaattattgtcttctaatattattttacataaagctactttaactttctctcctccacttaaaactcctacttttttataaacctcatcacctttaaatccaaataaatttaaatttattcttatgaaagtttcgtcaaaagaagatacttcttttatattatctaatatacttttatctatgtttagtgtatcttgactttgagaaaagtatcctatctttactctttcatttattttgatagcttcattgttattttttagaatttcttttattaagctacttttgccacaaccattttcacctattaaagcaatttttttatttctttttattttaaacgaaacattgtttaataaaagttttttatctacttttaaagttaaatcttttacttctattaaatttttacttactatctccataccatcttgtatatatatttttatttgattaatattatttggtttttcttttacttccaatttatcaattctactttgtatagcttttatatttccatctaagtttttctttcctctttgtcctcccatcttatgaagcctagcttcagagtttcccattctctttggagtttttcttatactatttttaagttcatttttttgaattttagcattttctaatctgtttttctctgttttgtattgttcatgctcaaactcttgtctttttacctctttttctttaagctttaaataagttgtgtaatttcctttatatacttttatttttccttcatctatttcaactattgtattacataaggaatctaaaaattgcctatcatgagatactaacaataatgctccattatgatcttttaacattttttctaaaattttaatactttctttgtctaagtttgaagttggctcatcagctattatcaatttctttttttcttttaatgcatttacaatttttaattttactttttctccaccagataagtaatcttcaaatttatttggtgcatttaataaactttttattttattgtcaatgtataaatcttttatatcctcactttgacttacataggagtagctatttgttaagtatacatgtccttcatctatatcagtatctcttattaatgtttttatcaaagttgtttttcctgctccattagttccaactaatcctattttatcattttcttgtatttcaaatttatatatgtctagtattaatctatctaaataatatttttttaatttatctatgcttgctaatagcataaaaaaatccctccttatttacacttaaatataaggagagaccgctattaataggtacggcaaataaaagtaaaatttataatttactctccttaatttaagcatcataaatatccctaccaaagtaggttttaaaaatttataatactgtaaatttaaaaagtaaattatatgttcattttcttttattccgttccctttcttttaattttttattgtaattttaccacatttactatctattatcaacttaagtttatttccatgtgataaattttcgctttatttcgttatatataaacttatttagaattgtttcttatatgttctgctactttaacatcttctttttttatatgattaattatccaatttgcaactttactgttgatttctccaaccaaaacaatactcggcccattttctaaaagctttttatttatattttcaacagtatatataaagtgttgatggtgttttttatgattattataatctggatatttagattttatttgtaaaacttcttcatgagcaaagtgagtttttgtataagaagataagaattttactgttttttctagttcagctcttcctttccctttgctacaagcttctaataaatcattaattgcttttataagttctttatgttcattatcaatttgagtacttcccgttagtaagtcatcagtccatttatatgccattttatcctccatactacattattttatatatttatacgcctattaaaactttaactaaagctttttaataaaataatatttttgaaagattaaaaatgattattttatagttcctattttttgaattaaaaaactaagtatcgtagttattaatattacaagaactccataagccatagccagacctattttatattcaaacactccactaaccattgcaattgatactggtctgttatttatactatataaatatgcagaacttttattttctctaaacatctattttattatgttcaattcattttaattttttactgtaatattagcatagttattatatagttatggctatttacttataattgtatatgtattcttagagtttaatggtaccgtatttaaatatgtttctcctgttttattgaaatgaacagcataggtaataccattattacttccatctcttacaccttgtacttgtataacccctttgtctggaacacttatttttactggtttatgtctaattgaaaaaggtgctccttgtgccactccatctataaatacttgaacgtagtcattatcttctttttctgcaaaattccaaattgctatttctaaatttccaaatccgcttgcaacatctatagatgcatctttcgcatcaagctttaaattttctttacttaatatatctcctacttttatattttctatagctccagaggttaaattatccctataatcctgatttgatactccttgaaacataaaaaatataaacattgctatacatataccacctataactgttctaaactttttcatagaaggagttatatattcatccttctcttcatcatctttaaattgtttatatgaatcttcttcatatatatttactttatctatgatttcatctggttttgatttctttgtattagtatcacttaattcttcaaactcattttgtatatttttattaaactttttcattataacccccattagataagttcttcattataattttgcattttttctacatcttctaacatagtttttgaaagcggtctttttttataatatatcgatacaaacactctccaaagtactattgatattacaaatgatactattccaaaaatttttctacctggagttaatacttcataactccagtttaatatttcagttcctaagcctataaaaatacttgatataattaaatatttaagagtttcaaataaagatggaaaaatactatatattcttcttagtgctctaaaccttaaagaaatatacataatcattaacatacctataagtagtgaaatataatctccgtaaactgtatatcctgtacttattattttaaaagcatctactatggtcataattgggaaaaatatacaaataagtgccaataatggcatacaaattacaccataagctactgttattacattacttactatcttaaatataaattccataatttcacctctttcctataaattaacttcagatacatcacacgcttcaatagtaacaagatactctttagttaaattatcaattttttcaagtcttacagcttggtttcttactgctttttcaaatatatttctaacgtatctaccattcccaaaatcagaaactttacaagcttctttaaatatatctttcatttttaatctggcttctttagttattacatatcctttattcctaaataagttatctgcaataatcagtaaatcatcaactgaataatctttaaattctatgatatttgcaaatctagactttagtcctgggtttgtatctaaaaatttatccatatcatcactatatccagctagtataactagtaaattatctctattatcatccatcccttttaccaaagcatctatagcttcttttccaaatccactaccacttcctgcatcttgtgctaaagcataagcttcatctataaataatattcctccaattgctgactctattttttctttagtttttatagctgtttgccctacatagccagcaactaatccacttctatctgtttcaacaaaagtcttactatttaacactcccatactatacagaacttctccaactattcttgccatcgtagttttacctgttcctggatttcctttaaatatcatatgaagagtttgtgattcatctactggtaaccctaaagattttctctgttctcttattttaagttgtgcttgaaggcttcttataaattctttaacttcattaagacctacaacttcatttaacttttcatctaaattgaagttttcttctgatttagcataaatgccaaaatcttcttcttttaataatacagctgactgttcatcaattatatccatctcagcaattcttgatgattgttttcttattgctttttctattatatttcttaccattcttccatttccagattgagttgaatttttatgtttttctttttttatagcatcttcaagttcatcttctgaatttccatctaagataaatcctttactatttatcattaactttcctatttttactaactcctctatatcataatctttaaagtttatacttaaaggaaatctagattctaaccctgaatttgtatttaaaaagtctttcatttctttatcataccctgcaagtataactactatatcttctctaaaatcttctatgagtttaactaaagtatctacagcttcttttcctaaagggtcattctcagaagacattaatgcataagcttcatctataaataatactcctcctaaagctgatttgaatacttctgtcgttttcttagtagtttcacctgcatattgtcctacaagtccacttctatcagtttctataacttgtccagattttaatattcccatgtttttcataagatttccgataagtcttgcaactgtagtctttcctgttcctggatttcctgtaaatatcatattaagagactgagataattccacatttactccaacttgctttctcttctcttttgctattaattgtttttctaaatttcttacaaattcttttacttcatataatcctacaacctgacttaattcttcttcaagattaaatgattcttttttatctagtccaaaatcacttattgtaagtttatttacttcatctttatttatatctttttcatctaatttagctaatctatttgattgatttgcaatagcctgttctattatgtttcttgctaatcttccgtttccactatcatttttaccttttatctgcttaccttcaaataattctattaaactatcatctaagttttcatctattgtatatccatttgattttgctataactttagatatttcaagcaattcaataggagtataatcttcaaactcaacattataattaaatctagacttaagtccactattagtttttaagaaattctccatttctttagtgtatccagctaatataactactaagttatctctgttatcttcaactgcttttacaatagtatctactgcttcgattccaaagatatcattttcatctctagctatggcataagcctcatctataaataaaattcctcccatagcatagttaactttattcatagtcttttgtgcagtttctcctacatattgacctactaaatcatttctagaaacttcaactaagtgtccactagataaataccctagcgcctttaaatatttagccattattctagccatagtagttttacctgtacctggatttccggtaaatatcatatgtagagataatttagcttctttagctccattgttttttcttatgttttgaatttttatattgtcttctaattttcttataaattccttcacactacttaatccaattatattatctagttctttatttaagtcagataaactatctgattcagtaacttttaatatagatgataattttatagattctaattgattaactaatactaattcatcattttctaattttaattcatatatataatcattatttatttttcctgttagttctagttcaactaaaggagcatatatatgtttttcaacaaattcatctaacccatgagcacctatgcttttatcaaatttttcaagtacataatttaatacagagttatcaaattctatagatatatgtaaattattgtttatctttgttttgtattcatttaaaataaacttacaaattattgataaactttctctagtaagttcttctgtacttataatatcgtttatttttttcataaaattatttgaaaatgtatttttaatatattcttcatttttttcagttataaaaactaaatactttccatttgctaaaatttcatctgtagtattcaaagtaagattaccttttcctgtaacatctaccatttgtcctagttgatccatatatcttctatttagtttaatcttctcatctattaccagtttactaagcaagtctaaaacactttgatggcacttttcaaagttatcaaatacaactacctgttcactaccataaagtgcattataaagatctgataaaaataaattatctgcatctttttcaagtttatattttgaaagatctattgaatatactccatttttttttattattttttcttcttttaaaaatttagttatagcttttattgataagtgtctacctgatccttttggtccagttacaaaaattgtattacttacaccatttttatttccgtatacaaatggccttttaaatgcaattgctaacttggataagtattctttttggccaagtacataatctgaaagtgtattttctactaggttaaataccttgtctaattcttccttatttgtatttaactttgtattattaatatttactgttttactagctttaatatttttggaatcacttgacatatttgaaactaattgttcattaaaactacttattttatctttattagaaacaactttttcccctatcttacccttagtattcataatattattatttaatactttcttattctttttaaagtattctttatttatcatcccattttcttttatatgatctatcacttgaatttctggaaataaaattcttattagtttaggtccagataacgattttatttttgatttagatttccccatttaacttccctccttaatttgcttttatatttcttaactcattctatttttacatatataattaaataactgaaaataccatatactaaaatcatggatatttgtatattagagattaattataccatatttttacaattaagtaatatgaaaaatcctaactactttattatagctagggtaatcttcaaacttatttatatttgttaattacataaaaaatctctctttatatttatttaaatataaagagagatatattaatattaatttaattttatacttttatagtaatttcgtctaattcaatcggatttccttgttgttttatttcgtctaatacccatattccatttttttgattaaacttcaactactctacatatggttttgaaataaatttatttccacctactatacggccatctctttctatataatctatcatagaacctattatatatacccatataatatctacattttcgtaattatttttttctattccaattaccttagcagaaattaatttttccattttcaatatatttctttcatttcttattttcatccattcaagtttagttttatgattttcataaagttttttagttgagtattctattgctatatcttgatccatatttgtccaagcttttgacataatataaaaagcatcttttatatctttatttattttatccaactcccaattagagttgtatttatttaaatccattaatacacgtctacattattttttcttttttgttactttaacccaactaattatataatcagttttagatattattataatagttctgctcattgcaagcgtcgctactcctcctgaattaagattagattgttgcgtataatttgaagaaccacctcttgatcgactactggaagatcctccaccactattaaaattaattgatattaatttcacacatttgttctaatctccttgaattctatatttataaatttatttataatagatatattaattgaaattttctttcatagaagtataaatagttgttactttctctatttactactttttattaaatttccattttcatcatgacaagggtcttctccaaccacaggattatagtgtccatcaaatatatatatgcttattttcaatgtttcctcttttttaatatctttacctgcttcaattgattgtttagcaactgttccttttaaattatatactggtgtaggtacagcttgacctaactcatattttatcccatgttctttagcaaattcatacacctgaatttgattgcatcctataaaattaggtattttcccatttttatactttattttatttgcttgtttgactttagtttctattttttgaacatcatccgtttttttaacctttttctcttcagatttcttcttttcagtttttttgctttcaattttacaaactttctttggtagattatccgtaactagctcattattatttaatttcataataaaaaaagctactgttaatgtcacacttataactcccactataatacttataattgctaatttcttcatttctactgcctttctatatttcttttccccacttaaaagactaactcagtaattctactagactttcattttataaaaaatataattaaatatactccatattaaatgttatcgttgattttcatataaaactttaattatatttttattgtgcctataatctacataatttaatttcattttttatatctaccaggaatttttaatctatataaattaaccttagcattttatatctataataatttttaattcttctaacttatacttctttactatattaataagttttaaaaaaatattagtcttataaatattaagtaaaaagataggcttatcacctgtcttttttattttgaattataaatagtaaattcataagttaagccattcttctttttttattttataacattaattattttagaaattgcttgggatttttgttgaaattttagcttttatatcctaagactgtagtgtatatattatctaatttaattattttcgctctatctatatttccaaatttcttctctaatttattaaaatatttttcactataagaacatttaaatatcaatctagcaaatccccctactaaattaactattcctatcattatacaagtaaaattccaataatccatattttgtctcctctacttattataataatctattttcaacaattgtaatactataaaaaaatatactatgtaaatacattatctcctcttataattagaatcatttctaatctacaacttaaataaaggattttaaaacttaaaatctaattacttcaataaaaaggaaatgtgaatatgaaaattaatgaatgtgtattttgcaaaataataaaaaaagaagctccttcacatattatttatgaagacaaagaaatatgttgctttttagatatagacccaataaacgaaggtcatgtactgatagttcctaaaaaacatatacataacatagatgaagtagatgataaaatactacttaagattctaaatctttcaaaaaagcttacaaaagtatttaaaaaaacttacaactgtgacggctataccattatgcaaaatggcggaatctttactgactttggacactaccacatgcacatattcccaagatataaaagtgataaatttggatggacttgcaaagaactcacaaaccctgaaagtcttgaaaatgtaaaagaaaaactacaagtagagttaaaatcaataaaatagaaaaatagttatataatttatattaaattaataactatttttttagatattataaaagcatctatactacttcaagatgcttttataatagtattaatttgttgtaatatatttatcatctggaacaaattttacagtaacacgacttaaatctattttagttccttcttttaattctacattttgttgctctctttgatagaaattcgaatctccaatagttcccattattaaattcaccttaaaatttgaagattgaacatttcctccaccttttacagcaaataagtcatatactccttctggaatatctgtacctaccaaataagtgccattacccaatgtaacactttttgcatctaattcagcttgtcttttctcttcttcttgatttttcttttcttgagctaatctttcttgttctattttattctcttcttcttttttggccgtttctattttcatagcctctttttccgcctcattcatcttaaaatatggttcagcagaagcaagttttgtatttaaactctctatttctgtctctttatcttttacagcattctctaattttaaaatcttatcctccagtccatcatgttctctaactgcacacattggtactattaagtttgctaaaaatatacctattgctactacaataattgatttaaatttcataaatcctcctaaattttataaatgtataatatcaaaacccattatatattatgtcttttgtcgaatttggcaatattgtgcaattcttgtaatttttcttattttattgtatattcttaaataaaaataattattttaataaaaaagtatacctaatgtaattatttcaataggtacaatctttttattatcctaactattattatttttgatgaagtaatataaaaattttcgttttttcttattaatcagtattgcctctataaaaataaatatctttatagtctaaaatttaatctaggttttaatccactgcaattattaactttttaacttatttgattaaaagggcgaaggcatgggatttagagtttgttgaagtaacacttaaaaatcaacctttggtctttgtatggatgaaatgattctaaatctcataccgaagccccttttaaacagccttatcattaaacaaacttattcctgataacaaacatattgccccggaaagaaataattttagccaattcatagaaagccaaaactcacccccaagtactacatcaggagacgtattaaattcatcaacataaattgctaaattccaaaatagtttaagcgatattattaagcaaacaaaacttaatacaaatatacttatttttaaagttttttctttcatattctctaccccatttcatttataaattagatttttaaaaatgccctataataattataaattataagagcatataatttaaagaaaattccaaaaaaaggaggaattttaactatatacaaagaataaaaaccattaaagctctataaaaatacaaaaatggaggatgaaaaattgtataaactagacattcgtgaagatttttacctaaatgatgaaaaggtaaaaataatatcaggtgctctacactactttagagtagtacctgaatactgggctgatagacttgaaaaactaaaagcccttggatgtaacacagtagaaacctacataccatggaacttccacgaagtaaaagaaggtgtctttgaatttgaaggtgcaaaagacatagctaagtttactaaactagctggggaccttggactttatgtaattttaagacctagtccatatatctgtgcagaatgggaatttggtggacttccagcatggcttttaaaacaccctaatatacgtgttagaagtaactgcgaaattttcttaaatgctgtcgacaaatactacaaagaattatttaaaattatctatccgttacaatcaactcaaggtggacctgtcataatgatgcaaattgaaaacgaatacggctcctttggaaacaacaaaacttatttaaaaaacttgaaaaatatgatgattaaatatggatgtgaagtacctttatttacatctgatggtgcttggagagaagttctagaagcaggaactatattagatgaagacattttaccaacagtaaactttggctctcgtacaaaggaacaatttggttatttttcagaatttttaaaacaaaataatataaaaagacctttaatgtgtatggaattttggcttggttggtttagtaactggggagatgaatttaaaagaagagatgcagatgatgcagctaatgaattaaaacaaatacttgatatgggtcatgttaacttttatatgtatcatggtggaacaaactttggattttataatggatgttgctatcgtgatgaaatacatccacaaactacaaactatgactatgatgctttgttaaatgaacatggtgagttaactgataaatattataaatttaaagaagtaataaaaaattacactgacatccctgaagttaagtttagcacagttataaataaagtttcttacaatgatattaaacttaaaaacaaagtcagcttattctctactttagacaagcttgcaaaacctatatacaacgaagaaacattaaatatggaagctcttgaccaaaattacggatatatactataccgttctaatattggtaaaagaaatgacttagaaagatttaagttagttggaatggatgatagagctcaagtatttataaatgaaaactatcactctactttatacaaagaaaagtttgtaagccaaaatcaaactctatctttagataaagaagataataacatactagatattttagttgaaaatgttggaagaataaattatagccctaacttgctttcaccaactcaaagaaaaggtataaaaggtggagttatgattgatatacatcttcatatgggatgggatcattactgcttagaacttgataacatagataaggttgattttagtggatactataaagaaagcactccagccttttatgaatatgaatttgaagcaaatgaaattggagatacattcttaaatacagaaggctttggaaaaggtgttgcatttataaacaactttaacttaggaagattttgggatataggtcctactaattatttatacatacctgctccactaattaaacctggcttaaataaaatagttgtctttgaaacagaaggaaaatacaaagatactatatcactagatgataaacctaattatttataatttaagtttatattaatttattattttgggaggagatttgcaatggttttaaagaagtttatgaaaaaatcaattttagcaagcactttaattacatcaatgtttacatttacagggtgtagttcatcaggggatggggatagtgataaaatttcactaagatactcaatatgggataacactcataaaaaagcaattgaaactttaatagcaaactatgaaaaagaaaatccaaatgtggatatacaattagaaataatttcaaatggtgattattggactaagatggaaactgctgctgctggtggttctgctcctgatatattttgggttgatgctagaagatttggaacatatgcaaaatcaggtatgcttgtagaaatggatgattatataaaacaaaataaaattgacatgagccaatacctagaaagtataacaggaatatataattttgatggaaaacaatatgcaatgccaagtttctgggatgataatgtacttttattaaacacaaaaatgatggaaaaatacggtatagaaaaacctaagaaagattggaactggcaagaaatgctaacttggttagaaaatgcaaaagctaaattaccaaaagatatttatccatttacttcaagtacagtagaatatactcaacttggaatatttaacggtgtagctttagctggaggacaaattataaatgaagataaaactaaagctttaatagatactccagaaactaaaaatggatataaaacttatcttgatttagtaaaaagcgacttacacagtccatttgatgtaactgttgaaacaggtgcaggtactttatttaaatcagaaaaagccttagcttaccaagcaggttcatattcacttttaacattctcagataaagaacaagcacaagttgcaggaaactttgaaatatatccagttcctgctataaaagaaggtgttaaaactaagtctgtaatacatggtgttgggaatgttatatctgctaactctaaacacccagatgaagcatttaaatttataaactatatgtctagtgaagaatctatgaaaacttatacagaattagctttagtttctcaatctcataaaaatgttcaagacttatatggtaaagtaatgaaagaaaaaactggtcttgatgtaagtgtagtatatgacgttgcaaaagatgcaatgccacttccaaatagtgttgatacagctaaatgggataagattatagttgataatataagttcatatgttcaagataaacaatcttttgatgatatgattaaaaatactcaaaaaggtatgcaagaagttttagataaagaaaatcaaggtaaataatattaataaaaaatccagtagagttaatctttactggattttttttaacttgcaaaactgtaactttatcgtaagccaaatcgatagtttctaaacttaacctaatataaaataaaaatatataaacagtaattatttttataattatataagggagatgacaaaatgaaaatttcaaaaaataagataatatcattagttttaggagttacagttttagcaggtggtttctttgcatttaaagcttttatgggtgaaaactatccatatagactggtttatatatcagaacaaggaaatcctaatgaaaaattacaaaaagaagctatcaataaagtttttaaaggtacagatatgaaagaaactaactttgatatgcttgaagtagatgataaaggtactgtggttattgaccaaacagagtacaataaattagctaaagagaaaaaccttaaggaagtaaatcttacagatgatgaaacaatgattatacctagatatgacggtttaaagaacaagaaatacttagatgaacaaaaagaaaaaaaggaatttaaagtaaaagatatgactttaaaggtaaaaggcgttcttaataataaaatcctaattacaggcctttttaagaatcaacttgtagttagcgacaaaacttatgataaaatatctaaaaacagtaaaatactagacataagtgggtataactacgaagctaatacagatattaaaaataaagttgcaagcttatttaaaaataagttattctcaataagtgaaggagatagattattttatctaattggaaaagataatttaatagaaaactaattgatataaaaattaataaataactgtactttaaagtacagttatttttatatttataataaaattttatttcactttgtatttattgtatataattttataatttaaaatcaaagcaactatcataaatggtataagtattgataaagttagacttccaaaaagttcttctagtattggaattagtaaaaaagataacccgtaacaaatccacataattccattagctttattgtatgccttaacatcacttatttcgtcactacttacagtacttcccgcccaaaaatgcataggagtttttctttttaatgaatatatacctaaacaaataaaaataaaagttgctggcataatacttgtatatacagttagattatctttagattcatataaaaatttttcttcgctaacttttgaattttctttaatattatatttatttattaattcgttataagtttttactgtttcactgctttctttatcattgtatataaccatctttcctttacttataatttttatatatggtttacttttgttgtaaacatatactgatgcttttttatctgtatctacctgacaaattgctcttatataagtaaaagtgttagttccattaattttatttccaatatgaacatcttctaaaagcttaacactttcaatatcttctatttttattgactctccattaattgttattttatcttctttaaacttcattttatgacctgtagtatccatatttaaaaatactaccaaaaatacagtcataactattataatgcctgctactattttttgagccttacccatataatatctccctttatacaatatttttaatatattatatcagtttgactttaatatatatgtcgttttgtggattatatataataaaaaaatgaggaaactatttattcctcatttttcatacatctttttagtttataatttttcaactacagaaagatataaattagcaaattctctttcatctataatttcataatcaatatgcttacctagttctttaatcatattttctttacttttttcaacagcttcaactaactcctctgttaaagttccaagcataactaaataaacactattactactgtattctcttaaacatctttctaaatctcttattgtatcttctacattaatctctccgctataatttttgcaaattacaggaatttctattggcttagaatttaatataggatttttaatttctaataaaatatcccaatcatctttaagctctctaattataacatcagctccatctatagcactaaatacctttgaaactaatatatcaaagtcttttgatttccaatcgttaactagtaattttacaacatcagatactagtttttcacgtgttctttcaagttctatttgtaaaatagatttcacattaaaatctggttcttcccaaattttatgaactataaaataatttatttcttccatggtatcttcattgtatatttcataatgacttcctctttttgtcatatcatgtttaaatatcttactattgtaatttgaatctatattcacttcattgtttgttataggtttacaataaattatatgattaaagtcatcttgttctccatcaaaatcatatatactaccattaacttcaactacctttaccaccataaatttacgaagtggtctttctaattgaactatcaatatatcatcttttttaagtttttctaagataaatttagcctttctccatgctattttttcttcatctgtcttttcttttttattttctaaaactcttaaatcatttccctttttgctccatccaaatctcaatctaccttgtctgatttcatcaatcatccagtcttttttaccactgtttaaagctaatattttgtagtaatttaccatatcaatatccccttttatatatgtatttctatttacttataataatatcactttatattgatttaaatatggtttttaaaaatgttcattttttcaaaatttttttattattataatgattctctataaaaataaaattcaaaaccctaggaagtatttttctacctagggtttttatttatttttattaatctgcttctgatgatgaatcctcatcctcaacaagactacttaacttcttatcaaatatgaataatgctgcagctgcaacaaacattatatttggaattgtagtataaactttaatcatattaaattgaagagtaaagtcataaatatatccatatcctttaccagctaagaaagtggcaaatgtccatactcccattaaaacagctagcattttcttaggtgcatacttacttacaaatgaatttccaagtggtgagaaaaacatctctcctaaacttaaaagcactgcaaatgcaattagccaacctatactagctttaaatgcctcagaagctcctattcctcttgaaaactcagctccaacaagcataaaaaatgaaaaacctaaaaatattaatccaaaagcagtctttttaaataaactcatatccccttgcggtcttttagaaagttttaaccaaagtccagcaagaactggtcctaatgctatacaaactaaaccatttaaagagtcaaaccaaacaataggaacttcaaatcctccaatatttaaatccacatataatttaccataatcataaaccgcaagataagctaaataccaaaatacccagaaaagtacagaaaatacagatacaagtattatagcccaaactctttttttctcaataattgttaaaggagttttgtctttagtttcaactttctcagcaactactccttctttgaatggtctttttcctgcatttcctaaaaatctccatcctataataaaccatatcccgcctattatgcataacattgatgcaactaaaaaacattgagaaaatccaagcactccattatgagcaaatgttttcgcatataatataccaactgctgtagttcctacaaaagaacctatattaacaaaagaatattgtactgaaaaggctgcatctagttgttctttatcatcaaataattgtccagctacagctgaaacgttacctttaaaaaatgcagtcccaattgaaactaaagctatcataatacctatcattaaagttgaatcagctattgaccctaagtaatagcctatcgccataataaacattccaaaaggtatagtatatctagctcctatccatctatctgatatgtaccccccaattattggtgaaagatatgtaaatgcaacaagatcagcttgcatctttgcagcttctcctctacttataccaagacctcctgttagtacagttgcagtaagaaatgcataaattaaaaactttgaagaataatatgctgctctctcaaatgagaaagtcgtcgcacaaaaataaaatcctaaaggaaatttattcttcttcttttctactgttgtactcataaccctaaacccctttcgattgtgatagtaatttttatgtatatcattatccaaactctttcttgtgaaagatatggtgatatttctataaatcgttttctttaaatatttatatccctcttttttatttcttccctcaaggtaaatggtagcacaacgcatattcattagcaatacatttttagagtaatttcgatattatatgttttatttctacgaatttttacataaactttatattctaaaataaaaaaatctgtaccaaattatatttgatacagattatatattttaaattaattatctattatacctctgagtaattatacattctttcataagctagtgctaaagttatcattattttaggatataatgccataattactggtgtcataatacctaataatattaatatcatagtataatttagcgcattaactgcatggtaaaaaatcaaaactccaaatagtaataatactccttgtggaataaatccaaacattaacttaaatgatttaattctattttttttcatgacagccctgtaagttttaaatatatctttcttattaaaattatttcgattatctaatgcaataaatggaagtatgaatgtttctgagaagataataacatttatactaaatatgaaaaatacaagaaaaacagtagatatcaacataaagtaaaattgtactttaaaagaagcactaccactattacttgaaatctctgctaataaactaaatgctcccacaaaaactattgcagagattaagattcttattaaatttaaaactatataccataaagattgaattgcaaaacttatcaatttagcaactaaatatttatctattaagttaagtctagattttattgattctttattaaaaggttcatttcttatcaaatctagcgataaagagcacaatataaaatcagaaaatacagtaacaatcatcaaacttattcctatactcataatatctaacaattgcctatatcccatatattccccaccatctaacttaatagatttcattataatgcctacaatattttttattattggatttagtataataaataatattgccataaaaatcatcgttataaaaaatgttttatttactacatttttattattttttattacttctttcccctttaagcgtaattctttatttcccatttaaatccccctctaatttacatttataatatatataaattataccattgcttaatgtaaatttatattggtatacatattatctactcttggagctataaaaatcacttacaaagagagcttgacaaaaaataatttagttgttagtgttataatcacattatataaaatattcaaaaatgggggaaataattgtgaaattaactaatatagcaattataatagggatgatacttttaagttcaacaggctgtactcaaagtaatcaacttggtgataaatcaaaagtaactatatctgataatactagaaaaactgtaaaaaaagatatacaagttctagaggttaaagttgacttaaagcaacaaaataacaaagattcaaatactacctcttatttgcaagaagaagttaaaggtggtttagatttaggtacaaaaaagacttttaatatagatttaaaaaaaggagagtctttaagaattgatacaaaaatagaatatccaattacagttatgttaaaagataattctacaggagaatatgtatataataatacccaaacacctaaagaaaattctatatttattgatagtgttgataatgacggtaattacgaattaatggtagactttaatgaaataaagaaatttaattttagtttgtatatagttaattaataaaaaaagaagtattaatctttaatacttcttttttcattaattaaatttaaaacaggcactaaaatacttaaattatggactaagattatttaatattaatccattaatatctctaaaaacttttctttattatttaaaaatgaatgtgtaatttgataatgttctgtttcttcatattcaacttcatttattctatcatcctttatttcatagataaccgcatcaggatatgccattaaaataggtgaatgagtagctattataaactgacaatttaaatctaccaactctttaatccttgttagcatagccatttgtcttgatggagataatgccgcctcaggttcatctaaaatataaatacctctttctccaaacttatttaaaaatatagaaaaaaatgactctccatgtgattgttcatgaagagatacacctccataagaatctataattctccttccaagtacctctttatctagctcgtctatatttgatgccaaattataagtagtttctgctcttaagaaaaatccatctcttggctttttaattccctttaccacatttatgtattcatttaaatttgaatgactatccttagttgaaaaattaaagtttttagtccctccctctgggttaaatccataagcaactgcgacagcttctaacaaagtagacttacctgttccattttccccaactataaaagttacattattatgaaaatctaatttatttaatcctttcataacaggtaaatcaaatggatactgatttgtattcgtaatactctctctatttaaagttatatatcttatgtactgatttattttatcaccgttcatatatcctacctcctaatttaccctatataatattattatatatacatattataatccatagtaatgtattgtataattatattagagtaaatgattcaaaatcaaagacatttaaactagaaaactaatattttttatatataaaggggtgtataaaatgggaaatagtgaaacttgtccaaaatgtggttgtacagaaatagcagagggaaaacaaactggtcatgcaagaatatatccagtggataatatatttggaatgggctcaaatgtaatatatgagatatgtactaattgtggttatatattaggtatgagagttgaaaagcctggcagatttaaataaaactaagaaaagtctactaatttaattagtagactttcactataaattttctacatttatttaaaacaaaataaaaatgctaaccgaagttagcgaaggatgaatatataagttgaagcgacatttacaagcatctttttagcttgtatggagcaaaacttatatattcatccaagcgcccctcaattagcattatatacaatgttttaattcatgctcatatccatcatttagatttaagctttccatagattttgcactaacaacgtcaacaccagttcctaaaacatccttaacaataacatctccaacactaactggagcattaacctcaacattatctaaaagcttcataatatcaaacataagctccttaggaacagaatcattagtcttaacaggaagtaaatttaaataacctccatttaacttaacagtagtagttataacccttctaggatttgtaacttcctctactccatatttagctcctcttttacaagtatttccttcaactttatattcaccatcaactttactaacaactaaagaacatcccattggacaaacagtacaagtaatatttctcataactaagcctcctcaacacttacagttatatttcctttaatatccttaaataaatctttactaatttttatattttccatctctgaaggtatcatatgaagtcttttcttttctaaaattaccttgtcatcacttcttacaactaactttttatttttataaatttgtctaactctcataaataagttaacatcttcatcactatctacatttacactttgaggaactatatatataattccatctcctgcaacagtttttacttcattacctttatttaacttatttaaagaataaagtgctgcatttttacctgctatcttactttctttagtaacaaagtctactaaatcatgaacatgaacaacattaccacaagcaaacactccatctacattagtagccattgaattattaactatcggaccactagtttttttatctaaattaacaccagcttcaacacttaactcattttctggtataagtcctactgataaaagcactgtatcgcaacttatgtattcttctgttccttttataggatttctattttcatctaacttacaaagagtaactcccttaactctttctttaccatctatatgagttattccagtgcttaacattaaaggtatatcaaagtcatctaaacactgaactatatttctagttaaaccacttgaatgtggatttatttcaactacagcttttactttagctccttcaagtgtcatacgtcttgccattataagacctatatctccagaaccatatataactatttcttttcctaccatgtaaccttccatgttagaaagtctttgagctgcacctgcattataaactcccgctggtctgtatcctggtatgtctattgctcctcttgttctttctctacatcccatagctaaaactattgcatctgcttttatatttattattccttcttcacctaaagcttctatagtcttatcttcacttatatttaaaaccatagtatttaacatataatctattttttcttctttaaccatttcaataaatttatgagcatactcaggtcctgttaattcttctttaaattcatgtaatccaaaaccattgtgtatacattgattaagtataccacctagttctctatctctttctattataagtacatcttttgcaccatttcttttagcttcaactgctgcacctaaacctgcaggtcctcctccaacaactacaacattatatttcaactaactcacctcttaattcttttgattttcctactactgcattagagttttcatagtcttttaatacatcttcaacatctatattaagttccctagctaatatttctattaccttaggtccacaaaatccaccttggcatcttcccatacctggtctaactcttctttttactccatcaactgttctagctccacatagtgaatttattgcatctacaatttcaccttctgttacgctttcacatctacaaactatttttttgtatcttgggtcttttttcattatttcttctttttcttgtgggctcatttttataaaaggtttgtttttctttcttttcggtttaaagtttaatttttcatttaaatttaaaccttcttctttaagaatttctacaacgtattttgcaactgctggtgctgatgcaagaccaggtgattctataccaccaacatttataaagtttttacatttatctgaagcaaatatcatgaaatcccctgtatttggagtcgctctaagacctgcaaaacttgttattgtttttctaaaatctatattttctatagtttttcttgaactgtttactatttcacttattccttctcttgatgttgatatatcttctttgtcatcaacaactgtagcatttggtccaactaatagatttccatgtacggtttgagtaactaaaacaccttttcctttttcacttggacattggaataaaacatgatttgcaattttaccttcactcttatctaatatcttatattcaccttttctaggtattataaagtattcatctccacctatcatgttgtttattttatcagcataaactcctgctgcatttataacgtacttagcttttatatcatctttattttttatttttatattaaaataatcatctatcttttctatatctacaacttctgattctagttttaaatctactccgtttaacatagcgttttccataagcgctatatttaaattgaaaggacaaacaattcctgcactttcacaaagtagagccccaaccacatctttattaacattaggttcaatctctattacttcttcacgatttaatattttaagtcctgttgctttattttcaagtcctctttcatataaagcttttacatgttccatttcttcatcatcaaatgctaaaactaaagaacctatttgtttaaaatctacatctaaatcatcacataaatctttgtataaactattacctttaacatttagtttagcttttaagctaccaactttcgcatcatatccaccatgtactatagcactatttgatttagtagttccttggcaaacttcaacgcctttttctattactacagtttttaaattatattttgataattcccttgctatagaactaccacttatacctgcaccgattattgctatatcatacataattttgcctccttgaaaaaaaatagagagacccccctatacaatgtatagaaggctctctcatctcttagccataatatttcatttttaatctttttaaatcgttttcctgatttgtaaatccattatatcataaataattttaattgtcattaattttttacacttgctaattctttttcaaattcttcatcttctttagcccataaaagtgatctttctactgctcttttccatcctttatataatacttttctcttttcttcattcatatgtggttcaaattctctttctattgttacagatttctttatgtcttccttatctttataaaatcctacagcaagtcctgcaagatatgccgctcccattgcagtagtttcaagtactttaggtctatttatgttaacatttagtatatctgattgaaattgcattaagaagttattagcactagcgccaccatcaactttaagatttttaagattaagcccagaatcttcttgcatagcatttagtacatctttaacttgatatgcaattgactctaatgtagcacgaactaagtgagctctatttgccccacgagtaagtcccataatacatcctctagcatacatatcccaataaggagctccaagtcctgcaaatgctggtactacatacacaccattagtatctcctatactttgagaataaaactcactttgctgagcatcaaataaaattctaagttcatctcttaaccattgtatagctgctcctcctatgaatatacttccttcaagagcatattcaacttttccatctactccccaagctatagttgttaataatccatttttagattcaactattttttctcctgtgttcataagcatgaaacatcctgttccataagtgtttttagcacatccttcttcaaaacaagtttgaccaaataaggcagcttgttggtctcctgcacatcctgctataggaatttgagctcctgctaacatatgttcatcagtatgtccatatatataactagatggttttacatctggtaacatactctttggtatatctagtatttctaatatttcatcatcccattttaattcttttatattataaagcatagttcttgctgcatttgaataatcagttacatgaactttaccacgagttaaattccatatcaaccaagtatctactgttccaaataataactccccattttcagctttctctctggcaccttcaacattatcaagtatccattttattttagttcctgaaaaatatgcatcaagtattaatcctgttttttcttttattttttctttgtatcccttagcttctaactcatcacatatttgagatgttcttctacattgccaaacaattgcattatatactggttttcctgtacttttttcccaaactatagttgtctctctttgatttgttataccaattccacaaacttgttctggctttataccgttagtttctaaaacttctctcattacaccactttgactaccccatatttccataggattgtgttctacccatcctggttttggataaaattgagtaaactctttttgtgatgttgcaactaaattaccttccttgtcaaataatatagctcttgaacttgtagttccttgatctaatgccatcatatattttttcatattgtttgcctccaatgattatttatttaaactttgatgatatatattctatttcatgtatctttttattcctttatcaaatacaaaacctgctaaaactgctcctattatcggtccaactattggtacccaaaaatacatattaggtcctagtgcaccacttttccaacctgctataactgcaaataattttggtccaaagtctcttgctgggttcatcgcaaatcctgttaaaactccaaagctagctcctattatagctattgttatacctataaaaactggtgctaaatttgacataggtttatttgagtttttctcttctcctactgctagtattacaattaccaatagcatagttataaacgtttctacaagtagtgcatcaaatgaatttaatgctgcatttggatatgtagaaaatattgaagctgttttaagtccatctgcacctgctcttactatgttatgagtgctttcaaatgatgtaaacaacttattaaacaataaataaactgttgctgctcctgcaaaacaacctaatatttgagatatgatatatggaattatcttattttttggaaaatccctatgtactgctaatgcaatagttacagctggatttatatgagttcctgatacagctccagttacatatatggctattgtaactgctagcccccaaattatacctatttcccactgtgaaacacttgctccacttaaaaccatagatgctactgctccacatcctataaatattaatatccatgatccaataaattcagatatacactctcctagtagtgtcttcttcaactcaaattccccctttgatatttacctttagctaattagttaaaaaaaacagagagcacctatagttttatagggctctcttgtctctagccagtattaatttaattaaatgctatcacgaaaacattttccagtcaataagataacttgttagatatttaataaactaattttttataatatttaatttttattatgtttttaaattaccatatatcaacatctgtagtagatatagccattgctcctgacgctaatccatttattatttcttctttgctatctataagtccaccgcatattataggtatgtttggatatgttttattcatttttttaattactttttgaattactccaggcatgacttcaattgcatcaggttttacctttcttaaactttcaattgcattttcaagtgacattgagtctataaagaaaaatctttggacaacttttaaatctagctctattgctctttttactatatttgtcttagtagttataattccatctaagtttaattcttttttcatataatctacagctataggacttgatgatattcccgtaatcatatcaatatgtacaaatacttttttattatgcttatgtaaaaattctattttatcctttaaactaagaatatcttcatttaataaaaatacaatatctccatccgaatttgcagcatcttcaaggtgctcatcattttttattgcacaaattataggatttaattctaatacgtctttcatatatgcctccacctttttgcttttttaaattaattatatcactttttttaagcaaactaaaatcgatttcattgttatatttttgccatagtgcatatttaaagttattacaaatatttcatattaatttgttatttttttatttatttaatttatcataaaattattaactgaatattaataataattctaaaataaaatcaatttaaatatagattaatcttaagctataagttaaaataaaaagaaatttaataattttaaaataagatacacaaaggggataaactatatgaaaatttttaaatttaaggtaatattaccattaataatgattgtattatcattaggatttgttgggtgtgaaaaaactaaaaatgctaaagaagattctaatgaatcaaaaataagtgtggataaactattagagtataaagattcttatgtaggaaataactcagctataggtaatattatttcaaacttacctgctaatatatacaataaaaaatttgagttacaaacaaattcaaagccatatgaaataaacatagattataaagactttgaagatacatatgttaaatttgaagataatacatctataacaattcctttttctgaagcaattaaaaaaaatgctatgattttactttcacttgttaaaaatgtagatataattaattttaattttgataatggaacaggtattacatataaaagagatgagttaatcgatgctcataagaatgagtatggagttaatttagaaaaaataacacaggataaatcatcattagaaaactttataaaaagcgatataaattaatataagccactatgtaaaaatagtggcttattactattttactaaatcaaatttcatttgttggtcatataataaattcatactattatctgtatatgttgatactttttttatatcttttattttagaagcactttttttataattttccatatcaaatatagtcgtatatttacctgtatgtctatctaaagattcttttacagggatatttaactgtatttgcttatcattttcatcaaagaagtataaatcaaggtaatatggtactaccccatctttataataagtaaatctcatttctttatctgtaatttgaatatcttctataattatttttccatatttacttgtttcaaatactattggtaaattatctatactttgaggttttaacatcttatcttttgtattctcatcataagatataggtactaaagtcaatgattttatatctttatttgcgtttaaaaattcgtatgaattagtggctattccagttaaagaatcagacccattttctaatctatctactatatctaaagatttgccattttcatcaaataatgcaaagctacttcccataattggatcccaatatttagaagatttattagttttttcattaattactatcttattcgctagtggagatataatcactttttctatatttactttatgttttatattttctttctttccattatactcctgagtttcattaaatttaaaagttttatttactttataattatgagttttagaaatagcttttgacttatctattttagcagatatattccaattaccctctgttttaaatattttatctatacgaagctcaacctctgtattattttttagatttatataacttacatctattttttgaattccttttaactcattatctgatatataagttgcttccttctcaatcgtcctacgcgatactaaactcttaccatctatatatgcatctatatatggacttgcacagtaagggtctttataatattcatttatttcttttatatttttatcactttttacagtataaaatacagttatgtaattatcatcaacagatacactatctattgtaaattctattcccttatcatttacagttaagtttaaatcctttcctaagttttctaaatcatctttgtcagatttatataaagatttttcattatgactaaaataatctactatttcttgtatcataggtattgaatccgctatagcaggatttgttaaacttactccgattacccctgttccaattattaaacttgtaaatgatgcaatcattatctttttatactttcttttctttttataatctatacctttttttattgccttcttagttaattcatctatactttctggaatctttatctcatcaaatttactcattatttttcctccttcaatatatcatataactttttcttggctcttcttatatatgatttagctgtattttcattacattccataatttgtgcaatttgcgatatagttaagtcttgaaagtattggagtattactggagttttatatttttcttctaaagaatctatagcatcatataaatctatattttcttctatatttgaataagaaatctcacctataaaatcttctacttgttcatcttgaaacttactataatgtctatgtttaatatttacattgttaataagtatctttgttaaccaagttttaaagaaattaggatttcttaactttgaaatatttatatatgccttatatactgtttcttgataaatatcaagtgcatcatgttcatttttaacatataaaaatgcagttttataaaggtattccttatatgtatttataagtttttcaaaagattcatcgcacccctcttgtgctttattcactaattcatattccctatattctgctttctttttatttaaaaatcttattttcttaatagctatgttttcaatcattttatcctcccccgtaaccatgattacatatattagattcataaagcacttatatagttgcaaagttttattatttttttacataaaaataaactctatttaaatagagttcatttttatatttggctatacaattttaataaagttttataaattcttcaagtaatgtactagcatttttcgctgctattggtaaaaactcttcatatgataaatcagcttctccattagctttatctgatattgaacgaagtattacaaaaggtactttatttaaataagcaacttgtgccattgaagctccttccatttcaacagctgctacatcaccaaagtttttcttaattttattagctacttcaccaccagctacaaactgatcccctgaagcaacacgaccttgagttatatgtatatttgaaacattttcagctgcttttttagcaacatctatcatattcttatctgccttaaagaatgtaattccaagtcttgagatctcccctaatggatctccaaaaactgttgtgtcaaagtcatgttgaactgcatctgttgaaattactatatccccttgatttaactttgaatccatagttcctgaaacacctgagtttacaagagcatctacattaaacttatctattaatatttgagtacatgctgccatgtttacttttccaactcctgaacgaactaatactatatttttaccatccattgttccattgtaaaattccatccctgcaacattaactgtttcttttatatccattttcttttttagtatttctacttcttcttccattgccccaattacacctaatactttttcgtcttttacttctgcttttaattcacaccctacaagcattgtaactgataataccaataatgcacacatagctaataattttttcataatatgagaccaccttcttgtcaattaacgaacattaatccgtcttttttatttttcgtacgttactttaatatttataacataaatattcgtatatatcaataacattttttaatttttttatattttagttcgtattttatataaaattataatatcttgtattatatttttaattacgtatatcctattttataaacccaataaatgaaatgatgtattctatgagtaaattaataaatcaaaatgcaaaacaagctttaaatatgctaaagatggaaattgccaatgaacaaggatacaactataatccagttagtgataaaattgaaagtaacgctcctcaaaatacgctagaaggactatctaaaaatgtccttgctggagagcaagttggaggagctatgactaaatcattagtttctaaaggtgaagaaattctttttcaaatgtataataataaataaatttacttttaaatttatacaatttgcaatgatttagtacaaaaattattaaactacctatcataatcattacatcctagattcttactttaaaataataattaagaaaagttacttatacccaataaattgctataatccaatttaataaaataaaaaacaggaacagctattgctgtccctgtccttaacagaaaacaaactcaacacagaaaggaatctgtattaaaatttgtttttagtatatcataataatcttgaattttcaattatattccataaatgtaatcactaaaaaaacactatatttttaatttctaaaatataaatctcaataacaatatttctttctataagtaaattagaataaaatttatactaattgtcaaagtttaggcaatatggaatttttttattttgatataatatttaatataaaatacataccaactttataaaaggaggaaatataattgaacgatatttttaaaaaggaatacaaaataaacatttttgatgttgactctgaacataaatgcaaattttcatccttagttgatttcttgtgggatgtagttatatctcaatctgattatttaggagaaactaaagaaggatttattcaaaatcaatgtatttgggtacttttaaagtatgatataactatatatgaataccctaaatttagagatacaataactgtcgataccaaagtattaggttcaaagaagttttatggttatagacaaaatactataagaaattctgaaggaaaagttataggtgaagctttttcaacagctatactaatagactttgaaaaaagacgtcctatgagaatatcctctactcaaagtgaaatatacggacttaatggagaattagctgaagtacctgctttagatgatctccctaaaattcaaaaagaggattataaaaaagattatcctgttagatatagtgatatagattctaatggtcatgttaataatgtaaaatacatggaaatggcagtagatactttaccaagatatattttaaatgaatataatttatttaatattaaagtactatttaaaaaagaaacaacagatggagatacattacatatttcatctgaagtaattgataatgaaagtggtgatattactacaattcataatattacaagtaacaatggaaatcttcttacaaaattgcaatttatatggaagaaaaaataaaaaagttttatctactaaattaaaaatataattatatatttaattaacagtgataaaagaaatcgctgttaaactttcttgtgatagataaaactaaagtgtacctataacaaatccaactaacatatcttaatttttttattaattattggttaaaataacataagtattaaatattttggataaaggagatattgtatatggaattcttacatggtcaagaaactcttagcgtaatgggctggatacttcgtgctgtcattgcttttttctttttgctggctattgcaaaactattagggcaacgttccatttctcaactaagactacttgattttgctattactttagtaattggaaatattattgcccatccgttatctgatgaaaaacttggattagagggatcaataattacaactcttgtattagttgtactatatgttagtggagtatttatcatttttaaatttccatctcttagaaaacttgttagtaattctccaattacagttattcaaaatggtgaaatactttataatggcttaaaaaaagcaagaatatcaattgatgtgttattagaagagttacgtgaagaaaaagtagatgatgtgaaaaaggtagcattagcaacgtgggaacctgatggtaagatttctgttttcctacatccagaatatgaaccaattactccttcatctttgggtataaaattagaaccttttgactttccaaaaacaattattaaagaggggaaaattaatttcaatgaactaaaagcacttcataaagatgaaagttgggttatttccaaattagaaaatttatatcaaactgaggtaagaaatgtcttgcttgccacacttgatagtaaagataacataaaagtttttttatataaataattcatcgaggcataaacatatctacttgcgtagagattagtttaagcctcttttattctaaaattcactttaaattattcaaggctaatcacttaaaatatattctttggttggctttttagcaaaattataattatttacgagttaatttccctttgtaaaaataagctaacttcttttggatttttcaatactactatcttatctttaaattcttgttctatatttttataatgattactcttttctttagtacgcccttcatgaagaatccaccaaataaattctaaatccattttctctatacatcccttagccatatcttcacgagttgtgtttttattcttaaaatatctttttaatgctctatacatgcaaattctacgtggaaaattaagaaaaattattttatcagcttgttctaatctttctctttgataaaatccactataatttccatcaattacccaggagtcattttgcataaaatccaaaactatcaagcgaccttcatctttatcacgcataacccaattaggtaaaaaattcactgtatcaagaaataaaacgggtatattataatgttttgcaagttgtctagaaagtgttgattttccacttccgctatatccaattattgcaatcttcattttaaccccctccatattaatctaatcagatttaattatctatatataatcttattaataaagtagttactattatcataacgcctatactatatatagtaattcaattacctctttaatacatctatataaatacctatcgataaaaatagcctcagaattaactataacagttatcttgaggctatttttttatcttataaagatattaccatattcataagtttattgtttctttttataaactcatctaattccttagcatctaattctttattagcaagtaaagctatatctactatttgattacaaattaatgataattcttcttttttactttcatcatcttttaaattaacaagctttttaattattggactattgtcatttataactaaagttttttcttcttcaaaactcataccaaagtccattccagcaaattgagacttcatttcagccattcttcttgattgttctgatactaaaattatagctgtagtatcttcactttttaaactctctactgagtatgatttaaccttatctttaactaaatctttaaataagttttctatagcagttttttcttctttgttttcatcatcttttttatcttttaaaacatcagataaatcagcatctattctattgaaagtaactccttgatttttaaattcaataaatgatacaaagtgattatctatactagaatctagtattactgcatcaagtccataatctttaaatagttttatatattgagattgttgctcttcatcacttacatagaacactttattttcatgtttttctttgcagttttctaaataatcattaagagttacatattcattatttatagttttaaataatataatatcttttatcttatcatagaatccttcgtcttttaagcatccaaatttaatgaatacttgtatatcatcccagaatttttcgtagttttctttttcatttttgtatagtgattttaatttatctgcaacttttttaactatatgcttagaaattttacttacatctttatcattttgtaagaaacttctagatacatttaatggtaagtctgggcagtctattacacctttaagtaatagtaaaaactctggtataacttcttttatattatctgcaacgaatacttggttgttatataatttcaccttaccttctataagctcaaactcattttttagtttagggaagtataatattccttttaagttaaatggataatctacatttagatgtatccaaaatagtggttcatcaaatgttttaaatacttttttataaaactctttgtattcttcatcagtacaatcttttggtgattttaaccataaaggttttgtatcatttaaaggttttatatcttcatctttttcttctttatcactaacttttaagtatatatctactggtaagaatgaacagtatttgtctattgtatctcttactgtatactcacctaagaactctttgctttcatcatctaaaaatagagttatagttgttcctcttgtttttcttgtatcacttaaacctatttcatactctgtttgaccttcacttatccatcttacagaatcattattttctttgtatgatagtgtgtcaatttgaacttttttagctaccatgaaagctgagtaaaatcctagtccaaagtgtcctattatatcactttcttcactcattttatctttatatttattaacaaaatcttcagctcccgaaaaagctacttggtttatatatttttgtacttcttcttcagtcatacctataccattatcttcaaatataagtgctgaattttctttatctatagttacagttattttatattcttgatctttattactttctatttcccctaaagaaactaatttcttgtatttgtttattgcatcacagccattacttataagttctcttataaatatatctttatcagaatataaccatttttttattattggaaatatattttctgtatgtattgatatgtttccttttttattttccattttatctcctcctaagtttacctttttaaaatagatatcgggataaaattgtcccccatatttattattgtagcaccttcattagcactgtcaaggttagagtgctaatttaattattttttctttctatttataaataatcctaccaatgaagctagtcctattcccatataacctaaaactccagtatctcctgttattggatttaagtaattcttatttgattgttctaaagtctcattaccatttaagttattattttcattgttactactactgttattacctatattattattttcatcgttactactactgttattatctatattattattttcactgttactgctactgttattatctacattattattttcattgttactgctactgttattatctacattattattttcactgttactactactgttattatctacattattattttcactgttactactactgttattatctgcattattgttttcactgttaccactactgttattacctacattattgttttcatcgttatcactactgttattatctacattattattttcactgttgctactactgttgttatctacattattattttcattgttaccactactgttatttatactttcattatgttgatgtttttcaattacatttaatatcaattttttagtagttgttttaccttgtgaatctgtcaatgaatatattacttcatactttcctggttcacttatatttgtttcactacttccattcatattttttatagtgtattttacatcacttatatttaaacttttgtcttctttgtcttcctctttagatacaaagtctaataaatttactttttctccactatttatagttgcgtcatttgtttttaattctaatattggagcatcatttaatatagattctttttgatttactattactattctttttactgtggtcgtatttccatctttatctgttactgtatatgttagttcatattttcctggcttattaatatctactttacctgtaactttgatatctttagttatatttccatcttcagtatcagtcgctgttacccctttcattgggtcaaacttagttccttctattatacttatattatttgctccacttattactggtttgtcgttactttttacatttacagtaatagtctttgttacctttgctccttgactatctgttacttcatatactactttatatgtccccactttatttgtatttactgtatcttctataatttttatcttgtttgttatattcccatcctctttatctgttgccgttacatcttccattggattaaacttttctccaacctttattgtcttatcgcttgcatttatttttggaacactatttatatctacccatttcatatttactattactattctttttactgtggtcgtatttccatctttatctgttactgtatatgttagttcatattttcctggcttattaatatctactttacctgtaactttgatatctttagttatatttccatcttcagtatcagtcgctgttacccctttcattgagtcaaacttagttccttctattatacttatattatttgctccacttattactggtttgtcgttactttttacatttacagttatagtttttgttgcttttgctccttgactatctgttacttcatatactactttatatgtccccactttatttgtatttactgtatcttctataatttttatcttgtttgttatattcccatcctctttatctgttgccgttacaccttccattggattaaacttttctccaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatcctctttatctgttgccgttacaccttccattggattaaacttttctccaacctttattgtcttattacttgcatttattatcggtatttcattttttataagtactattggttgagttacattccctgaaaattcagaatttgccttaccaatatttacattctttgaaaaagaataattctcactattactatttatatctttccataaaattttattagtatttttatcatataccccatttccagaaatatttgtcggagctattttatctccaattttatcagttactatgttatcaatttctatagattctaattgtttgacttcttttgatttcaattttatgttttgattatctaattgtaaaaaaattaaatgatttaagttaactatagaacttatattacttatttgattagatcctaagtttaaaaatcttaatttagttagcttttctaaagaatttatattacttatattattaaaatctaaatgcaaataatttaagttagttaaattccctattgagcttatatcacttattttattatcagttaagtataattttgtcaaattagttaaattacttattggacttatatcacttattttattttgatctaaatacaattcaaccaagtttgttaagtttgctatcggacttatatcacttatttgatttctatttaagtacaaagtaactaatttttttaagtttgatattggacttatatcacttatcatatctccatctaagtataagtaagttaatttagttaatttagatataggacttatatcacttattttttctccatttaaatgtaagctagttaaatttatacaatattgtagtccatctaaattcgatatatttgactcatgtacatttaacctttttaaggattctaattcagacttacttatatctgcatccaaatctttctttcttaactgttcatttatcgctctttttaaatttatatctttaatatcaattatctcacactctttaattttttcatttatatctttatcattgttgtttactacgggtttgtcttcaagatttatactatcatctttaatttcatttttagttttagtgtctatattttcattattggaaatttttgtatatggttcaatttttctatccgtcaaaaccaaatctaaagattcttctttttttaaattagtgctagtttcatttttattattagattctatttcatctgctaatgcattgaccatcattgattgcaaaatcactgttgttgtaattactcccacaatcgtctttttaacattattttttttactcattatattgccattctccccttgatttcttaatttaaataaaattttattaaactaaataattccaaattatgtaaatatttatcgtttgatatttttaccccaaaattttattttaaatcgcaaaaatcgcaaaaaaaatatgagtagcatatgctactcatatttatataactactgatattgtgatatctccatgagctttgcatgtacaaccatacgagcaccttcatactcataactacaagtagataaagtcaaaattttatcttttggcgttacttttagtttagatttcacaatagatttattttctattttatttaaaaagtttctatattcattttcagttttaaagttagtctcattataattatcttttaaatccgttgtatatgcggaaaatacctcataagtcaatttcttaccttttggagttaaaatagttattttattattttcattaaaaaattctttttcgttaaatttatccaactgtgcaaacatagtatcattcttcatagaatgaccatataaaatagtattttcatcattgaatttattatttctaaaatctaaaaaaattgatcctgatgataaataatttttatttatatccttctcaaggtaataattattatcttttccttgaagaattggatagtttatatttgtattatcaatatttagccatcctctataatctttatttatataagataaatctaaagtttcagtatttttttctatgttcttatcttttatcttctgaatttctttgtatacattatctgctttcttatagcttattattttttcaacaatcttatatgaactaaataaaaatactattactaaaaatatatttattaaagttctaattttattttttttcattaatttaatcactcccaatatggtggtcgatttagtattttaggtaactttgtactagaatcacctattgctgtattaatttgcgattgagtaataaaaatacaatctgataaatttgcacctcttatatctgcatctctcatatctgcaccaattaaatctgctttacttaaatcaacatttctaagatttgtggcaataagaaatgcgcctcttaaattagctccttttagattaaattttctaagatctgaaccaatacaatctaatcctttaggtatatttttacttttattttctccataacaagatttttttctaacaatttcactagtatcagaaagcaatatattaactttatcttgatgtgacattacatccagttctataagagatttgcaatctaaataagtaagtctttctgtttcttctatcataaccctaattttatcatgtatagacttattttctttaagtgaaattgcttgatttaaataccaaagcatttcatgaagttgtctcataattagaaaaacatcaaacatttgatttttagattttacttcttttctccaatcacgtccattgtatgtaacttgagatattttttgacctgctccaaaacactcatatgcactacaccctttaagaccttttttcctaagattttcatgaatagaacatctaaaatcagattgtaaatttatacaaggagttccggcaactttatcattgggaaacccttctgattttgaaaaatatagtgaaacacaacaaagtccaaagcatttttcacagtcagctcttaaattttcatatacttctttgcgactatctaaatatatcatatttatctaccccattttttagtaaatacttttaatttattaattttataattatatttaataaatatttttctaatgtattcattagtatatattagttataaaattatgtccacattcttaattaatgagtctagatagttctaaacttaaaatataatttttaaatctatcctcattaatataacaaatttcataaaatgttgctaaaataataatataggaggggataaaatggagtttgataataaagataatataagaaatttaataatacaaaaagcttctgaactttttctaaaacaaggatatacaaaaactactatacggcaaattgctgatgcttgtaatttaggtcgtggtcatctttattattattttaagaaaaaagaagaaatagttttatatttgtacaaaaatttaatagaaaaaatctatgcttatataattaatcatcctaataaatctattgacccactgcttagctatgcaataactcaatatatatacataaaagtaattgcaacaaacgatgatttttttagaatgtatatagaagcctcggaaatttactctattagaaaagaatatctaaaaactttatctgatatcttaaattctaacttaaaaaaattagattatgactttaaaaaacaagatataaacttaagtcttataataggctctgccggtgaagatactctcttacgtagattttataaaaaagacatagacttaaatcttgatgaaataattgaaaatactataaaaacaagattattattactaaatataaaccatgaaaaagtaaatgaaataattcttaaaacaaaagaagaaacaaaaaatataaagatttttgacataataaaaagtataaatatagttgacatataggttgtactaatcctacaatctatctgtataataatttgggcatgcctaatattttaagggggaataggctatgagaggattgtcaaagcaaatagctaaaaaaagcaaattaatattagtaatagctatattattactaatcccatcagcaattggttttttaaagacagacataaactatgatattttaagttatttacctaatgacctatcgacaacacaagcagaagaaattttaaaagacaattttgattgtggttcacttgctatgttaataattgaaaacatgaaagataaagacgtatcaaagcttaaagaaaaattaaccacagttgaaggtgtaaatgacgttttatggattgatgattttttagatttatcagttccaaaagaaatgttacctaaagatataaaagacctcttatacacagaaaattcaactttgatggttataaaattagaagaaggttcagcagcacttaaaactttaaatgctgttgaagaaattagaagcataacaggtaaacaagcatttcttagtggtatggcaagcataataaaagataccaaagacatttcagataaagaaactccactatacgtaattgttgcagttatattaactttaatagttttaacttttacaatggattcctttgttacaccatttatatttttaataagtataggttttgctataatctacaactttggaactaatataatctttggtgaaatttcgtacataaccaaggctttaagcgcagttttacaacttggagttactatggattattcaatatttttacttcacaggtatgatgaagaacgcgaaaagtacgataatcatatagatgcaatggcaatagcaatacaaaataccacgacttcagtttttggaagttctctaactacaatagcaggatttttagcactttgttccatggacttagcccttggaatggatatgggattagttatggcaaaaggagttttgctaggagttatttgtactgttacagtacttcctgctttaatattaatctttgataagcaaattcataaatacaaacacaaaccaattttacctacatttaaaaaatcatctcaaatagttgtaaagaattacaaattactagtggttttatttttaatattatttataccttcaataataggttcaaacaatgcaaaagtatattataacctagatgaatctttacctgatgacttaccttctatagtttcgactaacaagttaaaaaatgattacaatatgaatagcacaaatattattttaattaaagattctcttaaaacttataaggttgaacaaatggttaaagaaatagaaagtttagatggtataaattctgtggttgcacttgaaaaatttataggtccttcaatagttcaagatataatacctaaagatttaataaaatctgtaaaatcggggggatatgaacaactcttagtaaattcagaatatagagcagcaactgatgaagcaggtattcaaatagataagttaaataaaatagttcataaatacgataaaaatggacttgtcggaggagaagctcctttgacagatgatttaataaaaattgcagatagagattttaagattgtaagtttagtttcaatactagcaatatttataattatagctatagtatttaaatcaatatcactacctataatattagttttagcaatcgagtcagcaatatttatcaatttgggcataccttattatacaggtacagtagaaccatttatagcttctatcgtaataggaactatacaacttggtgcaacagttgattatgcaatacttttaacatctagatataaagaagaattagctataaatagtaacaagtttgatgctatgaaagcttcaattcaaagtagtgcaaggtctatagttacaagtgctttatcctttttctctgctacaataggcgttggacttatatctaaattagaaatgataagtgcattatgtgaccttatggcaagaggtgctataatcagtatgtttataatcatttttatgcttcctgcaattttattagtttgtaacaagtttattataaaaactagcaaaaacttcgtagtttcaaaatctatagatttaaataagggggaaatataaatgagaaaacttaacttacctaaaaaatcggtagctactttaacaacactaatgatattttttaatactggtatttgttttgctgatacaaaaaaagaagaaactgtatactcaatattaaaagataatggaaatgttgaaaaaacaatagtatctacttggataaattcagacaaaaagcttggccaatttactgacttaagcaatttaaaaaatataactaatgttaaaggtgacgaaaaacctactataaataaagaaaatttaaactggaatataaataaagaagacttatattacaagggtgatagtaataaaaagcttcctattgatgttgatataaaatatgaattaaatggcaaagaagttaaccctaaagatattaaaggaaaatctggtaagttcaaaataactattaaactaaaaaacaatgaaaaaagaattaaaaatataaatggtaaaaataaagaattatatgttccatttttaacagctacagaagtattacttcaaagagataattttaaaaatgtaaaaataaatagtggcgaaattgttgatgatggtaaaaattgtagtgtaacttttgcgtctttccctggcttaaaagaatctctagatttaagtaaagatattaaaaactatttagaattagaagatactttagttatacaaggagataccaaaaaatttgagatgccaaatataatgattcttgcttctccaaaacttccagaccttaaaaatataaatgaaaattcaactttaaatgatttatcaaaagctttaaatgacctctcaaaaggtggagatgagcttttagctggctctaagaaattattagatggaaataatgagttaaattctaactttgctaaatttgaccaaggtgttaagactttagacaaaggctctaacgatttaaatagtggtataaataaattaaatgattctgctccaattttaaataaaggagcaaaaagtattaataacggacttagtcaattaaatgcttctcaaggaaaagtttcaaatggtgtttatgcttttgtagaaaatgtaaataaactttttgaagcttattctaatattaactcaggtatttcaaatgctagtgatggtgctaatgcccttaaagaaggtttaaacaatggtagttctggtgttgattctttaatagcttcaactaataatatagaccaaatatcaggtggtttaaataatatagcaaatgctttaagtgaaataaacccagaatttgctgaacaattaagatcaatgtcaaattctttaagtcaagtttctcaaggccaaagagatggtttaaataatttaaaagcaggaattaacaatgcagttggaggtgctaataatttaagttcaggactttcaaacttaaaacatggctcatctgattttaattctaattttaaatcattagtaaatgcaggttctacacttagtggaagtcttaaaaaactatcagatgcaactaaccaattagaaaatggaagcaaacaacttgtagctggaactgatgaattaagcaaaggttcaaatcaattagcaagaggctcaaaaactttagctgatagtactaaagttttaactgataattcaagtaaattacttaagggaactaaagatttagcaaaaggctcaaatgatttatacactggagttaacaaattaaaaaaggaaggtctagataaactttataaagaaggaaatacaaaactatctgatatacaaggacttctagatgtaaaagatgaaatcgtgaaattatcaaaagaatataataacttctctgggttaagcaaaaatatgaatggtagtgttaagtttataatgaaaataaatgattaatttttattattagattttaaattttatatataaagggctaaataaactaaagtttaatagccctttttactatttatatatttaaatatctgacatttctaaatttacagtttgagtattatctataatacttgaactttcataattaggaatatctttttctaaatttagaggtaagtatactctaaatttagagcctttatttacttcactttctatctcaattttaccaccatgaatttctacaatctcttttactatgcaaagacctattccactaccttcattttttcttgtatataaattttctacttgataaaatctataaaagatataattcaatttatcacttggtattccctctccatcatcttctacttctataattatattttcagcctctgtccacatagataaatttatattcccgttttcatgtgtaaatttaatagcatttgatattaaatttaatacaactctttgaatttgaaacacatctatagctgtgtttatttcttcttctttcgtatcaaatatcattttaatattttttcttttagcaaagtaaagacttgattcaaatatattttctataacacttactatattacacttttctaattttaacttaaacatacctgattcagctttagttatatcaattatattgtttgatatctttaacaatctatatgaatttttattaatattttctattttttctaaaaggtaatcactatttatttttttattagcactacattctaaaactctagtggttcctaatattatatttataggtgttcttaattcatgacttagattaactataaagtcagattttaacttttctctttctaaagctttttgtttttcttctaattctttttcttttatttttctatgcttagttacaatttgacttattaccaaaattaatattataattactattattattattaatattaacaatttcatccatataggaattaaaaattcaaaaaattctttattaattacattaacatctttatctacaaaaaaaggatttatattatattcatatatacttttataatcaacataagcttttgcaattggctctgtagtatttttaatatcttctatactaacgccttttcttaatttgactaacatatcacaagctatttcaccaagttcttctcctatatcaatatgccctccaactatacctgcattcatataagtctggtcattagagtatataggtgcattactatatttttttatttcatctactatatatttagcttttttatatttttttgaacttatactttgaaattcacctgctataatatttactgtattatctgagctttctattttttttaattggctaattatatcctctatataattaccttttatataccgtatatttattttttcttttaaatagttctccactaatctgtctatttcatattttactgaatcgccatacttagaatcttcaattattaaatttatatttttcattttagggtttaagtcataaatcaaatttattaaatttaaactatcatctccgtgataaatccctgccatatacgacttttcttctttaactccacttattttcctgtctactccactaaatacaagtggaagtttataaaaattactttctttatttaatacttctggactaaaaacatcataagcttcatcatctactgtatatatagcatcaatacttccctttgcatatttttcatttaacatacttttaaatgattttatatactttttattattattattcttaaaatctaaatactcaatattaaagttaatgtctccttcattattattttctatatatgataataaaccattgaatatactagattcccatatatgcccttgatgatatgaatttaaaactaatacattaaatcctttatctttagtattatttgcatgtactttattaattaacttacatgtactaattgtaaaaataaaactcaaaattaatatttttaatgattatttaattaatatggtgtttacatagagattatagataatcaaattaaagaaaataacaatgtatttgaaatacgtgtcaaagacaatgaagtgaaagcaataaaaagtaataaaaaagctgatataggtttaagtataaattatattagtcaattagcattttcatatatagatatagaaaaagtattattcctagaaaatataactaaaactaaagaaaacacaaaagctataaacttattaaaatctatttttagtaagaaagaaaactatataaatgaatatgtataatcaaaaatatccattataagtgatttcacttataatggatatttttgattttagaacgtaaatacatctacgtatttacaactgtaaagacagctgctaaaataatcttgaagtcaaatgatttaaggaggggtatatgaggaatttaagaaagtatctaacagtgtttatgatcacagtattatctataagtgcagttggatgcagtaaagaagaagaagataaaaaaagtaatacagaaagtaaagatagtaaattttctgtaggtgttgtattaggagaaggaggagctaatgatcaaagttttaatcaatctgctttagaagggttagaaaaagcaaaaaaggaattaaaaataaagggtacatatttagaatcaaatcaagactctgactatgtgccaaatatagaaacttttatagatgaagatgctgatttaatagtaggtgttggatatacgacagcaaactctatgttaaatgcagctaaactttacccagataaaaagtttgttatagtagatcataattatgaagaggaagggcaagaaattcctaaaaatatgatatgtatgacttttgatgaaagagaagcagcatacttagtagggttaatagcatctaaaatgagtgaatctaataaaattggatttataggtggaatgaaaatacctaatataacaagatttgaagaagggtttataaaaggggtaaaagaaggaaagcctgatgctgaatgtatatcacagtatgcaaattcatttgacgatgcaagtttaggtaaatcaatagcaaatcaaatgtattcaaaaggagtcgaggttatattttctgcagctggaggagttggaacaggagctatagaatcagctaaagaaagaaataaatatgctataggtgtagacatggatcaaaatagtttagcacctgataatgttataacttctgctatgaaaagagtggatataggagtatttgatattatatcaaagattaaggatggcaattttgaaggtggaaaatcagtagtttatggattaaaagaaaaagcagttggaatagctccttctacatcaaagaatgtatcaaaagatatattagattatgttgatactcaaactaaaaaaataatagatggaaaaataactattacatcatcaaagtaattgtaaaaattataggatataaatatttatatcctataatttttttatttttgatttaaaaaaatctgaatgtatataatttagaaaatatatatttaggagttatacatgagaaggccattattattagtgttttttatagtaataattataagcttaattattactaatttagaaaataaaaatgaatatgaaacaaataaattaataactgtagaaggactcatatctgaaaaggtgattaaagaaaaatacacgcaatataaattagataattaccttataaaggattattctaaaaaagtaaatataaatccgggaagcgtagtaaaagttacgggtaaatttaaaaattataaagatctaaaatttgaagattttgactatggaagatacttaaaaagtcaaggttatgaagggactatagatataaagtattataatatagtaaaaaagaacttattttattcgaagttatttaatgtaaaagataaaattagtaagtcaattaaatatttatataaagataaatccaaatttataaattcaatattaataggagaaaaagaaaatttagatgaaagccttaaagaagtgttttcaaaaacaggtgtaagtcacatcttagctttatcaggtcttcatgttagtattttaattacaattataggatatagtttaggaaaagttaataggttttataagcttttaataataactattatattatggttatatagtattatggttggacaatcaccttctataattagagctatagtttgtagtgttatatcttacttatctatatttattcatgaaagaacagatgggatatcgagtttatcttttataggtacaattttagttgtaagtaacccatatataatttataatataagttttcaattgtcttttttagcaacattgtctataatatatttctatggttatataaattctaagattaaatttaaattaatagcgcttactttagccgctaacatattaactataccaatagtatatttacattttaaaaatatatcattggtttctgtaattagcaatgtagtagttgtgccatttttaagtataataatatacataagtattataagtgttataatattacctatgagttttactttatctaagtttatggttataataaatactttcataatagataaaataaatattattttagaaagtttatataatctaaaatttagttatattgaatttgaaaaaagcaacaagttgattgttattatttactatattttagtaggaatatatatgatatataaagaaaaaaagacgataaaggagcaaaagaatggattacaaggatatcatcaagagcatgaacaacaacgaatttaaaaatgtatatcttttctacggaagagaattttatttattagaaaatgtaattaaaacttgtaaaaaaagtttaaatgaaagcatgattgattttaatatggatatccttgatggaaaagaggttacattagatcaagttttaagtaatgcggagactcttccatttatggatgagaaaaaaatattaataataaaagactttgaattattaaagggtaagaaaaagaatttctcagatagtgatgaagctgaaattatagactatttagataaaataccaaatacaactgttatagtttttatagtatacggagatgtagataagagaaagagtttagttaaaaagattaataaagttggtatagtaaaccattgcgataagttaaatgatatggacttatttagatgggttaaaaatagatttaaaaaaagagaagtagttattaatgattctgaagtaatgtattttatagaacaagaaggatatagagataaaaatagtgaaaagactttatctgatttagaaaatgaaattaataaaataggatcatttgtaggtaaaggcaataatgtaacaaaatatataatagataagttatctcaaaagaaggttgaaaatgatatatttaaattaatagatgagataggaagtaaaaattcatctcatgctatgaagatagttacagatatgattttagaaggtgagtctgttcttggaatatttgctatggtttctaaacaatttaaacttgttatgcaagcaagacaacttcaaaatcaaggatattcatcaaaagttattgcagaaaaattaggagctcatccttttgtaatttcgaaagctttaaagcaaggtagattattttcagatgatattgtagttgatatgttaaactatatattagaaagtgattttaaaataaaaaatggattaatgaaagatactcttgcagtagagatacttgtaagtaagtattgtcagtaaggaattgtttaaaatagatttatagcgtaatcagcgctacatgtgaatataaaattttcctccatgcaagctaaaaagatgcttgcaaatgtcggttaaattctatattcacacttcgctaggttacttggtaaatctgaaacttaaacaattccttatttttatacaataaagtttagaataggaggaaatgatggcaaaagaaaagacccttgataaaatcaagggtcaatatctattctgaacggataattaagcgttcattccgtttaacttttgagctaatttagcaacttttctagctgcagcgttcttgtgtatagttccttttgaagctatttgagatattctcttttgagcgtattggaatctagcaacagcttcctctctgtttcctgcagtaacagcttcttcaaactttcttattgcagtttttatttgagattttctagctctatttaaagcagttttcttttcgataacttttattcttttctttgctgattttatgtttgccatccgtttcaccccctcgtgagtaatttatattattcatcgtcaacatattagattttaacagaaataaatctaaaaatcaaggataattattagtaagttcttaaatatctttccatttgactttttagattataacctatatcaaaatattttacaacatagaaattaattattataaaaatttttaaattaatctgattaagttataaaattataaaagttgttaacaatctttagtatgatttaatttaaacttttgaattggaggaagttttatgataagtttaagaactgatttagcgctagaagctagagaaatatatgaacaaggaaatgatgctagtcatatacctggagttaagatagatacaaaggaattagataactgtattgtaagtaaagtagaagttttaaatgaagaaggcgctaatattatgaataagggtataggaatttatacaactatagaaagtaaattaatgaagtatgatgatgatgagtcaagagaacagattatagagtatttaaaagatgaattaatagacatacttggaactgataaaagtaaaaaaactttggtcatcggacttgggaactggaatataacttcagatgccttaggtcctaaggcagtttcaaaaacattagtaactagacatatatttaaaaattacaataaagattatgatgatgattttacagaagttgcaggtcttagccctggagttatgggtattacagggattgaaactagtgaaatagtaaaatcgatagtagatatgataaaaccagacagagttatagcaatagatgcactagcttctaggaagatggaaagagtaaactctacaatacaaatatcaacagcgggtatttctcccggtggaggggtaggaaataagagaaaagcattaaataaagaatatctaggagttgatgtaatagctataggggttccaactgttgttgatgcagcaacacttactagtgatgtattagaccttgctattgacaatttaatgagccaatctaaagaaagtgagagtttttataatatgttaaagactttaaaggaagatgaaaagtatcatcttataaaagattcgctagaaccatatgataaaaacttgatagttacaccaaaagatatagatgatactatagaaaatttatcaataatcataagtgaaggtctaaataggtcgttgcatcctggtagaattgtaaattaaggaggagataatatggtatcaaaaaaacttataagtctcagtcttataacttgtatagcttgtatagtatgtttaaagaagtcttatgcattagaaaatgatgagtttttaaagtttcttatgaatgctagctatccagaaactaaattagaacaaccaaaagatgaaaaagaagttaaagatgatagtaataatgagaataaatcagaaaaaaaagatgatgaatttgtaaaaatgtatgttggggaagaaaatttacctactgtagaaagttcaaataaagcatcttctgaaagtgctaaatatgtggacaatgtattagtaactaaaaatgagccacaaatacttatatatcatactcatggtggtgaaacttacgcaaacaattctgcagggaattaccactcagaagacaaagtaaattccactttggaaataggggcgacacttactcaagaactaaataaaagaggtagagcagtagttcataataccacatatcatgatattcctcaatttgtaggtgcatatggaagaagtttaaaaacaatagaaactatgcaagctaaatacagtagtatagatatgataatagatttgcatagagatggaagaactttaaaaacgaaagaagatgagaaaaaattcaaagatgcatgcacagccaatataaatggagaaaatgtagctaaatttttatttgttgtaggtaaaaaaagtcctaactattctaaaaacttaaagttagctgaggaaataactgcatttgctgaaagtaagtaccctggaataacaagacctgtagtaacaaagggaactggaaatgcaagatacaaccaacataaatcggacaatccacttttaatagaagtaggaggacaaatgaatactacagaggaagcaaaagcatctactaaatacatagcagaaataattgatgaatttttaaaacaaaaaggcatgtaggtttattttatgagccgtgtagagcgaaaactagaagaaaaaaataagaaaaaagctagaaaagctatttatcgatttatatttttaatagtaatgacttttattgtaagcatttgtgcattttttatagataaagaagcaacacttatgataggtgaagtcaaaaaatataatatagaagtttttataaataattttggaaattctgttatggatactataaaggatatagaaagaaagttaagtaaacttaataacttaaaataaattagggttatcattttgatagccctaatttattttagaaagtaagtctttaaattgtagtatcaatatttacataatgacggatatattataaaataaaagttatgataataataaaaaggaggaataaaaggtggacagcaaacaaagtagaacgagaaattttagtataatagcacatatagaccatggtaagtctaccttagcagatagattaattcagcatacagggcttgttagtgaaagagaaatgaaagatcagttactagataatatggatcttgaaagagaaagaggaatcactataaagcttcaaaatatcagattagtttataaagctaaggacgggaatgagtatttcttaaatttaatagatactccaggtcacgtagactttaactatgaggtttcaagaagtttggcagcttgtgagggagcattacttgtagttgatgcagcacaaggtgttgaagctcaaactttagctaatgtttacttagcactagatcaagacttagaaatattaccagttataaataagatagatttaccaagtgcaagaccggatgaaataaaagcagaaatagaagatataataggacttgatgcaagtgaagctccacttatatcagctaaaagtggtttaaatatagaagatgtattagaagatatagtaaataatgtaccagctccaacaggagataaagatgcgcctttaaaagctttaatatttgactcatactatgatgcatacaaaggtgttgtagcttatgttagagtatatgaaggtactgttaaaaaaggcatgactataaagatgatgaacactaacaaaaagtttgaagtaactgaagttggtgttatggctccaggacaaagagaattagatgaattaagtgctggagatgttggttatattgcagctagtataaaagatataagaagttgtagtgttggtgatacaataactgatgctaacaacccaactgatgaaccgatgccaggatacaaaaaagctactccaatggtttattgtggtatatatccaggtgaaggtgaaaagtacgaaaacgtaagagatgctttagaaaagcttcaagttaacgatgcagctcttgagtttgaagctgaaagttcagcagcacttggatttggatttagatgtggattcttaggattattacatatggaaataatccaagaaagattagaaagagaattcgacctaaacataataactacagctccatctgttatatacagagtaacaaaaactgacggagaagtagttatggtacaaaaccctgctaacttaccagaacgtgatgaaatagatatgatagaagagcctatggtaaaaggtgatataatagttcctaaagattatgtcggtactgttatggaactttgtcaagaaagacgtggggacatgataaatatggaatatatagatgaaaagagagttatgcttcattatgaccttccacttaatgaggttgtttatgatttctttgatgccctaaagtctagaacaagaggatatggatcattagattatgagttaaaaggatatgttccttctaagcttgtaaaactagatatattgataaataaagaacaagttgatgcacttagctttatagttcatgaaagtagagcttatccaagaggtaaggctatgtgtgaaaaattaaaaggcgagataccaagacatcaatttgctgtacctatacaagcagcagttggtaataaggtagttgctagagaaactataagtgcacttagaaaagacgtacttgctaagtgttacggtggagatatatctcgtaagaagaaacttcttgaaaaacaaaaagaaggtaagaaacgtatgagacaaataggatctgttgaagttcctcaaaaggcatttatgtctgtattaaaattagatagttaataaaaaaagatgcttaaataagcatctttttttattgtattaaatttaaattgataaattttattatttacagatttgaagttacacacaagcttaaaaattaaaaatatttatacaaaacagaatgaaaatttaataaataattagagaaatgttatcataaataattaaataaggagtaattgtaaataatagacaaaaaaataaataaaagtgtcgaaatctattgttatttataatgaaatgtagtaatattcaaattggacattttaataaatcaaaatataaggaggaaaacgatgagtaacaaaggacttcaaaaaactttaggtctttcagcagcgctttctacagttgtaggtatggttataggtgcaggtgtattctttaaacctcaagctatatatcaagcaacaggtggagctccaggattaggtatgttagcatgggttattgctggtttcataactatcgcagcaggacttacagcggcagaggtttcagcagcaataccaaaaactggtgggatgatgatttatatccaagagatatatggagaaagattaggatttttaacagggtggatgcaaacggtattattcttcccagcaacagctgcggcactaggtgtaatatttgctcaacaagcagcaactataataggacaaaatgaaaacaacatgtcagttgttttaccaatagcattaggaattatattatttttagctgtattaaatacagtaggttcaaaattaggtggaacaatacaaactgttgccactatatgtaagttaataccattaggtgttataatgatatttggatttataaatggatctggtgataactcaataactactccattagtagcacaaaacttatcagtaggaactgttttaggacaagtattaatagcagcgttatttgcatatgatggatggataaacgttggagctatagctggagaaatgaaaaatccaggtaaagatttacctaaagctatagttggtggattatcaatagttatggcagtttatgtaataataaacttagcatacttatgggttgtaccagctaatgaaatggcacaagttagtgctcctgcagctttagttgcagaaaagatgtttggaccaataggtggtaagttagttactgctggtatattaatatcagtatttggtggactaaatggatacttattaactggacctagaatatcttatgctttagcttgcgaaggtacattaccaggaagcaaatctttatctaagttaaataaaggtggagttccagcaaatgctactttcttaatggcaatacttgcttgtttatatgctttatctggacagttcaacttattaactgacttaacaatatttataatatgggtattttatgtattaacttttataggtgtaatgaagttaagaaaagatcaaccaaacttagaaagaccttacaaagtacctttatacccaataataccattaatagctatagcaggaggattattcgttatagttaaccaattaatgaacaatactttaatagcagcaggtggattaatagttacagctataggattacctgtatattcaataatgaaaaagaaaaactaataattaattacatataaagagatagtattaatactatctctttttttattatataaaaaagtattatatgtttataagattagaatactttatataatgatgtataatatatataattatatttaataaaggagatattatgttaggactatatatacatgtgccattttgtgcacaaaaatgttattattgtgattttaattcatataaaattaaaagtaatgaaaaagaagattatttaataaatatagaaaaagagatgaaattttataaagaggaatttaaggacaagtactttgatactgtattttttggagggggaactccaagtatattaaaaattgatgaattaagaaaacttgttaattatatgtttgagaattttaatataaaaaaagatgcagaaataactgttgaatgcaatccaggaactataaataaagaaaaattaaaagctatgaaagaaatggggataaatagattaagtataggtcttcaagctactcaaaattatcatttaaaatctataggaagaatacatacatatgaggaatttgagaaaaactattatgatgctatagatgtaggattaactaatataaatgtagatttaatgtatgctcttccaaatcaaaaagaatatgaatggaaagaaacattagataaaattataaagttaaatccatcacatatatcagcatattctcttatattagaagaaggaactaaactttatgatatgtatgaaaataatgaatttaaccttttagatgaggatacagatatagatatgtatgaatatactataaatacattaaaaaagcatggatacaatcaatatgaaatatctaattatgcaaaaaaaggaaaagagtgtaagcataatgtaatatattggacatgtgacaactatttagggttaggacctggagcttcagggtatataaatgacgtaagatactctaatatagaagatttaaatgaatataataataaaattaatcaaaatataaaacctataagtgaagaaaataaattaagtgagaaagataaaatagaagaatttattttcatggggcttagaatgaataaaggtataaatctagaagtatttaaggaaagatttaagattgatttttatgaattatataaagatgttttagacaaattattagagcgtgaacttataaaattagacaaatttaatttgtctttgactcaaaaaggaagagaaatttcaaacagtgtatttatagaatttataaattaattaaaaactgttgacaaagaaaatttaaagtgttataaaatatatataatcttttagcactccaactaaatgagtgctaacaaaagaggaggcttaggattatggtggaactaaatgaaagaaaactaaatatccttaaagctatagttaaagattatatagaaactgcagaagctgtaggatctagaactctttctaaaaagtatgagttaggaataagcgcagccactataagaaatgaaatggctgacttagaagaattaggatatttaattcaacctcatacctcctcagggagaattccttcagaaaaaggatataagctttatgttgattctcttatgaaagaacatgaattagataatgttgaaaaaaaattaataaaagaatcaataaataaaaatataaactatatgaatgatttaatacatgaaacatctaagttgatatcaaagttaactaattatacaactatagctgttactaaaaatgtatcaagtttacaaaatataaaacatatacagttagttggattagatgaaaaaagtatagttttaatagtagttactgaaaaaggcgaaattaaaaatacaaatctttcaactaatgtgcctattgatcaagctaagcttaatttaatttctgataatcttactagaaagctttcaggtaaaaatataactgagatagacgacgagtttttaaactacataaaatacgagattacagaaaactctttagttatagataagcttatagattcattaaactttggttttgaagaaaatgatacatcaatttctttaagtggagcaactaatatatttaatttcccagagtttagtgatgtagttagagcaaaaacatttttaactatgctagaagaaaaagaaaatatatctagtatgttaaaatcaagaggaattcaaaaagaaaatctaaatataattatcggaagcgataatgaatgtaaggtagctcaagattgtagtattataactgcaacttacaatatagataaaaatgtagtaggaaagattagtttgattggtccaactagaatggattatgcaaaagtatactcaatacttaattatatgggactactactaaacaaaaaatagttaggggtgtaagttttggaaaaagatatgcaagaagaattacaagaagaagtaaaggaaaatgcttcagaggaagttgaagaaactattgaagaagcaatagaagaagctaatgaagctaaagaaacttcggaagctgatgaaaaagacaaaaaggtagaagaattaactgatactcttcaaagacttcaagctgaatatgctaactatagaagaagaactcaacaagagaaagaaactatgggcatatttgctaatgaaaaaatcttaaatgagttaataccagttatggataatatggaaagagctatggatgcttgtactgataaagaagatagcatgtataagggaattgacatggttcaaaaacaattaaaagctacatttgaaaaattcggactagaagaaatagaagctgaaggtcaagaatttgatccaaacctacacttagcagttatgcaagaacccgtagaaggcactgaagctaataaagtggttatggttttacaaaaagggtataaattaaatacaaaagtactaagacctgcaatggttaaagtatcttgctaataaataaacaattaagattgaattaatatcaatattatatagaagaattcaaggaggatattaaaatgggaaaaataataggaattgacttaggaacaacaaactcttgtgttgcagttttagaaggtggagaacctcaaataataccaaactcagaaggaatgagaactactccgtcagtagttgcattcactaaagatggtgaaagaatagtaggagaacctgcaaaaagacaagcagttactaatgctgatagaacaataatatcaataaaaactcacatgggaactgattataaagttaatatagatggaaaagattatagtccacaagaaatatcagctataacattacaaaaattaaaagctgatgctgaaagctacttagggcaacctgtaactgaagctgttataacagttccagcatactttacagatgctcaaagacaagcaactaaagatgcaggtagaatagcaggacttgatgttaagagaataataaacgagccaactgctgctgcacttgcttacggtatggataaattagatcaagaaaagaaaatattagtatttgacttaggtggaggtacatttgacgtatctgttctagaaatcggagatggaacattcgaagttttagctactgctggtaacaacagattaggtggagatgactttgaccaagttataatagattacttagctgaagaattcaaaaaagctgaaggtgtagatttaagaaacgacaaaatggctcttcaaagattaaaagaagctgctgagaaagctaaaaaagagttatcttcaacaatgagtactaacataaacttaccgtttataactgctactgctgaaggaccaaaacaccttaacatagatttatcaagagctaaatttgatgaattaactgctcacttagtagaaaaaactatggaaccaacaagaagagcattacaagatgctggactttcaacttctgatatagatgatgtattattagttggtggttctacaagaataccagctgttcaagaagctgttaagaaattcataggaaaagaacctcataaaggtataaacccagatgaatgtgttgctgcaggtgctgctatacaaggtggagttttagctggagatgttaaagacttattacttcttgatgttactccattatcattaggtatcgaaactatgggtaatgtaatgactaagataatagaaagaaatactactataccaactaagaaatcacaagtattctcaactgctgcagataaccaaactgctgttgatatacatgtacttcaaggtgaaagaagtatgtcttatgacaacactactttaggtagattccaattaactgatataccaccagctccaagaggaatacctcaaatagaagttacatttgatatagatgctaacggtatagttcacgttacagctaaagatttaggaactggaaaagaacaaaaagttactataacttcaggaactaacttaagtgaagaagaaatacaacaaaaagttaaagaagctgaaatgaacgctgaagctgacaaacaaaagaaagaaaaaatagaagctgtaaaccaaactgaagctactatatatcaaatggaaaaaactttaaatgaagctggagataaagtagatgctgctgctaaatctgaagttgaagctgaaatagctaaattaaaagaattaaaagctaaagaagatgttacagctgaagaattaaacaaagctttagaagaattaaacaacaaattccacaaaatagctgagcaaatgtatcaacaagctcaacaagagcaagctcaaggtggagctcaagaagaaactaaacaagatgacaatgtagtagatgctgattttagagaagtagatgatcaaaaatagtatttaaaaaacagagttacttgtatataataaatatataaaattaataatagcttgtagacgtctacaagctattgttctgtaattaaaggtggtggcaagagtggctaaaagagactattatgaggtgttaggcgttgataaaggcgctgatgcacaggcgttaaaaaaagcatacagaaaacttgcgatgaagtatcatccagatagaaacccggatgataaagaagcagaagcaaagtttaaagaaataaatgaagcatatgaagtattatcagatgaaacaaaaagagctaactatgaccaatttggacacgaaggtgtaaacggaggatttggtggccaaggaggatttggaggcttcggcggaggagctggaggattcgaagatatatttggagatatattcggtgacatgtttggtggaggcttcggcggaggaagacctagaagaaaaggtcctgagcgtggagctgatataaaacaatctgttactataacatttgaagaagctgcatttggagttaaaaaatctgtaaaaataaacagaacagaagaatgtagtgagtgtcacggaagtggatctaaaaatggaactggcaaaaaaacttgtcctacatgtaatggtacaggagaagttagaactgctcaaagaactccatttggtaatataatgagtacaagaacatgttctacatgtaacggagaaggggaaattttagaatctccatgtcctaagtgttcaggctctggtaaagttagaaaaactaaaactatagaagtagatataccagcaggtatagatgatggacaaataataaaattaagtggtcaaggtgacttaggttctaaaggtggaccaagaggagacttatacattgtagttaatgtaaaatcacatcaattatttactagagatggatatgatgtttactttgaattacctataacatttgtccaagctgcacttggagatgaaatagaagtacctacattagatggaaaggtaatgtatactgtaccatcaggaactcaaacaggaactgtatttagattaagagaaaaaggtataccaaaaatgagaggaaactctagaggagatcaatatgttaaagtagtagttgaagttcctaagaaattaaatgaaaagcaaaaagatatattaaaacaatttgctgagtcttgtggtgatgaagttcacgaaaaaaagaaaacttttgggcaaaaaatagaagatttctttaaaggaaaataaatagattaaaactcctagattatctaggagtttttatttttacctaaaaaccggggttatttactgatatttaagccataagaaatactaaataataaaattttaacaaaatgaattttatgaaaattgtcattaactagaaaatatagaaaaaaactataataaaatatttaaatattataaaaaactatacttaataaaatttattgacgatgataaaaaatttaaatacaatgtatttcgtggccacaagaaaattaaaacatctaggaaagggttttaggaatgagggaattttttaaaacgtataagtcttcatttattttactaggatgtaccatattgggtgctataattggattagtattagggccaaaggcaacagttattaaaccatttggagatttattcatcaatttaattatgatgatcgtagtaccacttgtattctttagcgttgcatctggggttgcaaacgtaaagagtatgaatagatttggtaagatcatgaaaaatgtagtagtagtatttacattaactacgctagttatggcggtagtaggaattgtggggtctataatatttgatccagcaaaaggaattgatataagttcagtaaaggaaatgatggtagcaccagaccaggagaaactagcatcaaaaggaagtttgttaaatcaggttgtaaattcaattacagtttctgattttagtgaattattctcaagtagcaacttacttcaacttgtaatatttgcagtattagtaggaacttcagtttcagttttaggggaaaaagcagatagtataagaaaaatactaaatgaaggaactaatgtagttttaaatatagttaacataataatgaaactaggacctataggattaggatgttatacggcatctattataggtgaactagggcaagaaataattgcaggatatataagagtgtttattacttattctgccatagcagtattatactttgttatatgctatacattatatgcatatttatcagggggtaaaaaaggagttaagagtttttataaaaattcaataagtccaatagcgacggcacttgcaacatcttcaagttctgcttgtataccttctaacttagaatcaagtaaaaaaataggggtgccagatgatatagctgaaacagttatacctcttgggattaacatacataaagatggatctgtattagctgttatagttaaggttgcattcttaactggaataatgggtggaaatatgggtaacccagaaacactattaagtttattagtgacagttcttgtagttggagtatttatggctccagtagcaggcggctgacttataggtgagatgctcgtggtaagcattttcggattccctgttgaagcgatacccttattaacagtaataactacaataactgatataccaaatacagtacttaatactacaggaaatacagtaagttctatgttagtagcaagattggtagaaggtaagaattggttaaaagatgaagttcaaagtttaaaaaaggttggataacaggaaaaaaggtagtaatcttaggttaagattactacctttttgttttattaagaacaactttaatatcttagacataatatatactactataaaatattataaggtgggaagtattatgagtaatttaaacttcattatagatgataaacatattactaatgaagaagagctacataaatttatactagaaaaaatagatttatgtgatgaagaattcgtagaagatgacaactgtagaggcaagaaacataagcataaacataaaaagaaacaatctgattgtaagccaccaggacctaagcatgttcatttgaagtttatgtttccatataaaatagatgtagcttgtggatgtaaacaaattatacttggagttttgatagattgtgatggaaaacctatcaaaaaccctattgttgaatttgaattatcggatcatagattaggtaatattggatttagccctgctattagttttggagatggatgtttttgtaccacttttgtaggggaaagaactggatgcggatttataaaaatgtgttgtgtaggtacagatttagataaagttatgcatgtagaagttagagataataattattattaaaaagtgctgactaaagttagcacttctttttatttaaaaagatacctatgttataatataaaaatagattaaaaaaataacatattataaaaaatgaatagagtattataataggtagaggtgaacgcatgagacagtataaaaatttaatattcgatttagatgatactttattagactttcaagataatgaaagaaattctttagaatttatctttaaaaaatacaatattccatttgatgaaaaatcaattaatcaatataaaagtattaataggaaattttggagtcaaatagaacaaggttgtataaaaaaggaagaagctttaactaaaagatttgaagaattcttcgccttatatggatataatattgaaggtgaaataatagaaaatgaatatcaaaattgtttaactaaaggtcataaaacaattccaaaagccatggaaactttaatagagctaagaaatagagggtataaaatatttgcaggaactaatggaataggacaaacacaaaaacaaagacttaaagattcaaaattaatgaatttatttgatgatgtattcatttctgaagaaatgggagttgaaaaacctaattcaaagttctttgagatgatttttaataagtatgattttatgaaaaaagatgagacattgatgataggtgatagtttagcgtctgacattaagggggctaataattttggaattgattgtgtatggtttaatatttcaaataaagagtgtaaagatataaaagcaacttatgaaatacatgatttatctgaattattattaatgttaaatagagaagctaatgcagctgtttaatatatatagttaaaattaagtaaagtattaaaaggggcataagctcctttttttacttaataaataataaattgtattactgtcttaaaatagtataatatgtataagtgcaaaataattttaaaatatagataatgtgggagggattatatgataataggaattcttggaccactagactcagctgtaagaatagaaaaacatttaaaaaacatagatagtagtttagaaacaagattatatacaaaagagaagataatagaatccgtagatttaatagaaaagtgtgagcatgagtgtgatgggattatattaacaggatgtggagtttatgaagaaataataaaaaatcatgaaataaaaaagcctcattcatttgttcaaagaagtgatacaagcattcttaaagcattttgggatatacgtaatttaaatatggaaatagataagtttagtatagatgtagttgaagatgaaatggtagaaaatataatagatgaatttgagataaagaatactgaaatgttttgtttgccgttttcaacaaatataaatgaagataattatttagattggcatattaatttatataaaagtggcaaaatcaatataatgattacaggatttatgaatatatataatcaaattaaagaaaaaggttatccaattgtattgcttagaccaacaaggtcactagttaaagcatcatatgatgaagttatgagtaaacatgctattagtaaagctgagtcttctcaaatagcagtagaaatatttaattttggaaattatagtaataatatagaaaattattattcaaatatgataaagaaaacagatatagataaatatataatctcttatgttagaagtataaatggagcagtatttccatttgggcgtaatgagtatattatatttagtaataaaggatctgtaaataaaaatagtaactatgagaaattattaaaattacaaaaggaaattaaagcattaggatttgatttaaatataggaattggatttggagctactgcttttaaagcagaaataaatgcgacaaaagcattagaaagaggaatagattcaaaagaattttacatatactcaattgatgaagatgaaaatcttacaggaccattaggaatggataatgaaattagttattgtattatacctaatgataaaagcattttagaaatatcaaatcaaactggcttaagttgtgaaactatttctaaaattattggtataagtgaagttaggggaagtaaaatttacgattcgaaagaattagcaggatacttagatataagtgatagaagtgcaagaagaattttacaaaaaataacttcagcaaaattaggaaaggtacatgccaaagaaagtagtaaaggtgcaggtagacctaaaaatttaatagaaatattgttttaaataaaagtgcctaaaagtaaattttaggcattttttatttttctaatttaaatattaataacatagtttgatatatattaaaagtaaatgaaatttctaaataattaaaaaaatataggaaaaagtttttttatttatattgacaatattctacaaatattatattatccaattaaggacatattatggacttgtcaaaaaataaaaaatgacaagaaaacgtttttaaaacaaaggaggaattatgatggataatttaagaagtgtatttgaagcagattatttaaaaatggcaaatcatccttttatgtggatagctgcagggttagctgtaatggttgttgtgattcaatccatagtattttttagaaaatcagtagtagctgcaaaagaaatgggaataaaagatactcaagttaaagcagctataaaaagtagtgcaatatcatcaataggaccatcgatagttatattagttggtatgatatctttattagtttcaatgggtggacctatgtcttggatgagactttcatttataggttcggttaactatgaacttatggcagcaggatttggagcagaagctatgggtgcaaagcttggagctggaatggacccaatggtatttgcttgtgctatatgggtaatggttttaggttctttaggttggttaatattcactttattattcactgataaaatggacaaagttaatcatttattatcaagtggtaatgaaaaattagttccaataatatcagcttgtgcaatgcttggagcatttgcttacttagcatcaggaaacttcataacaggagaaggttcagtaactttcacatcaccagcagcagttgctacaataattggttgtgttgttatgatgggattatctaagattgcaaaagataaaaacatacaatggataaaagagtgggctttatcaatatcaatgttttctggaatgataataggaacagtattaataaacgtaatataaggaggacaaatatatgagcaataacaattattattcaaaaaaatacataccaagtataactaaatggggtaaaggtactttattattaggaattatattatgttttgcaccagtattagttgtgtcaggaatatttggatatatgcctccaatagcagctataatagctgggacaatatcacaaataagtgttagtggagctttttatgtggttgagcctatagcatacttcccgatacttggaataccaggtacatatatgacatttatatcaggaaatacttcaaacatgagagttccatgtgcaatggtagctcaagaagcagcagatgttgaaccaggaacggaaaaaggttcagtaatatctacaataggtatagcggtttctataatagtaaatatagttatattatcaattggggttgtatttggacaagcaatattatcagtattacctccacaagtaacagcagcatttgatttaatattaccggcactattcggagcagtgtttggacagtttgctataatgaagcctaagtttgcagcagttgcagcattaatagcagtacctatgaacttcttattaaaaaatggggtatttgattttatgccaggaagtggaagtccatcatatttagttatattaactgcagtatttggaactatattaatcggtaagaaaataaacgaaaaagaagaaattaaagaaagccaaaaggcagcataggtaagcaaggggtgtctgaggcatccctcttattatagggtaggaaaattaaaaatataaggggagattattatgttatctagagaaagattagtaaacaattttatagatatggtaaaggtagatagtccttctaaccaagaagtagaaatggctaaatggttagtaaattacttaactgaaagaggtatagaggttaagatggatgatgcgggagataaatttggtggtaattcaggaaatgtaatagcttatataaaaggacaagatagtgaaaatccaatatgctttgcagcacatatggatcaagtagcaccatgccttggagtaaatccagttatcagggagaatataatagaaacggataaaacaacaacactaggagcagatgacaaagcaggaatagctgctatattagaagcattagaatgtataatggaagataaaatacctcatagggatatatacttattatttactgtatgtgaagaagcaggaatgttaggtgctaaaaactttaatcctgaaaatcttccttgtaaagatgtagtaattttagatgcaggtggagctactggagtaatagcttataaagcaccagcacaagaaaatataaaagtaactttttatggtaaaaaagcacatgctggcatagagccagaaaaagggataaatgcaatagtagcagcttctaatgcaataagtaatatgcacataggaagaatagatgaaatgactacttctaatataggaagaatagaaggtggaggagctactaatatagtaacggataaagttagtttcactgctgaaataagaagtcatataacaaaaagattagaagaagaaataaatcatatgaaaatttgttgtgaagaagcagcgaaaaatatgaatacaacttgtgattttgagcatacaaatgcatatccaagttttgaattaagtttagaaagtaaagtatttaaattagttcaggaagctactaaaaaggttggaatagagccaaagcctatggtaataggtggaggaagtgatgctaatataatggctaacttaggatatcaaagtgcgataataagtttaggaatgtatgatgtacatacagtaaacgagtatgtaaatatagatgaattatatgatgcgactaaaatagtttataatataatggctttataaagtaaggtggataagatggatataaaagaacttaaaagattggttttggaagaaatagataaaaacaaagataaaataattgaagctggaaaaagtatatacgaaactccagaacttggttacaaagaagtaaaatctactaaaactgcttcagattttttaaaaagtttaggtgttgatgtagttgaaaatatagcagttacaggatgtatgacatctttaaacaaggataaatatggtcccaaaatagcagtgatgggagagttagactcagtagtttgtccagatcataaagatgcaaatgaaataggaaatattcattgttgcggacataatatacaagtagctggtatgctaggatgtgcgctaggaattataaattcaggagtactaaagtatttagatggtaagatagattttatggcagttccatctgaagaatgtatagacttagagtttagaaaaagcttacaagataaaaatgagataaagtatgttggtggtaaacaagaattattatacagaggaacattagatgatgtggatatggcaatgatgtttcatgcattaaactttgaagaaaataaaaactgtgtaataaaatcttatactaatggatttataagtaagcatgcaaccttcataggaagagcatctcatgcaggtatagcacctcatgaaggtataaatgctttaaatatggcaagtttagctgctaacaatataaatgctcaaagagaaacttttaaagatgaagatagagttagagtaagtacagtaataaatcatggtggagatatagttaatgttgttccatcaaaggttacaattgaagctatggtaagagcggcaaatgtagaagctatgatggatgcaaatgaaaaagtaaatagatcacttcatgcagcagcaatggctttaggtggagaagttataatagaagatactattggatatcttccactagattctgataatagtatggacttggtatttaagaaaaactacatggaattagttggtggaagtgatgaatctataatagatgttataaagtcatctgggtcaactgattttggagatatatctcaaataataccatgtattcatccttggataggaggagtaagtggaagcttacatactaaggattattatataagtgatgaagaattagcttatataatacctgcaaaagctatggctatgactttaatagatttattggtagatgatgctaaaattgcaaaagatataataaaaaactttaagcctaaatttaataaagaaagctacttagattttatggataaaaatacaaatacatataaatacgattataaaaattaataaaaaagcagtttgggaaaattcctaaactgcttttttattttaatttccttactcactaattaataattaaatgcatagtatacgtaaaaatgcttttttaggagggaatatgataaacgatcaaagatatgtgattttatcacttgaattacatttgtttttttctagaataatgaaagaacactctatatttttagaagctggatttacacctaaagattcaaaacttgctaatgaagctgatcattataaaagggaatttgaaaaattattatcatatgcagtaagtgctagtaatggagtaattagatcaaatgttttacaatctggagaaattattactgattatacattaggtacagaacaaaaaacacaaaacttaacaggcatagaaataaatcaaaatataactacactacaatcgagactacgtagtggaaaaaatccaagagttaattctgaattagtaaactatgtagatcaacttaactataatgcaaaaaaacttcttaatggaattattaattttaaacaaagattattagatggtgtattatcttgtaatttatttacagttaactatccattacttattgaacatatacttcgtgaagcaaaattgtatctttcactagtagaagatcttgaaaatagagttgatatagattccaataatactagagaaacagagttattctggaatcaaattatgatggaacattccttgtttataaggggattacttgatccttatgaagaaaaattaattgaaactgcagatgaatttgcagatgattttgaagatttaatagaagaggcaaaaactatgacagatgcgacaataaatagtattacagatgaaactttaaataaaactattcaacttaagaattttaaagaagcaggaacagaaggaatttcaagttgtaaaataagatctataatacttccacttcttgcagatcatgtattaagagaagctaatcattatataagacttttagaaacatataaagagatgtaatttaaattactatgtttttaatttttttagtaaaaaatatagggtaagaaaaatttatatcttaaaattaaataaaatagctacttttttaattttaaaagtggctatttttgtatttaaagaaaaaagtaaagttttaaattttaatactttaaaatatgaatttgattacaggtttgatacaaattataaaaaaacttgaaataagtttagaaaaaatataatatagcaacaagggatggtgataagtatggaaacactaacactaagtcaagctataataaaagtagcagaattagaaaaaatatatagagcaaaacttaatcaaatatcagatgttcaaaattcaactgtttcatacatattagaatcagacggtcaaaaatatcaatgtaatgatgaatttgactttgaaaaagaatttaaagaaactttagaaattggaaatacaatagaaactttaagaactgaaatagctaaattaaataatattactataatagatatagaaaaagaagatttaactatacaaggtggtttaaatagacttaaaagattaagagaacaagtagatataattgatatgattattgaacaatctaaagcatctaagcaaagaagagttgatgcagctgcaacttcagtatattacaaagtggttgaatcaaactttgataaaaaagatatgaagttgcttttagaaagtataaataatgaaatattagctttagagttagcaataaacaaagctaataatgaaacagttattgctttagcttaaatgctagtaatatatattaataattgaaatttagtttgattgattaaaattaaagaattttaaaattaaaatacaaattacaaatcacaacttacaattaaattaaggttatatacctaaaattacaattttaatttactaattacaaatcaagcgatcatgtatataagtgtatatttaaaaatttcaattatgcaaaaagagactattttaaatagtctcttttttatatttaaatatcaaatttgagattatatagctaaattgtagtccgtagcttcagttatagctattttttaactatagtcttgcagttataaccaagaccacaatcaaatttgatttttaaagtagatggatttttagtttctgcaactgccatttaaatcaccttcatttgacttgttaatataagtataggagatatgtaaattttaaaatattaaacaagtttagaaaaagttaggtattaagtttaaaattaatgttaaaaatgttgtataatatatcagatatatatgattaaattgggtataagatatatatattgagaaaagtaagaaagaaggtgtgcttatgagccatgagatacaggcacaaagaccgtatagacattttaaggggaatttatattatgtacatagtatagtgaaacattcagaaactggtgaggagttggtttcttatcagatgttgtatcccccttatgatatgtatgttagaccactttctatgtttaaagaaaaggttgaagaaggtagagaagataatgtaacaaatcaagtttatagatttgaattatatacaggaaaataaagaataggtgaataataatggcaggtataaaatttgagatagaagagaattttggaattatttcaaattcaagtaatggatggagtaaagagttaaatttagttagttggaatgatagaccagctaagtttgatataagagattgggatgaagatcatcaaaagatgggtaagggaattactttaagtattgatgaggtaagagagcttaaaaagattttaaatgatatagatttatagatgggagtaccgttttggtactctcttttttagagtgcaaaaagaaaactagaattaattctcgatataagcaaaattaaaaaattataagataagcattttctatagtagttaaattttatagagagattaattataaaatattatttattatattttaaaaactatacaataaaaatattaatgctaagttttaccgattttatagggaatattatttaatatagtggtcaaaatataactgtaaaataaaaataataaatatatatttattatgaaaatctaattatttaattactattaaggatttatttgaaaaaatttgatatttaagaattaaaaagtaattataaaattttattaaaggagtgtcttttatgggatatgataataataaaaacaaagaaggtaatggtagtttattaagatggttaggaagatttatattagttgcaattattcttatggtaacatcatttgtaactccaggattttcaatcaatggaatgtggtcatttttaatagctgctgttgtaatatctgtactagattatttagtagaattatttatgggagttgatgcatctccttttggaaaaggaataaaaggttttgtaattgcggctataataatatacttagcacaatttttagttcctaatatgggagtaactattataggagcaatattggcagctatagttattggaattttagatgcgatatttcctgttagagctatgtaatgttaaatacattaacacaacaatttataaaaaaatttaatttaaataataacaaaaagccgtatcataggagtatgatacggtttttatattagtaatttttaaaaaaatatattactggttaaatgtgattaatttatatttcgataattataagatacatataataaagctaaataaagtaatcaatactttatttagactattttgcgtagtaaaatatattagtcataatatatttaaaatcataagaaaagtagattaattattaataattttgggtattagaataaccctaaaataatagaaaggattgtagtatgaaaaaaatatttaaattattgagtttatcaatttgtgctgtaataataagcgtattttttgtagggtgtagcaaaaactcttcagagcaaataagctttcttaactatggagaaaacatagacaaagaaactgtgaaagaatttgagaaaaaatacggtataaaagttaatattgaaacttttgatgacatggaaacaatgtatcaaaaaattagcaaaggtgcaggtcaatatgatgttattttagtatctgatgctttaatgccaagaatgattaaaaataatcttgttcaaaaactaaacaaagacaatatacctaatatatctcaaatggatgaagattacttaaatttaaaaatagatccaaacaacaaatattcagttccttatatgtttggaacagtaggacttatttataataaagatgtagtaaaagaaaaagtagatagttgggatatactatggaatgaaaaatataaagataaaatctttatgtttgatacttatagagatacaatgggagcagccttaaagaaacttggatactctttaaatacaaaaaatccaaaagaaattgaagaagctaaagatttattaataagtcaaagaaaattagtaaatccaatatatggagttgataatggaactacaatgattccagcaggtgaatctgatataaatatgatttggtctggagaaggattaaatcttcaagatgaaaatcctaacttagtttatgtagtgcctaaggaaggtgcaaacttctggattgatagcttatgtataccacataatgccaaaaatgttgaaggtgctgaaaagtttataaactttgtaagtgataaagaaagtgcgttaagaatagcagatgaaataggatatacaactccaaataaagaagctagattagagcaaccagaaaatgttagaaataatcctaatgcatatatgcctaaagagataatggatagatgtgaaatctacactgatttttctagtgatgttaaaagaatatatgacgatgcatggacacaaataaaatcagataattaaagaaaataaggaaaggtcaataaaatgacctttccttatttttatattacttattaaattatatttatttacaaatttatattaaactccaaatcgaatagatgttagtataacaactatagtggttacaaatattggaataacaacagaagttacaaacatatctttataagcttctttatgagttaatccacaaatagcaagagtagtaattactgctccattatgaggtagagtgtctaatccacctgaagaaagtgaagcaattctatgaagaatttctggtggaatatttaaagcatgactcatttgcaaataagttggagctaaggcattaagcgatatttcaagacctccagaagctgaagccgtaagaccacaaattaaatttactgataaagcttcagatattattggatttgatgaaataccaaaaataaatgattgtataacactaaatattgctaaagactttatcacacttccatagccaactatagcactagagtttaataatggtttaaaggaattagtaacacctatatctagtactgattttatattttttatttttttaaaattagttaataaaataaatatatcagataaaactatagctattattacactccaagtacctgaaacattgcttaatgtagtgttaaacttacttaaatagcttccatcgatattttcataataaacttttgagaagaataagttggttataaaaattataattataggaagtattgctttaaaaatacttggcagattttcgtagttttcttcagctatattatcactatgatttccataaccttcattattagctttagcagattttacacgttttgtaagccaaatcataccaagtgataacatcataatacttgcaaatattcctataactggagctgcaaaagtatctgttctaaagtatttcattggtataacattttgaatttctggtgaaccaggtagtgcagtcatagtaaaagtaaaagctccaagtgcaatagttccaggtataagtctttttggaatatcggcttctttaaataacatagatgcaattggataaagaataaatgcgactacgaataaagaaactcctccataagtaagaattgctccagatagaactactgctaatactgatttatcttttcctagttttttagttataaaatgtgctattgactttgcataaccaacttcctccattaattttgcaaaaattgatccggtcatgaaaagtgggaagtagttttttataaagtttgcaaagcctgacatgtaaacttctgtataatttgccattaaatgagcgtcaaatccagtagtaaggattattgttatcattgcaattattggcgctgttattattgttgagtatcctttgtaagcaagatacattataagtattaacgataaaattaatcctaagatgctaaacattataatttaatatcaaaataattttgataatctcctttctctagctatttttatagattttctaagtattttttattttacccgttaaatagctgtataaaccaatttaataataatttgaaaatattaagaaaattaaaattaattatattgtgattaagttcttttttatttttaagtatctagataaagttttatataggtacatatttaaaactatttaaaaaagtattggataaaaaagaattaaagtttctaaaaagcttctatagttgattttaaagaaattggcttttgcaaattcactgatgaaattagcattaagagaaagaagtaataaaaattaattaaattagtacaaaatactacaaaatatgaacttttttgatatttattcatattatataaagaggttctttataagaactttttaatatatataatggagagatgttaaaatgagctgtcaagattataaatgtaaaaaaaattgtaaacactgttgttcagatgattattgggattgcaataaatgggataaatgggataattggtataactgttatgaagatgaaatgagacatgttcatgaatattcagaaagtgtaaaactagcagaagaaggcgatgatagacataaccaccgtgctgcaggagttacaggagaagctataccaatatatggtggaactaaccatgttcataaaataaaaaatgataatacagatttccttgatcattttcataaaatatgcactacaacaggaccagcaattaatataccaggtactaataaacatgtccatttagtatctggaaatactactattgctgatggtcactttcatgcattcctttttaccactcaaattgatgcacctttagtatagattcaagatataaaatttatatgggactatgattataattttcatagtcctttttaaatatatttttttatttgataaatacaggaaaagagattatagtagctgatacaggagtgcttatgctattttctgattttgtaaaaaatagtatgtttatttggaggagttagtatggaaatcaaaggacaatgaattgattcgtaaaattatagagtataaagaaaaaattatattgaaaaacaatatatatattctaccaatctagtgtttgcgatttcaataatctatgaataattaaaatatatatttaccttaaagtaagacgtaaaattttatcatcagtttcatcaggattacctctaccatctctattacttgtcgcaatgtaaattgatccatcttttccttgaatgatttcacgtaaacgcccatattcatttttaaacaataattctaaattttttattaatgttccttcttcatttaccgttatagcaagaatttgttgcccacgtaaattagtaactaataactttccttcccatggaccttgatttacaaaagcaataccagaaggagcccatgtattttcaccactgtgtatcaaaggcttttgcactgtaatttctgaaaaattttcatctccttgaactataggccagccataatttttacctggatatattatatttatttcatcatgagcagattgaccatgttcagatgagtataatacattttctaaattccaagctaatccttgaggatttctatgtcctaagctataaacaggtgaattagcaaatggattatcattaggaatacttccatctggttctattctaagtatttttcctgctttacttttaatatcttgtgctaattcaggattccctgcatcccctgttgttatataaagttttttgtctggtcctatttttatccttccgccattatgaattcgtccaccaggaattttatcgataagaactttatcaatatatgcactattattttcttcaattaatctaacaacttgattatatattttattattttctgtatatgaatacataacgtatatataattattttgtgaaaaatttggatctagggcaatacccattaatccaccttcgccttgagttataaatggagaagtaaacttaattagtggtttgggattaagtttgccatctttaataactctaactgaaccagagcgttctgtaaaatatatatttccgtcatcacttaaatctatagcccaaggtacatataaatttgtagcaataatttcaattttataagggaattgtcttgagttggttgactttatttttacattagaaaaattattatgaggcattatatttgataaaatatttttaatcatctttttcatattgttatcctccaaatataaatgaatgtatcctaattaatatagtattcatttatagatttgaatgtgatattaaaaaatttcataaatatttttaatatataaatttttaaaaaccaaaattataaaaactacatgggttataactttatagtagggggtatataatctattaaaatatatagattggagtagtttcatggatataaaagacataattataagaatcttattagctatatgtataggaggaactataggttacaatagagaacgtgaaaatgtatcagcaggatttagaactcatacactagtgtgtctgggagctactgtagcagcgcttattcaagtagaattagcaaatcttgctttaaatcaaattgctaaagcaccagcactttcaggaataataaaattaaatgatggaagatttataggacaagtagtatcaggtataggatttttaggagctggaactataataaaaacaaaaggagctataaagggattaacaacagcagcatctatatggactgtagcttgtgttgggattgctataggaatggggttttataaaataagtatattaagtggagttagtatagcaatagttcttgtttttctaaagaaatttgaagataaatttatgagtaaaactaatattattaaaataaaaataaaatgtaaatctagggttgaagccataaaagaagttaaggaatcaattgaaaattgtgaaataaaaattgaaagtatagaagttataggagatgatgaatgtttatatactttaagaaaatcaaaattgattagtataaatgaaattataagtatgttaattgaaaataaaagtatagttacagcaactaaattatagatttaattgtatatattaagggggtaccattttagtaccccttattatctaaactaaaaaatacaaaatgttttttatgaaactgtgtcgatatcattttcaacaaaatcttcagataaagaatctatatattctttaagtttacctttatatatttcctcgaatatataaaagcctaaagctccacctaatgtatttaatatcaaatcatttacatcaacaattctatagtcagatatatttaaaatattagttattaattgtgttaattctatcgaaattgatactaaaaaagaaattattgtacaagattttagatttcttatacaaacttccatggcacataaatatattattagaggaattagtaacaaaaaattacctaataaaattttaatagaagatattttataaatattataattaaaaaagtctacaaaaggtaaaatatttaaattgcactgttcagcaaaacttaattgctctggccaaggtaaacgataacctatatgtataggaaaaatacgtattcctaaaataaaaaataaatacaatacaaacaaattgactaaaatttcactaaataagttgattttaattttgtctttttttcttttaaacaatattaagcatctataaattaaccagaatgggaaacaagtgcttaaaagaaaactcatatcaaaagtcatttaaataaatcctccggctataattattacatatatttccattttaacttgctttgtacttatttacgattaaaaaaaagtaacaattatttcaaaatttatgctttttataattaataaagtttttgagtatagttaatgtaaaaaaattaaataatataaaaaacttcataataaaattgaagatatgaaaggaggctgtcaaaattactaatattatatatttatggttaaaattttgacaagaattatgctcagaagaagtattataacagtttttattttattttttatgttaagtactacagtaagtaaatgtgaagaaaagcagttaatacttggaggacaatatataaaattattaaatttaaaagaagataaaaaaagaaatgacactgagcaatataaaaatcaagaacgattttttagaccatctaaagctcctatattaaataataaaatagatgaaagcttttataatatgtatggaacagatacatctaaaattaaaatacctaataaatttttaaaaaatcctgaagatattataatcaattactttagtgttttaagagaggcagctaatcctgttgaaggttccgaaactggatgtggaagcttaggtgatacaagagcaccttatccaattgcgtataagtttttatcagattcttataaaaataaggtgtcttatgaaaattatttaaagtcttttgaaaatacacttcatattaatttaattaaattaaataaggtaggttcagataaggaaaatcccgacattataaaatattttgttgaaattgaaacaatagaaggtacaaatgagtcaaaaggagtttttgcttattattttggatatatttatttacaaaagcaaggtgaagtttataaaattgtaaatatgaatttcactccagaaaattatttatgcgctccttatcatggatggtcatatgatgctaaatcatttgttgaaattgaatatggaaattggtgttctttgatagataataaagtttatgtaaaagaaaatggatatgaaaagaaagtttattttaaagataaaaatatgaacgagtactatgtacttttttatcaattaactaatggtgttgatattaaaattgcagattataaaaagaataaagatggaaaatgggatcaaatatatattgactcaacaaagtgtttagaaaaaaataataaataatgaaatatttgcattttataaaaaggtaatagcttataaagctattacctttaaacattaaatatattaaaaattataactgtataagaatacatttaaagatgttttaaatgatttaaaataaatttctttttcacctatacgattaaagttttgaatatcataaaacttgtagttacatctagtgtctgtatataaatacaaagattttacatccatttttttcatataattaaataaatgattaactaaagacttaccaatacctaaacctctatatttttttgatacaataaacaattgtatacaaccttggaaattattttctcgttttcttataagttctttatacgtatctgtaatttttgaaaattccttgaaaaggtctttgtttttatcatcatttataattgaatcaacttcattagggtcaatacttaaaatattgttacaattttcaaaacgatttttatctttttttgcactacctaaaataaatccaacgacttgattatctttttgagcaactttactaaatgaactttctaaaagacattctttaagatagcctgcaagtaatatatctaaaagtttcttatctttgacaaattcattaaaaccaaatgcttcacctataaattctttcatagtttcataatctgtttctactaaatttctataaattactttacccatattaaatactccttttatataattaaatttagatttagtattaaatttaaatactttataatgataataagatgtaccctaaggggagagtcaataaaaaggaggagtgaaatgaaggatttattttctattggggaagttgcaaaaataaaagatattacaataaaagctttaagatattatcataaaatgggtattcttattccaaaatacatagataatgaaactggttatagatactactctatagatcaatttatttatatagatattataaaaggatgtagagctttaggaactagtataaaagagctacaagacatttttaaacaatgtgatactgataaattactagaatttttacaaataaaaaaatgtgaagcacaagaaaacataaataaaatgaaagaagtgattaaaaatattgattctttaaatatgagtgtagaaaactctaaatatatattaaataatgatgatataaatattaagttttttgaaaatcgatatataattacagctccttgtaaagaagtaggaagtttaaaagagttactttactactcagatttagaaaaatatttgaagataaaaatttaaatatgtctatggatagaggtataatatatgaacgcaattcagacaacactataaaaccaagatatgtttttagcggatttgaaggaagtataaatatagaagatgaaaataatataaaaatactaccaagaggaaattacttaactttatcttacagtaaagaaaatgaaaatgaacgtaggaaaaaaataattaattacgtaaaagaaaataatttaaaaatcaaaaacattattgaaattgagttatttaatgattttttcaatatagaatcttataattgtcaaatccaaatatttatagaagataattaagtaatttaaagttctagtaaaaatgtttaaaatttaaaatataaataagcatatataaattttaaatggtaataattctttaaaaagaatttttataattaacctactgtttaattttcaaagttctttgtgcttatcttgagcacatgtataataatatcattataaattttataagtcaacacttttttataaattttatttatccattaaaaataaattatacctttcgattaaatcaattaacatatctgcatatattaactctccattttgattttttttagtactataccctgcattttctaatgattgtgcttgttccttataatcattaccttcaaataaaccatgctgtttatatcttttattttcttttaaaaatctagcatgatctgttatagattcttctatagaatcatattttctaaatttagcttttactatatcactgtaattttctgtagtattaacttcaacgctctttcctttccaactttcatctgactttattccaaataaattattgctatttttcgttaattctgattgcccccaacctgattcaagtatagcttgagctactgttatagacggtaatattccatactttttgtaactttttttcgcctcattttcaatagtttttacaaattcaaatttttctttatctaccgatatatcttctctagttatagttccctcttcatacttattgatatctatacatatataaacacttaaaattatacaagttattataattatttttttaaacttcttaactaacttttttttggttctaggcttaagccttagttttcttttaataaaattttttcttacttttcccatatactcctcctctttaataattaatattatataacattaattatatgttttattttaaataatcagtcatttttacaaaaataaaaactcactttaaataagtgagtttttattttcatctattttgattttaactgtatccatgcttcatcatatagtcttatcttatttcctagatctctaaaagtttcagtttttttcattacatccttagaaggatatgctacttgatttttcgtaacctctggatctaataattctaatgcgcctatattaggagtagaatatccaatatattcagcatttatttttgcaatctctggatctaataagaaatttataaacatttcagcttcctttttattttcagctgttttaggtattgccatcgcatcaacccacttattagttccttcttttggaattgcatacgctaaattaggattttgctccattaatgtaactgcatctcctgaatatattatacccatagcagcttcttctcctaaaagtctatctttaccttcatcatttacatatgctagtactaaatctttttgtttcattaattctttcatagcttcttttatttctttaggattagttgtattcatactgtatccaagtttttttagtgctattcccagtgtatctcttactgagtcaagcatcattatattacctttatattttgggttccacaatatatcccaactatcaactttttcatgtactagctttttattgtataaaattccaaaagttccccacatataaggtacactatatgcactatctttatcgtatacaggactcatgaaacttttatctatatattttatattaggtatatttttgaaatctattttttgaagtagaccttcttttttcattttttctaccatataatctgatggaaatattaagtcatagtttgtacttccgcttttaactttttgatacatcatctcatttgtgtcataagtttcatattgtacttttatacctgttcttttttcaaatataggtataagactttcatctatataatctccgacattatatacatttaaaacttttttagaatccgtagctccacatccagtaagcatagacgttactaaagcccctatagtaattagtactgatattttttttaatttcatattatttatcaccccttactatagattgttttttatttgatattaataataatattaataccacagtaaacattattgtagataatgcatttatttctggttttatacctcttcttgccattccgtatatctctattgaaagattactaactccatttcctgtattaaagaaacttattataaaatcatctattgacatagtaaatgcaattaaaaaacctgatactatacctggttttatttgaggtaatacaacttttcttagtgcatacatcggtgttgcacctaaatccattgctgcttcttcaatattttgaggaagttgttttatcttaggaagtactgataatattacataaggtatactaaacattatatgagataataacatagttataaatccaaattctaaatttaaaaacacaaataaactcattaatgctacagctgtaactatatctggatttaatacaggtaaataatttatatttaaaattaattttcttcttttacctctcattttgtatatcccaattgcacttatagttcctactatagtagctattatagaagatattatagctactactattgtgtaatatagcgcattcattatactatcattatgaataagttgtttataccacttaaatgtaaatccaccccagtgggccatagatttagaatcattaaatgaaaatactgctaacgccattattggagcatataagaataaaaatactagcgttagatatatattagatgctaacttctttaaaataataacccaccgccttccttatcactgtcatcttcaaatctagacataatagccatagaaattaaaattattatcatcataaatatagatatagcagatccaaagttccagtctccaactactgtaaattgttgttctattaaatcacctagtaacataaacttaccaccacctagtaatctagatatagcaaatgtagttactgctggcataaataccatagttatccctgatacaactccaggtatacttaatggaaatataactttagtaaacacttgaaagctatttgctcctaaatctttagctgcatttattaaatcattatccatctttgataatgatgtatatataggcagtaccataaatggtaaaaagttataaaccattccaagtaatattgcaaaatttgtataaagtaatgttacaggctctattccaaataatcctaagaaagaatttagtattccatttttacctaaaatagcaacccatgcataagttcttaaaaggaagttcatccacattggaagtataaataataatattaacgtgtttcttttacttaaatgagctttagatattatatacgcaacaggataacctactaataaacatattatagtagatgctccagctaaaattattgaacgtaaaaatacctttaaataaataggattcattaatctttgatagttatttaaagaaaatacaagtttatttccatcttctgtagtaaaactaaaagccaccataagtattaaaggtattactatgaataatgcactccatattatatatggataagcaagaaaagatttatttttcttcatatctattcactcacttttctcattatatgaatatcttcaggatatatatctaatcctagctcacttccaacttgagcactttgcgtattgtgtaatatccattttcttccgttttcattgacttcaatttcataatgaacacctttaaataatacagatgtaacttttccttttaacattcctttttctggttctaccatttttatatcttccggtcttataacaacttcaatattttcgttcttttcaaaatctttatctacacatttaaatttctttgaacaaaattcaactaaataatcatctatcataactccatcaaatatattactttcacctataaatcttgctacaaatgcattttcaggttcattgtaaatatcttgtggcgtacccatttgttgtatcttacctttgttcattactattatcttgtcagacatagtaagagcttcttcttggtcatgagttacaaatataaatgttattcctagtttcttttgtatttttttaagttcaatttgcatttcttttcttagttttaaatctagagcccctaatggttcatctaataataaaacttttggttcatttactaaagctcttgctattgctactctttgttgttgtcctccacttaaagattctacttgtctgttttcaaatccctcaagtgcaactagttttagcatttcttttacctttttatctatttcatctttaggcattttttttattttaagaccaaaagcaatattttcatatatattcatatgagggaataatgcatacttttggaatactgtgtttatttgtctttcataaggcggtatatctgtaatatcatgttcttcaaataacaccttaccttcatcggcatattcaaatcctgctattattttaagtgttgtagtttttccacacccacttggtcctaataatgttaaaaattcattcttttttatatccaaacttaaattatctaaaacttgattatctccatatcttttagataagtttcttagctctattatattttctaacaaatatatcacctctttcaattaaaatgatggtggtgtactcacccaaataactctagcttccgtttttccagcatttgatatatagtgattagctctaggtttaaaataaaaactctcaccttttctaaccttattctttttatctcctatatgtaaatatatagaacctgctagtacgtatccaaactcttcaccttcatgaggcttttcttctttatattgtcctcctggcgataaagttattattattggttccatctcatttttttgagagtttggaaccaaccacttgaaagtatatttcaaatcttcatcttctgtttcaaacatatcttctttagtgaaacaaattttttcattgtccatttcattaaaaaactctttaaggttagtccccaaaatttctaatatatctataagtgtagcaatggatggtgatgttaaattgttttctaattgagatataaatcctttagaaagttcacatctgtttgctaattcttcttgagttagctgtttttcaattcttaatctctttattttttcacctatatccatggtccacctcctaatttcactcatttttactaaaccttttgtttaaaatttctaaacaacaaatcatattatataaaatccatatatatatttcaatactttttttgaattttttcacttctttttataactttaaaagcctaagatttcaaacctttcatagattttttatttttttgatgtttatattaatatttataaagtttagtatctctaatttttaaattttatttagttttttaatttacaaaataataaaaacctactacatagcaggtttttattatttaaaattatattaacttataatcttctttatttaattttgtagcagcagcttcatctattattaaaattacatcattatggaattttaatatagatgatggaacttgaggagtaacatctccatatacagtattataaacagcttctgctttacattctcctgatgctaataacattatttttttagatgcaaatattgaccctattcccattgtgacagcttttttaggaacatcatcaatagaatcaaaaaatcttgaattagcttctattgtagattcttttaaatcaactaaatgtgtattttttataaatgcatcatttggttcattaaatcctatatgtgcattatttcctattcctaatacctgtatatctactccaccaatgttttttatggcttcatcataactagcacattcaatttccacatctccattcataccatttggtatatttatattttcttttttaatgtttatatgattaaatagatttttatgcataaaataatgataactctgaatgttatcttttggtaattgatagtattcatctaagttaaacgttttcacttcactaaaatctatttcccctttattgtacatatcaactaagtttttatacattcctataggagtactacctgtagccaaccctaatatagaatctgattttaatataacttgacttgaaattatttgagcagcctttttactcatttcatcataatttttacaaactaatattctcatattcaccctccactttttatgcatattttacttaaatattatttccccacttgaaatagtcatatgacagtttaaattttcatcaaatatagatatatctgcatctttacctatatctaaacttcccttcctatcatctatccctaaagattttgctgggtttagtgaagctaaatgtatagcttcatttatttttaagttagtattttcatagaaatttctaaccatattatttaaactagaaacacttcctgctaatgatccactttctaatcttgcagctccatcttttactataaccgcttgacctcctagactgtaagttccatcttctaatccaccggcttccatagaatcagttattaatataactttatctttacttttactatctaatataaattggaataaatcttttgttatgtgtatagtgtcacatataaattcacaataagcatctgtagtaagcgcagctcctacaacacctggatctctatgatttaaaccagtcattccgttaaatgtatgtgttatgtttgtagcacctagtcttatagcatctcttgcttctataaatgttgcagcactatgtcctatagataaaacaatatttgtatttttctttatatctttagtaaatttaaaatctttatcttcttctggagcatatgttataacttttattacatcttcatatttttttacaaattcataactaggatttactatataactttcattttgagcacctttgtaaattttatttataaaaggtccctctaaatgagcccctaatatctttgcaccgtttatttttctattcattcccctttttattgaatcaagtgctttaactatagattcttcatccattgtcatagtcgtaggtaaatatgaagtaactccatgtctagcaactgacttagatatagtatctatggcttcatctgtgccttccatagtatcttttcccatattcccatgtatgtgtatatctattaagcctggcgatactagcttttgatttgcatctataatttcacaattttttggtacctcatcagctatatctaatattttttcatcaaatattaatactttattttctaatatctcatttcttaaaagtatttttccattaattatggctttcatttttataccccctatgcatttaatgatatttcatattgatacttatcacttctaaatatagatatagtatattcaataggtatatcctcctctatataagaagttctttttaatttaagagctaaagttcctttaatttgctttaaaaggtttgcctcttgctttgtaagcattattggctctattatttgttcagctcttttcatcttataattataattttcactaagtattgaatatagtgagttattagcttctaaatcttttttcaaatttttacacatactctttggtatataacttatctccaaaccaaatgggtcatcttctatataccttaatctcccaactttatatatcatttcattttcattttctatttttaattcttttcttatgtactcatcttgcttagcttcttcaaagaatagtatatctgtttttatatgaatccctttttctttcattacttcagtaaatccttgcatgctagaaaacctattcctctgttttataacagatacgaaagttcccttaccttgtactctatacaagaaaccttcattaactaaatttactatagccttatttactgtcattctacttacattttgaatagtacataactcacgttctggcattatagaatctccagacttaagttctcctgaatcaatcatatcccttattatattcataagctgtatatgaagtggagtttgactatttttatctactaatttcatatagttcaccactcttttatttatggtatataccaatttttggtatataccaattatactattatttacttatcacttcaacatcttgtattcttttgttataaaaattcatatatattacaatttatttataagatacccataaatatggtattataatagaatatatattttgtaatattaaataaagaggtgaattatattgataaaaataggtgatttcaataaattaactatagctagaaaagctgagttcggattttttttagatgctaaaacaggaaatactaaagatgatattttcatgcatagaaaatttactaattatgaagttttaatacctggagatgaggttaatgcgtttgtatatagagattcaaaagataaattagctgctactttaaatcctcctttaggtaaagtaaatgaaataggttattttgaagttgtagatgcaactaaaataggttactttataaatattggtttagaaaaagatatattagtaccttttagtgctaaacactatgaaatcaaaaaaggtggtaaatatttattctatttatacttagataagtctgatagaattgctgctactactaaaatagaagatcgtttaactactgattctgactataaagttggcgattcagttacaggtgttgtttatggtttccaaactaatgacagtgctatggtttgtgtagataataagtttgatggagttatacttcacaatgaatactttacaaaacttaacataggagataaattaaacttaaaagtaatcaaagtttacgaagatggaaaattaggtcttactccaagacaagaaagagctcaagaattaagtgaattagaagagaaaatcataaatcatttaaataatgcatctagaggtttcatgccttacaatgataaatctgatccatctgatatagcatctgtatttaactgtagtaagaaaaatttcaagcgtacattaggtatacttatgaaaaaagggctaattactcaagatgaagaaggaactcgtttagtttaatataaaaagagtatggatatccatactctttttatattttaatttaaataaattatttttaattagattttgttaattctcctgtaaaaatatttatttgatacttacccatactttgctcatgagaatgatgatctttttctaaggattcgtcttcatgctcatctaatcttacacgcacatctactacatattcatctccaacttgctttatatcttctttagtattgactactcgatttccatactgtgattttaaaactttaagtgctgtttcttttgatataggctctatatttttactatattttgtatcttcattagttttaatttcattttctttatttttacttatagaaaatattatcaatcctaaaataataaaaattaacaataaaatcaaatgtcttctattcataactttctccataattatttaaaattattttttaagatgtttaaagtataccacatttgattataatataaaaatagttctacttagccattagtgttgtattaatgactatataatagatttttttacattctagctacaccagtttttattgcagcttcttttacagcttcagctacatttttggctacatctttgttaaatgatttaggtaaaatattttctgtgtttaaatcttcttcttttatagaatcggctatggctttagctgctgctattttcatttcttcatttatttcactagctctaacatctaatgctcctctaaatattccaggaaaagctaatacattatttacttgatttggaaaatcacttctacctgtacctactatataagctcctgcttctttagctaaatctggcattatctctggagtaggattagccatagctaatattatagatttttcattcattgacttaaccatttcttttgtaacgcaattaggtccagaaacccctataaatacatctttattttttataacatctgataataatcctttttcattatgtatattagttactttcatcatatctctttgagcccagtttaaatctttcatattttcttctagcgctccatctaatccacataaaacaatatttttaactcccatactaagtaacattttagttatagccaatccagctgctcctggtccatttattactatttcaagttcttctatttttttatttattagttttaatgaatttattatagctgctgctaacactatagctgtaccatgttggtcatcatgaaatacaggaatatttaattctttttttaacttttcttctatttcaaaacatcttggagcacttatatcttctaagtttacacctccaaatactggttccattaattttacagtatgtactatttcatcaacattcttagtatttaaacatataggaaatgcatcaactccagcaaactctttaaataatatagctttaccttccattacaggtatagatgcactagcacctatatcccccaatccaagtactgctgttccatcacttactacagctaccatattacccttagaagtatatttatatgctaaactttcatttttagatatttcaacacaaggtgctgcaacccctggagtgtatgctattgataaatcatctttattttccacttttaatttactacaaacagtaatctttcctttgttcttctcatgtacttctagtgctaattctgaataatttttactcattataatgccctctttcatatattgattttaagttatttatttaattcataaatattgttaccattacaatctatagcaactattaataataaatcttttacttctagctttctaatagcctcagcccctaaatcttcatatgctattatttctgatttttttatagagtttgatatataagctcctgcaccacctatagctgctaagtatacacatttatttttcttcattgattctataacagattgattccttttacctttacctatcattaattttaatcccctatctagtaaagggtttgttaaatcatccattctataacttgttgtaggtcctgctgatccaataacttgtccttctttattaggagttgggccaacataatatatagcttgtcctcttaaatcaaatggcaactttttttcttcatttatacaatttattaatctttgatgagcagcatctctagctgtataaattacaccacttaaactaatcatatctccacatttaagtgattttatagttttatcctccattggaatcgttatccttttcattgtttttccccttaaattatgacttttttatgtcttgatgcatgacaatttatattaacaactacaggtagccctgctatatgtgtaggaaatgtttctatgtttactgcaagtgctgttgtgtttcctcccaatccttgaggtcctatccccaatttatttacttcctctaaaatttctacttctaagtttctaatatcttcatcttcattgtgtaatcctatatctcttagtaaagattttttagctatctgagcacatttttcaactgtaccaccaattccaactccaactactataggaggacatggatttggtcctgcttgctttaccgtttcaattataaagttttttataccatttacaccatctgaaggctttaacatttttaagctactcatattttcgcttccaaaaccttttggcgcaaactctataattatattatctcctttaactatgtcatagtgtattatagctggagtattatcttttgtattttgtctacttataggagttactacagattttcttaaatacccttcattatacccttgtcttacaccctcatttatagcttcagttaaattttgaccttcaatatgtacatcttgacctatttgtacaaaaaacactgccatacctgtatcttgacatataggcatctgtttttcttctgcaacttcacaatttttaattaatatgttcaaaatatttttccccaaatcattattttcttttgactcatattcttttatagacttttttacatcttcacccaagtatatattcgcttttatacaaagatcttttactatttcagtgatttttgatgatttaataattctcacgaacttaacccctactttcccactttatattcgactatatataaactttatcattttttatttattttaacaataaaaaagcacatactgtccgtaagtatatgctttcttggggatatatgagtttttatggttgtaagagatattttaagttttgggggagattaattacctcttatattataagtatggaccaaattttgatttatatacatcttattataattttttattttattttttagatacatgcttattatcttttatgtaatatctccataaataatcttttgcttcttcagcataatcaatatttacacgtttactttcaattatttcaaattgattactttcattgtctaaattaacattatctattatataaagtttatttcctaatatactttcaaaatttaaatttttatcaattttaagagctttacatagttttcctggcccattacaaatattctttctttgatatgaacttaaatccttataatcttttgagtatctattttgagatatttcatcaatttcacttataggttcaactgctctaatcaatagacactcaggtattccttctatattagccgaaatatttaagcaatgatacattccatatatcaaataaacatatatgtgcccaccatcttgatataatggctctgtcctttcagttcttctatctccaaagacatgcgctgctttatcttcgatgcccatatatgcctctgtttcaactattttagtaataatttttttatcatcatattctctaacaagatatttacccaacaagtttctagccacagttatagcatcttgtctaaaaaattctatattcatattatcccaactttccttaatttatataaaagttatattatatcttcaaaactacaatttataacactttgtaaatctataggatttatctctatttgatatcctatttttccagcacttactattatagtatctaaattttttgcagtttcatttataaaagttttatataattttttcattccaacaggagaacatccacctctaatatatcctgttagtttgttaatatcacttacatgtatcatttcaatcttcttttctcctgatactttagctgctttttttaaatctaaattttcatgtacaggaattacataaacataaatattcttactagttccatgtgtaactaaagttttataaacttcatttacatctcgtcctattttatttgccactgatactccatctatattatcatctgatacatcatatgaaagcatattatatttaactttcttagaatctaaaattctcatagcattagtttttacctttgccatatttaccactctccttataataaaccatataacttattatatacttattttctctttattctctattaaatttgatataaaataaaaagcctactaaaataatttattactttaataggctttttattttatattaccgatgtattaatatatatgacttataaaaaataattttattgcttttctccttaatcaaattatttttttattatataaggtttataatattttctttttttatatcttttaagttatcaaatcttccttttatagttactggatttcctcctaatataaatattttatctgctaaaaatagagcttcatctatatcatgagtaacaaatataacagttttagaatctttctttaaaattttttttattttttgcataatctcatatttcaacttaacatctatagatttaaatggttcatccataattatatatttagctggcttaataaaagctcttgctatatttcccctttgtcgtattcctccacttaacatttgtggatatgaatgtttataatcttcaattcctacaagctttaaatacttatcaaccacgatattaagtttatctttatcataaaattttttacccactaattttatattttcttctagagttatccactctataagtctatcctcttgaaatatataacttatattatctttaggaatagatttaaattcttcattatcgcttgtaagtatacctgtaatcaaatttaataatgtacttttaccacatccagatttacctaatatacagttaacttttttactttcaaattctatatcaaagtctttatatataaccttatcttcataacatttatttaagttacttattttcatacttatattcttctccatttataattgtacttagatatatacttttgaatataatctaatcctatagatattattactattattacaatccatgcaaatatagctggtgtattaaaattagttttttctacttgaataatacttcctatcccaaaacttggttgaccatatatttcacctgctataactacttttagtgctaaagaaagtgtagataccaaaataggaattaactttatatttatagatggtatatatatgtattttattttatctattattcgtaaattatatatatctaccatctcaattatatttttatctatattatttaaagctcctagaacactttcatacaaaattgggaatactacagagattccaattataaatggtaccttatttttatcaaaccatatcaaagctaatactactaaaatcattgttggtacagattgaagtatcgaatttataggttttataaaatttttaaaactactacttatataagataaagagcctaatactatagatataaaaaaagctaaagaaaaacttactaaaactcttattgctgtagaacttatatttattaaaaagtattcccctcttataatttcatataaattttttaaaacctcccctaaggtaggcaggtatatatcattatctattttaattgctaaaacttcccacataataaaaagtaatatacaagatgaaaatacctctaatttactctttaaaaaagattttttcatctggtagttttcctcctaatgtattaatatcaaattctgatagcattttataataatctaaataatctttcatataatctttagcttttatgaattttaagtttgcattttctatagatttactaattatttcttttttcgtacttacaccaacttcatttgcacactctcctactttatttggattttcatttgcaaattttacactttcatttactttatttaaaaaactttttacaaattctttattttcttttgcaaaatctgactttacgattattgtagcttggggatatccaaattttgaattagttatatttttatattcttcatttaagtttttaattaagtttatattttcatttttacttagtaatacacttaatgctggttctggaactatagctgtatcaacttttcctgttgctataataggaactagttcatttgcagaactaacatatgtaaaatcaatatttttttcattaattccacttgcttttaatataaatttagttgttatatctggagttaacccttttccagtattagcaactttattaccttttaaatcattaaaactttgtatatctttattagatacaagataaaaagaacctaatccagtagttcctgcaatctgataattttttgttttattataagcaatagctgccatatttgatggtactattgctatatcagcaccttgtttcataacagttgtagcaagcgtatctggtgttttttctatgttataaactacattatatccatcttttataattggtttttccttaatcatctttgccatggatacagctggcaacccatctggcataataactttaacatctttaatgttatctactttttgttcattatatgcacttgtattgctacatccaactataaatgctacacatataagcatagttaaactcttcaatacttttttccccatacctttccccccttaaatatattatcgctataatagtagcatattaattttattaattcagtagtttcatataatttctgataattataattctaacaaatacaaataaaaaagctaactcacaagtaactaataaattactttgagttagcttttcttatataaatggattataaaatctatttccatttttaaatgttatatataaagatcctaacaagattaatatagctaaaaatatagctatataatcacttaatttaaactttcttgaattataccaagtacgttttcttctatttccaaatcctctaagttccatagcacaacttataacttctattctctctaaactcgaaaatattaaaggcataagtatagaggaaatatttttaagacgtttacttagtttttctttcctagacatatctatacctctagcctgttgtgcataagatatatcatgataatctctttgtatatcaggtatatatcttaaggctattgctactgaatatgcaattttataatttatacctaatttatttaatgatgctgcaaattcactagggtctgtagttactataaataataaggccataggtattgttgctagtatctttaagttaaagtttaactgataaaataactgctctgaagttatagtatatggacctattaattttaataaattagttctagttccataaatttcaacaccttgataaggtcctaatataaatattgcaatattatttaatatcataaagaaaaaaataaaatatacaacgaatgccacatctttaaattttatctttgatattttaaatattataagacttaaaattaacatacctataagaactcttgtatcataagttaccatagatgcaatcgaccaagctatgaaaaatattaattttgtggcacctgttaaattatggataggtgaattttcttttatatatgatagcattgttgttttcatactcttctaatcctcctatcatattcaataaatttatttacaaaatttcgcggattatctaattcacacctaactgctagctcataaacagaagtttcttttaaattagcttgtttaataacttcattattagttaatatactagctgaagtgtcatcagctaatttctttccatcagctaaaactatagctctattagtgtattcaagcattaaatgcatatcgtgtgtaatcattattatagttacgccttttttatttaattcaactaaaaactccattatttcattataatgtctaaaatcttgtccagctgttggctcatcaagaattattatttctggatttaatactaatatagaagctattgtaacacgttttttctgaccatagctaagtgctgatattggccaattacgatactcatataatccacatacctttaatgtttcatatactctttcttttatatcctcgtctttgaagcctctaaatttaagacctaatgcaacttcatcaaatatcatagttttagatatcatttgattaggattttgcataactattccaattttttccgcacgctctttaatagaatcattagtaatatctctattatttaaaagtatttctccactagtttgcttataaaaaccacaaatcaatttagatatagtagatttacctgctccatttttacctactatacttaccatttcacctttatttattttaaatgatatatcatttaaaataggtttatctttttcatatttaaaagatacattttttaattctagtaaagtttcgctttcatttttaactttatcaacctcactatgattattccatttttcaaggctttctttacatttacttgtatctatagtatttatatgcccaggtttcatatctggggttatattcacacctgcatacttaagagctgtaatataaagtggttcacgaataccacttttctttaatacatcagatgaaatcaattcgtctgcactcatgtcagcaattatcataccttcattcataactattattctatcaacatcacaatgaagaacatcttctaatctatgttctattataattattgttttatcagtttcatgttttatcttatctataagttttatagcatttttacctgttgctggatctaaactcgctaaaggctcatcaaataataatatatctacatcatctactgtaaccccagctaaagtaactctttgtttttgacctccagataaactatatggagatgaatctaattgtttatctataccaactaattttgacacttttttcaccatagatttcatcttactttgaggcgtacaatcattttctaatttaaaagctatatcttccgctaccgttaaacctataaattgactatcagggtcttgaagcactgttcctaccatctttgatacctcaaagatacccatatcttttgcttctttttccattatttttaagctacccgtactagttccttgatagtaaaaaggtgtaagtccatttatgcaatgagctaaagtacttttaccagaacccgacggacctactattaatactttctcaccttcgtatattgtaagatttatattttttaaagtaggtttagcttgaactctatatttaaaagtaaaatctttaaattctattattttctttttcatacgaatctccttttatagttctctatctaaactacccgttggtatcttagtttttgcatagctctttattataatagttcctaaaactgctactgttagtatatttccaattccacctaaaataccttgtaaatataccttagatgcaggttctgcataaattaatatatctagtgttggtgctactacaaaccatgctagtgcatttgcaataatttgagtaatattaaatattattatttcctttttattaaattcgcctccactaatattaattttcttatatataagacctattactaatccaactacagctgatgctataacccaactaaaccatggtgatccgtaaaatatagcatcttttaaacaatgtcctataaaacctattaaaaaacctgcaagtggaccatacataagtgccattaaagctaaaaatgcatatgcagtttctatatttgtatttggtattcctgttggtatagaaccaaaacgccctaatatcataaataccgccgatccaattcctatagcaactattgtttttatggtaagcttatttcccattcaatcaacctccttttctattaagtttttatatttctatagatttaagttgaaattttatacttgtttatatagtataatattctctatatttttttattttttcatttttagtcataatttttattataagtaatgtatcaaaaaatgtcaattttcaactctttaagttgaatataagaaaactttttcaattatattttaaatatattatactcaattttatataaataaaagcctgtttgattaaacaggcttttatatctatcttttctttcttctttgtttgtttgaattattatttctatcatttctagatttattatctcgattgtttttagttccacgtttacctttattatcatttctgttattttttctacctgaagattttgttgaagaagattttcctttattgtagtgattatttctagaatattctcctttaggctttattaagcattttggtccaaatcctattaaatcttctcttcctgcttcaactaaagctgcatgaactaattcataatttcttggagctctatattgaagtaatgctctttgcatagctttctcatgtttagattttggaacatatacaggttccatagttaacggatctaatcctgtataaaacattgtagttgataatgttccaggtgttggatagaagtcttgaacttgttctggctgatacttagtatctcttaaatactctgcaagttctatagctgaatttagtgttgaccctggatgagaagacattaaatacggtataatgtattgcttcttaccagctctttcacttaatctaaaaaacttttctctaaatttatcataagtatttcctgctggcttttgcatatattgtaatacttcttctgctatatgttctggagcaacttttaactgtccacttacatgatgttcaacaagttctttaaagaatttatcatttttatctgccattacataatcatatctaatacctgaacgtacaaacacctttttaactttaggtaaacttcttacctttctaagaagctctaaaaagtcagtatgatctacttttaagtttttacatggctttggatgtaaacattgtttatttttacaagcacctttagttatttgtttttcacaagcagcatccctaaagtttgctgtaggtccacctacatcatgtatatatcctttaaagtcttctaattctgttatatatttagcttcttctaatatagattcatgacttctactttgtacagctcttccttgatggaatgttattgcacagaatgaacaactaccaaaacatcctcttgaactaactattccaaacttaacttcttctattgctggtattccacccatagctttatacatcgggtggtaatctttagcataaggaagtgcataaactgcatctaactcttctctatttagtggtggttctggtttattttgaactaaatatttatctccatgtctttgtattataacttttcctctatatgggtcttgttcatcatattgtattttaaatgccttagcataaagttctttatttgaagaaacctctttaaatgatggtatttctacataatcatcatatatttcatccttgctatctgcaacataacaagtcccatttacatgtcttatatactttggttcaaatccatcatttaatgcattagctacttctacaatttgtctttcactcataccataaactaataaatctgcttgactatctaaaagtatagactttcttactctatcactccaatagtcataatgtgcaaatcttcttaaactagcttctaaaccacctattattatttttgcatctttatatgcttctcttattttattacagtaaactataactgctctatccggtctaagacccatcttagctcctggagaatataaatctttatctcttctttttttacttactgagtagtggttaaccatagagtccatatttccagagttaactaaaaagcctaatcttggttcacctaatttcataaagtcatctgtacttttccaatttggctgtgctattataccaactttgtatcctgcattttctaatactctagatattatagctgttccgaaactatgatggtctacatacgcatctcctgttactaatacgaaatctaattgttcccatcctctatcaatcatatcttgtttacatactggtaaaaatttatttgtcatttaatcacctacttatatgtcatatatatttattattaactattttgaataagtaaaatcaaatttactacttaagattctattataccattaacttccctactatttatatgattttttatttccaaaacaaaaagtgccaattatcttaattagcacttaatttatatacttatcttaatacagtttttctatctatatcatggctagagtttttataaagtttattggtttttaataaatatacgtatacacttatcatcagtataccttttaatatactcgatatacttatactccaccaaacaccacttaatcctaataactctggtcttgataaaaaatatgccataggtacccttgctcctgttaatactgtcaatataattgatggtatataagttctacctatacccttaaatgctcctgctgttattatctctacacacataaaaagctgagaataccctaaaattttcaaataactagcaccttcttttatagcatcagcttcatttataaatatagtaaatatttgtttaccagcaaatattaaaatcgaagtcgttattattcctaagacagtggcaatacctaaagttattttaaatcctttatttattctattatacttagttgctccatagttttgacctacaaaactacttagtgctacagcaattccatccgcagtcatccatgatatagcctctatttgagatcctactttttgtgcagctatagccaccggtccccatgacgctactatcactccaagtaacattgagaatatggtaaacataccactttgtatagctacaggcatacctaatttacataatgatttatagtattctaaacttatttttctaaataatttcaccttaaaatactcattatttcttttcataatcataactataaaacacatagtaactataaattgtgaaaatactgtagctatagcagctccttctacaccaagctttggaaatggccctataccaagtataagtaatgggtctaatattatattagttataagtcctactgtgtttattctaaatggatctttactattacccataccattaaatatagctgtaaatatcggatttataaaataaaatatcattcctaatgcaactataactaaatattttttagacattgatataacacttgtatctcctaaattaaaaaaacctattaaactatctttaaatattaatagtactaatgtatatattaaagataatatgatatttacctctatagcagcctttatataagatttagtttcttctgcatcatttttccccatactttgtgctacttgaacttctccacctactctagatatagcaacaaatgccattgccagccatggaaaaaatccagctgtaccaacagctgctacagcactacttcccgcttttcctacccatatcatatctaccatattataggccatttgtataaatgatgttcccattataggaagtgctagttttattagtttatctattatttttccttctgttaaatctattcttccctgcaaatttaccacctcttttttatagaattttccgaatttacctattcgctatattaataatagctataccttctaaatatttctataaaaatttataattttaacttattatttaagaagcaatatcacaaaataaatctaattttatatttcagtaacttttacttaaaaataggtatgatatagattatttaaatcatctaaatcataccttaagtttttataaagatttatataatttctctagcctattatttatggatttgtattcactaaccatttcatttagatgttggaaaatacctttatctaacttctcatctttatatgaattgattaaattacttccaccttttatacccatatctatagcatttattgcatggtctataacttctttatcattatctataaaaatatcttttaatttttcaaacatgcttgccatttctccagctactcctaatgaattactaggttctcctccaagtttttttatatatgaacttactttttcatcttgctctctaaatataagcataattttagttaattcattttttatatcctggcttttagctttgtcttgataaaccctaaatgagtccgctcccatatgaattcctcttaaaaatttatttaattcttttattaattcatcatgtttatccattttatcacctcatcattagtttccttataaacagttagattattcatacattcctaaaatatattgtttacaaattttctagatctatttattataaattccatagtatttaaaaattcatctacttcttcacatgtattatataatcctaaacttgctctaaccataccagctgctttacaatctcgttttaataaatcttgagctgcctcatctgttattcctagtaatcttcttacataagtatgcgcacaaaatgctccttgtctaaccgctattcctctaatatatgataacttatctgcaacagaatcaaagtttattccatctacattaaaaggtataacacctaatctatcttcacaatttaaatcaccatataattttactctatctatatctttaaggccttttattaacctatctttaagaaggtcttcatgttcttttactttatcaaatcctatttcttttaatttattcatagctgtatatagtgctacaacacccaagtaatttggtgttcctgcttcaaatctctctggcgcattactccaataaatatcataatcaaatactaaatctacagctcctccaccttttataaatggctcttttttttctaaatcttctttaagtccaataactaatccagacccatatggcgcatacattttatgcccagataaagctaaaaaatctatagaatcatcatttcctgttcctttcatatttatctctctatgaggtgctagttgagctgcatcaacaataattttagctccatatttatgagctattttagctatatgatttattggattaatatgacctgtaacatttgatgctcccgttatagttacaaactttacatctccattatgtttaattaattcttcctctatatcatctatatttaatcttcccttttcatctacttcaatatatattaaatttgcattatatctccatggaaggtcatttgcatgatgttccattctagttgtaattactttatcatacttactatttaataatgtatttgcaagtaaatttataccttctgttgtattttttgtaaatataactgtgtatctatcatcattgtctaaattaaaaaatgttttcacataatctctacacttttcatatatcttacttgaatactcagattttggcccctttcctcttcctatagaaccatacatttgcatatgcttaaaaatttctttatccacacatttaaaaggaggtgtcgttgcaccattatcaaaacatataggagtagcatatgctccatctgataattttattgttaaatctaccccatcaaacatgtgtctgtaattgatttcttgtctatacattcccttccccccatataaaaatatataaaagtagcaattatacttcttatttaatagtattcaagtttaaaaataatgttcatttttaatatatttgctaagttatcatactgtaaaacacaaactagtttctcatatattatttatgattttaaaatagcaaataaaaaaagagtatctcttttttattttgagatactctttttaataaattattttaagtctttaaatttttctttaaataattcacctatagaacctaaagaatcttctgtttctaagaattcagaatagtcttcttctagctcttttgtagcttcttttaatgaaactaccatttttttatctttattttttatatctattatcataacatctatttcatctccaacgtttacaacgttagatactttcattactctatcttcacttaattcagatattggtaagaaggcttctactccaagtttaacttcaacaaatgctcctctttctattaattttaataccttaacatttattatatctccaacttgcatttcttcttttatagaattccatgggtcattgtttatatcttttatagctaatcctattcttttgttttctttatctacatttataacatacacatctacttcttgaccttctttaacaacttcttcaacagaatttattctatgccaagctaattcatttatatgagctaaaccttctattccacctaaatctataaatgctccataactcattatcttacttactttaccagttcttttttgacctacttcaagtgagttaaataaatcttctttagcttttttaactctagctctttctgcttctttttctgcttttattctagctcttttttctgctttttctgcatctaatctttcttgagctacctctctatgagatgctactattctgtttcttcttaaatccatttctaacatgtaaacttctaaatcacgaccaacatatgcagcagtattgtttacaaattttacatctatttgagataatggtataaatacagtttctgttttataacttgtaaataatcctttttctatacttctttctacgtgtactgttagtatagtatgattatctaaagcttctttaagttcttttctagtagcttctacaaaagctttttttactgataaatatataactccatctttacgttgtatcttagttatttctccacttacttcttcccctattttatatttatctgatatctcctcatctttagctaataaaagctcagaagatggtataattccatcaaatccatagtttagttctatacgaatctcatcatataatattttagttatttttccagttattatctgaccaacttttagattactcatttctttttcttgttgttctaaaagttcttgcatagtttgattgttatccattaaattccattcctttctatgtaaacgtttataatttcatatatttacctattattatatcactaacatttaattctttatattattaattaatttactttgtaaaaaatatttcttttatgcagtcttcgctataattcaccactaaatttcctgggaaatctacttcttttaatattctttcacaattttcaaatgctccaacttgataataaatatgagcatcacttcctaatataactttgacattatattttttacataaatttaataattcttgtgcgtttttagtagctccaaccctaaaactatttggtcttaacgatgaattatttatttctaataatgtattagtttctttagctttttttacaactgtttcataatctactggatatctactatcatccaaatgccctattattttaacttcttcattttccatagcacataaaacagctttggtattttcttccttacttccgggagatatgcacggtggatgtaaactagctattacataatctaactttccaactacatcttctggtatatctaaatttccatcaaaatccattatatttgcttctattccttttaacatctttattccatttatttcttcttttataactcctaaattcccaaaatagaaaggatgtgtactccctggcatctctggagcatgatctgaaacacctaaatattttaatcctttttcttttgcttcatctatgttttcttttaatgtactatatgcatgtccactagctatagtatgacaatgtaaatctataattggtttcatatttaagcctcctatttatagtttatatttttaattatataataattaatttctttttatcaaaattttatttagtactaatatgcaaaataagctatcataatgagcaaacactacttattatgatagcttatgtaaatttttttattcttcagctttagttttagctatttccacatttacttggcctaaatgattaactgataatgtctttttataaaatacaataaagcatactacagtagtaatcgcagctaacacgtctgcaacaggctctgccattaatactccttgtaatttattttcaataaacataggtaatataaatattaatggtattaataatattatttttctaagtaatgctaatatcatagatatttttgcttgacctaatgcaaggaatgtttgttgacaagcaatctgagctccaaacataaatattccagcaaaataaattctcatactccatgctgttattgacacaagttctggattactattaaatatagatacataaatttgtggaaatgcaattatacttacacacattatagttgcatatgtaaaacaacatataattaataacttaaatgtctttctaaccctatctagttggcctgctccgtagttaaaactcattataggttgcgccccttgagttaatcccatcataggtagaagtattatttgcatgacactacttattatagtcatagctcctactgctaaatctcctccatattttgcaaggctattattcatagttattataactaaactttcggtagcattcattataaatggtgatatacctaaaagtaatataggaacaactactttaacacttggtacaatatattttttctttatttttagtacactttttttaccaactaagaattttaatacccaaatagcagaaacaaattgagctgttatcgtagctaatgcagctcctttcactcccatatttaatccaaatataaatataggatctagtattatatttataattgcacctatcataactgtcatcattccagttttagcaaatccttgagtatttataaatggattcattcctaatcctatttgtacaaatatagttcctataagataaatccctatatagtcattagcatatcctatcgttttatcacttgctccaaatgcccaaagtatatcttctttaaatatcaaaaacgatattgttaatacaaatgatattattaataatgtagaaaaactattagtcattattttttctgcaccatcattatctttttctcccatttttatagctgctagtggagctccccccataccaactaaagcgctaaaagctgatactatcattattattggaaaagctactccaacacctgccatagcaatttctccacttggtattcttcctataaaaattctatccactatattgtataatacattcactatctgagctattatagcaggtagtgccaattgaaataataacttagaaacactacctttccccaaatctgtagcttgctttgacatattaacctccttattaaaatacaattaaatcctatgatagcatattcctaaataaaattaaatattttaatttaaaatatttttattgtttataatttattctaataaataatttttgttactataattaagttataacttatcaaacaacgatatagtagtatacatttctttttctttatctgataagtttgatatacttacacctattaatcgaatttgtttattcttatctttgattttctctattaaaatattagtatttcctaatatatcatcatatgtatgtataggagtttttaaagtatgtcttttagttacttgttgaaaatcttcatacttaacttttacagttattgtttttccagatttattaatagaatttaatctcatatatacatcttttacaacttcttttatatgctcatttaattcatctgaatcaaaattcacattagaaataaatgtactctctgcacctactgattttctttctctactaacctttacaggtctatgatcaatccccctagcaaagttatacatatcgtatccttttttcttaaatattgtttctaattgaattaactccatatttcttaaatcatacccattgtttattcccatcattttaagtgttttttctgtgacttttccaataccaaaaaacttttttataggcagtttatctatgaattcttgagctttttcaggagttataaccgtcaatccattaggtttttgataatcagatgctattttagctaaaaatttattgtaagaaaccccagcagatgaagttatacctatttctttatatatatcatgtttaattcttttcgcaattacacttgcatactctataccctttttattctcagtaacatctaagtatgcttcatctaaagatagtggttctataatgtcagtatatcttttaaaaatttctcttatttgacatgaaaccttgtgatatacatcaaatctaggaggaacgaatatagcatgtggacaccttacataagcaactttagatggcatagctgaatgtatcccaaatttccttgcttcatacgaacaagtagcaaccactcctctactttcaggacttcctccaactataactggctttcctctaagttctttgttgtctctttgttctacagatgcataaaaagcatccatatctatatgaattatctttctattgctatacaatatatattctccttatctatttttaattaaaaaaccgtattgcaaaatgctttacaatacggttatatacaatattagttttgatataagttagctgatggatattctggatcagaagttgtatccatacctaattttctaaatgtttgctcatcatttacatttaacatagttgttgaatgagcttgagctcctttaagcataggtaatttttccattgcagcttgagctgttggattagttacagcacatatacttaatgcagttaatacttcttcacagcttaatgcaacatttctatttcctaaagtgttggcttttaaattaataattggttctaaaacaactggtgatattaaatgcatatcatcatttatatcagcaaaatgcttaacagcatttaatacagcagccgctgtcgcattcattgtttcagatgcttttcctgtaagtatagttccatcacaaagttctaatgcaactacaggacatatatcatttggtgtattagaagcttcttttaacttagcactatattctctagcaggcattactacttttctatcttctggctttaagtttaattcttccattattaaattcattctatcataagcacctttatcaacttgtccttttttatattcacaagctgttttaaagtatcttcttattatctcttgtcttgaagcttcttgaactacttcatcatctattataccatatccaactctattaactcccatatctgttggtgattgatatacagattcttttcctgttattttttctattattttctttaaaacagggaatagttctaagtcacggttgtaattaactgattgtactccatatttttcaagatggaatgaatctatcatgttaacatcttttaagtcaactgttgcagcttcatatgctatatttaaaggatgctttaatggaacattccatactgggaatgtttcgaatttagagtatccaacttcatttcctcttttattttcatgatataattgacttaaacaagttcctaatttaccactatttggtcctggtgctgttacaactactataggtttagttgtttctatatatggattagctccatatccttcatcacttactatagtatctacatcacttggatatcctttagttggagcatgtttatatacttttatacctctacgctctaatttatttataaaaactgttgttgcaggttgtccttcatatcttgttataacaacactgttaacatcaagttcatatgctcttaaatcatctataagtcttaaaacttccatatcataagtgataccgaaatctcctcttattttatttctttcgatatcccccgcataaacacatattacaacttctaatttatcttttaagttttgtaatacttttatttttgcattttcatcaaatcctggtaaaaccctctttgcatgaaggtcaaacattaacttcccaccaaattctaagtataacttatcataattattaactctctctaaaatatacttagattgttcttctaaatatttcttgtggtcaaatcctatcttcattgtaattcctcctagataaaatataaatttagtagatatttcttcaaaaaattaaaaattaaataaaaaaagtaaatttaaatagattaagtctatatttactataactaaaattataatatcatatataactataacccaatttaaagtaaaataatatcatatatttttatatttttctagtacattttttaaaatctacataaaaaaaagctaactcattgagttagcgcaatcgaaatatctactaaatatttaatctatttatcttaggacttactattctaaatcatttgaagactatttgcaatatatttttttaatttctatttaaattttcagtatattttttccaattgaaattaatactatatctatatattagttggaggtgtttttttgattaaatgtttatctataaattgcgtttttaatgtttctggtttatgtagtacatctgtagttaatatagaaggttttgatgcaaatataactccagaaacttattgcaaaactttcatagactctttaaattcatctaaaataacaaatagtactatggataataacgagacctcatctaaaaatataatatgcagtgcatataactgcacatataattttagtggttcttgcaaatcatctgatatacaagttaattttttaaataatacttgtgaaacatttaaaaaaaggtcttataataattatgaatattaattaaaggcacctaactttggtgtctttaatacttacagtaactaatttgtcccttacttaataatatatactagtcatcttatgttaggaggggatatattgatagaagctttaatcttagttttatctttatgtatagatacttttgttgctagtatggcttatggaacagatagaataaagattccatttacttcaaatatagtaattaatcttgtatgctcattatttttaggaatttcattatctttagggggcttgttcaaagaaattttaccacctactgtagcttctactcttagtttctttttattattatcacttggtgtccttagactatttgaatctttttttaaaacctacattcaaaagttttctaatataggagcgcccttgacttttaaattatttgactttaagtttgtattagagatatatgccagtgaaactaaagctgattatgataaatctaaaaatcttaccataaaagaagctatatacttagctgtagccctttctttagatagtatagcagttggatttggtagtagcttgatatctataaactattttcaagttttggtgttatcatttttcataggtgtaatgtctttgtttcttggagtatactttggtaaaaaattcattgagaaaatagatataaatctttcttggctttctggttctatgcttattttactagctataataagatttatataaaaaaagagaagtttgtaaaatacaaacttctctttttttaagctaaatcaaagtcatcaaagctaaaatcgtcatctaaatcactttcttcttgctctttttttatcatattaccttcataaactttgaaaaatggataataagtcactatgctaattaacactaatatgaatacaaacaatacatttcttatatccatagatgataagtatgcttgtgcaaagaatggtgtaaaagatgggtcaactatataaccacaagttataaaccctatcttttgagcaaaatatgttaatgatacagatataattggagttactataaatggtatagctaatatagggttaaatactataggtcctccaaatattactggttcattaattccgcatattccaggaacaatagataaccttcctaatgactttaggtgtgcagatttacttcttgccattaataaaactaatcctagtgtattacctgctccacctaatatcgcaattctaaacatttgtaaattcattaatacgttagggtcttgtccagctgcaaccaaatctgaatttaatcccgtattgctaagccctaatgtaaatgctattgggaatattatagatgttccgtttaccccaaataaccataatagatttccaaaagttataagtaataaatacccccataaattatcagctatattaagtgcaggtgttagtatactcattattgactgaggtaaactcattcctgtgttagctattataataacatttagtccatataaaattcctatatttaaaattaaaggtaccaatgtatttataaaagatgaaacagctgatggaactgaatctggtaaattaaacttccactccattttatcaacaaatcttgttatctcaactgaagctattcctattattatagctacaaataatccatctgctcctaaaaatgacataggtatattaccttcattgctcggtgcacatatcataaagaataaagctgtagatataagtcctgacatagaagcattcatcttataatcactagctaacgtgtacgctattgcaaatgctgacattactcctagtaatcccatagtcatatcaaacggtgctgttatagttgcataatttgctactgcaaattccttccatgataataaaaactttacaaatacatttgcgttgttaggatcaactaactctggatttatagggggatttgctattattaaaaataacgaacctaccacaataagtggcaatgtcatcatcattcccgttgaaatagcattcaaatgtctttgtcttccaagcttatctccaataggtgatagtactttatctagtttttctaaaaacttactttgtcccatttaactaatctccctttttatattttgtattattcttgccaaggattatattggaatgcactttctattgcttcttctggcttgtacacttctaatatttttctataacgctctttataatcattatcaactttcatttgaggtataaccttacttgcttcatttaagaagtggaatgaatctcttcccatttcagctcctcttaccgtgtgcttatcaagtgcatagtcaggtatttctggaactcttcccattgcaaatccttttataacaatattttttaacaagtcacttgaacgatctttctcacaattacataaatatcttatagcatgtatgaaatatataggtctatctccatctgcataagaaaattgttttctcatttcatataagttattaacaattatacaagctgttggttctcccatacctatatcttctacagtcatagttaataatcttctccataacttttcttccatttgaggagatgttatatacatttcataagcaaattcacaagcttgctcttcaagccctcttcttatagatttttgaagtgctgatataacttcatctccatttagtccattacgagtttttattcttgcccatgggtcttttataaatttttcagccatgatgtctacctccatatattttatatttatatttttttgaaattcatatataatagcctttgaggtggttaaatatgaattttgaatatcttagtgataaatatcaactatctaccgtagaacagaatatattaaaatatttatataataatattgataacttgaaaaaaattggtatacgtaaagttgctaaagacaattttacttctacaaccattatatataaactttgtaaaaaactaggttttgaaggttattctgatatgatttataatatatcctactctaataaaattgatgaaatagattcttctgtagatatatttacaaatgcttataatcaaattaattcaaacttagttcctttatctaatatactaaaaaactctaaaaataaattgataatgctacttggtgttggatactcacaaatgattgcaaactatatgagtgagcgatttgtaatacatggattcaagtgtattgcaaacacacatttacaattgttaaccaaatcccataaagatgaagttttattaatagctatctcaaattcaggcgaaagtgctagtatattagaagtagcacaaactgctaaaaatagtggtatacaagtaattagctttgttggaaataaaaactctacacttgctaatctttcagatataccaatagttttaaagggttatgaaaaattccctaatttaaagaatactccaaatacattcttttccgaagtattgttactattcgaatgttttataagtaatatagattagtattcttataatttaatcttaatatttttcttatttaatttaaatatatttaatacttttagaaaaaagtttttcaataaaaaacattttataaaaatattttattctataattttttgatatatttacatttttttgctaataatcaataatataattagtattaatatacttattatgatattattaattaagttgtcagtaattaaattagcaatatttgtgaggtaaataatatgaattttaaagaattaggaattaatgataatacaataaaaaccctaaaaaaaatgggaataacaaatccaacacctatacaagaacaaagtataggtataataaaatcaggtaaagacgtaatagctgaagctcaaacaggaacaggaaaaacattggcatttttacttcctatatttgagaatttatcatctgaaggtaatcatatacaagctcttataatttcaccaactagagaacttgcaatacaaataactaaagaagcagaaaaacttagtgaaaatactgatattagcttactagctatgtatggcgggaaagatattggcgctcagttaaaaaagttaaaaagaaatatacacttagttatagcaactcctggtagactactagatcatatagacagagaaactgtagatcttagtaaattgaaagtcttagttttagatgaagcagaccaaatgctatttatgggatttagaaatgaagttgagactatacttagatatacttctaaaaatcgtcaaatgttatgcttctctgcaactatggattctgctgtaaaaaaattagcatataaatatatgaataatccaacagtagttagtgtagaaaaagaagaaataacattaactaatataaaacaaaacgtagttgaaactacagatagaaaaaaacaagatgcattatgttcagtgttagataaagataacccattcatgggaataattttctgtagaactaaagctagagttgataagctagaagaagttcttcataggagaaaatataactgtgctaaacttcacagtgatataaaacaatcccatagggaaagaatcatgaaatcatttagaaatgcagatatacaatacttaatagcaacagatgttgcatctagaggattagacataagtggagtatctcatgtatataactacgacataccggagaatgcagaaacatatattcatagaatcgggagaacaggaagagctggagaagaaggttatacatgcatgtttgtagacccaaaagactacaatacattaaaagaaatagaagatgctattgaaatggaaattccaagaagagaagtataaaaaagaagtgcaaaagcacttctttttttattagaataaaaaaagattacgcggctacgtcctactctcccaggcagcttcccaccaagtaccatcggcgctaaagagcttaacttctgtgttcggaatgggaacaggtgtatcctctttgctataataaccacataatctctaatagattaatatctatttagttagagttagtactctaaaaactgaataacatttattagattaaataatcttggtcaagtcctcgatctattagtatcaataagctacatatttttataggaagctctatatttttatctattcttttataaacatcatctgataagtttttaacattattatatatttttgtgtttaaattaattatttcatctgattttttattatttattactaatgatatttcttcatttatagattctatagaactttttataatacttttagattgcttttgtagcttatttttatttactaacatttgtaatgccattattgataatccacaaactgcaaatgccaataatctagttggtaattcgtttatacttataggtgtatataacataaataaatacgctagtgtaaaagctatatatgtaggttttttagtattgtatgtaaattcatatagtacaaagaatataacaataaaggttattataagccctagtaatgaatttattgatgctatatatgaaaaaattcctattcctacttcaattcctacaaaatagattgtgttttttattggatttatcgtgtaatctgttcctagtaaagatagtgctgctgtaactcctactaccccaactaatgtgttttcatctccaaatatagatttaaatgctattattatagaaactatgactaaaaacattatggttgtaggtattatttttttcttgtccataataaaatctcctttaatattttgttaaattccaatattaaatttcataccactttcatagttttttaaacttaagtaaagtaataccttaaattttgtatataataataaaaaaggagtaacttttcgttactcctttttatcataaattattattttttctttttagattttattttcttaaaagctcctacaccagctacacatccagctcctaaaactccaaaacctattactgaatcttttttgctttgttttttaccttcatcgtattttgcttgtatttcagattttattggttcaaactttttatcaatgtttaattctttattttcatgaccttggtcaaaacttgcttgtaaaatatcatttctatcttcattaccttttttgtaaccttcttcataactagatttatatgctgattctatattattattaggtttatttaataaaccatcattatatcctttagttttatattcttcgtttttaaattgtgtatatttttcttcataagcttttttataagcatctatgtaaatagaatctgtattttcttcgaattttctgtcttttttattttcttcacaatcttttattgcaagattagtatattgtttgattttgttttctttgtattcttcgtttccttttgcaaagttttcttcatatgattttactactgtttcttgtttgtatatattatcatgcttgttttcttttccgtctttgtatcctttttcttgtgcttgttgtatttcttgttctattttaagtttacctttttcaaaggcgtaattataagcttgtctatattctgattcatagctaccagagtagttatattcattgttgtttttcatattatatccatcactataacctgcatttgagcctttttctattatactttgttttgatggtccactaggtactgactttttttgtgaagcgcttgaactttgagaagtacttgagctttgatttgatgaagatgaacttgtatttcctccttgatatggacagccgttagtgtgtagatgtgctggatgtcctccacaatgatagtgatatggtcctaatcctgacctatttttgttgtctctatgacctccagatgagtctgttcttcctggatgtgcatctactattagtgcttgagaacatatcataagtgctgatgcaaatattataaatctttttttcatgtgttgctaaatcctttcttgttttttgcctcaatcattttaccattttttggttagaaatttaagtatttttattctgcatttttcgacatttagttagttttattttttataaaaaaagagtagcttatgctactctttatctgtgttttaggtaaactaagtgtttttctattttttcattgttttttattgttacttcgtattcattgtagtgtgcgttgtgtggttttgtgtacttgcattctaatacattttcgttgtcttctagttgtagtagttctgtgtcttttagaaattttctgtttattaatctcattaattcttccaatttaatcccccttagtaaaaaatataaatatactttgctaaatattaaaaagaaagtatcttaaaataactttaagatactccctttttatattatttatattaagtttaattgtatttgctaatatttctttaacttaaaaatagctttacttttgccaactaattcctttttatgattataaactcttagattatgttcatcatcaaaataatctaaatcttcactaggtataacacctaactggtgtagtagttcaataagtacaacatttctcataggtgataatccatcatgagttttaatagcaaagcctattcccttatcaggtatagctcctccaaaatatccatttgctcctgattttacaactaccttatttggatactttttcattactttaaaatctattctatctgaacctgaagcatatactggattattcataacagcattaacaactctagttactgcttctctatacttttcatcaagactagaaggctcgcccatacgtgccattccatatgcaaacttatttaaaggtagggcatgaacaggaacaccacatccatcaagccctatacctatatcatttggattataatcacaaagctttcctatcatttctataattcgcttttgatgtggatgatcagctttataatatgtacttaaatcttcattaagatactttactgttgctaacataccagcatgctttccactacaattattatgaactgctagtggtttttcacctttttccttcataatttgtgctacatcttctttaaaaggataatgctctccacattgtagataatcttcatttagatttattttatccaaaatatctctaactgtatcaacatgaatttgctcccctgaatgtgatgcacaaatttgtgctatttctttatcatttattttatactcatctactgcaccataaaaaatcggaactactgcctgcattaatttagcagatgaacgtgcatatgctatttcatatggatctcctactgaataaagtaatttcccctttgagtctacaacagcaatagaacctgttgtaacaagatcaactaaatccccacgatatgtatttactaaaacttccataatctctctcctttttatatctgattacataattctaattcttctttttcttcagtgtatcttgccatacctattcctgtaatcccacaaagtagtgaaaatataggacataagtaacataaaaatgcgtaaggtgcatactctgcaaaagaaatattaagagtactcattataaacactgctgtaactccccaaggaataattgttactccaatagtcccacagtcttcacatattctagaaacattttctggtttaagaccttttaacttaaataaatctagcatagtagattgaaccattatagctgaaaaacaatgtgaacctgtaagccctatagataaataacttattcccatagcgcttgcaactaatccagcagttgatttaatcttttgtgcaaactttgaaacaagtacatttattattcctatctcttttatcattccaccaatccctgttgtaaatataacagcttgaactgtactattcatactattcataccaccgcgatttaaaagtgttgataaaaattctaatttaaattctttttcaaatcctttataaaaactatcaaaaactaaggtatgttcaaagccttgataaaatattgctactaatattcctaatataacaccagctaaaattgattgtgctggagacttcttttttaacaacattataataactacaaccataggtaaaagtgttacaatacctaatttaaagttatctgctaaacctagtgaaatttgttctattaaagtaaaatctgctgttccagataccttaaaccctaagaaaagaaaaattatagcagatactataagtgatggtattgttgtataaagcatatgctttacatgtgttaatacattcacattcattactccagctgcaaagttagttgtatctgaaagaggtgaaagtttatctccaaaccaagctccactaataattgcacctgctgtcattcctgctggtattccaagtcctgtcccaactccaagaagtgcaacaccaacagttcccatagtaccccatgaagtacctgtaaacatagaaactatagcacataaaaaaagtgatgttactagaaagtactttgcatttattattttaattccataatatataattgttggaactgtccctgatgcaatccaaactcctattaatgctccaacagctaacattataactactgcttgcaaactatttcttacagtatctaatgctttagtttctagctcttgatatgtatatcctaactttagagcaaaaacatttataagtatccacgctaaaaacatcgtaacatttagatgaactcctaaaacggtaacccccaaaaccataaatgttgctaagctaagtagcgtaaacaatgaataagcaaaagtcggtatctgtttttctctcataattctcaatctccccttaaaaattattattatctactttattaaagtcacaacctttacttattttggttgttaacttataataattatacttatttttattttttaagaagtataattttaaagtatttactttaattatatcacctatgaaaatgtttttaaaggaaatactttgaattttcaaaaaataaaatcaatatcaaatatttaggagttaatatatttaaaatgaatattatagaaattataaaaagtaattatagttctttaacgactaaacaaaaaaatgtggccgactatttaatacataagccatctgatatatgttatatttcactcgctacattgagtaaaaaaataggttgttctgaagttactatattaaagttttgtaaaaagataggaattgatagtttcattgatttaaaagaagagtttagaaattataatcaaattctagttaataagcactctgtttcttcatattcagttccatctgaaataacagataataactctaagatagattatctaaaaaatatttgtaacgaagaactagataaaatgattaatttttataactcagttgatttagaaggtatactatctatagctcaacttatatataaaaagcacataatatacttgtttgcacatgatgcttctaagacactagcttcttttcttaaggtaaggcttgatgttttaaatttaaatgttgtattagttgatttatctgatatgaaggaagttgagtatataatgaagcaaatcactaaagatgatgtttctatatttttaagttttcctaattattatttttccattaaaagtgttgctgaaaatattagaaataatgattgtgagattgttttacttacagatagtttaaattgtcctgtttctgattgtacagataatattttaatgtgtaatactaggacaaagatattttataattcatggctattacctattgctttgataaatattcttacatcaaatttggctatgttaattgaagataatagtgatttttaataaaatatgaataggagatgaagatgaaatatatggaacctacaaacatactagataaaatttctgatggaaaattatatgatattgaagatatagtaaaagcagacacatgtggttgtgatggatgtaatgattgttgcttagatgttggagacctagtggttcttacaccttttgatgtatatgaaatagtaaattttttaggcgttaaatttgatgatttattaggagataagattgaacttatacaaaataataaaatttcactaccatatttaaagatgcaagataataataaatgtagttttttaaatgaaagcggtagatgcataatccattctagacgaccaaatatttgtcgtatgtttcctcttggaagagtgtaccaagataatgattttaaatactttttacaaataggcaattgtcctaaagaggatttaaaagatgtcaaggtcagcgattggatcggaattgaaaactataatgaaaataaaagatttattttagagtggtataaacttactaaggcattagcttttcgtttaaagtttgtgagagatgaaaaagaaattgaggaaattaatcaaattctattagatagctgttaccatattaatgtagaagaaggagagaatttttattctgtatttctacagtgtttacctgatataaaaaagagattaggaattatttaaattttaaaaacccctaggtcgtaaaattcgacttaggggtttttctctaatatttcatcttatcaggtattactcctcttaccccacctttgggatattttgtatctccaatgtatcttggtattaggtgaacatgaacatgcattacagtttgtcctgatacttcaccacagtttactcctacgttgtagccgtctggtgagtatttttcatctagtaattttttcccttcatccacaagattaaatatagcttctctttcttctttcgttatgtcaaagaagtcttttacatgacgttttgggataaaaagcatatgccctttgtttactggaaatttatcaaatatagcataagctagttcattttctaagatgtaatctttcatatcacaaaatatacaattcataaattactcctttcttacccctacctcgtaaaacacgagagggttgtatatggtatagtgtttcactataccctataaatcattattttctctatttataaactcttattaaattctatatctatataataaatattttaatttaaatataccatattggcaaaatattcttctatatttattttcatcttttgagctttatatctgtaacttgaataactcttaaaaggtaatttacaaatattaactatatcctcccataaatatatttctatattattattttctttaaataagttaaatttatcttattgattacttttatccattctatcatagcttataccttttatttctacatatctattttcatctacaatataaaaatcaggaagatacctttttccattatctaacttaaaacactttggtccatattcaaaatcaacactattttttattaaataatttgtaaatataacttcataacttgacctacaatacaccttctcattgttttttatatagtaccatctatctttattatgattaatacaagaacaactcttacaattcctcgtgacttaaaatcccagttagaaattatcgctaaaaatgatcatagaagtttaaataatcttattataaatatactttacaattatattgatgatacagcctattgtttagataaaaaaaagagtaacttttagttactcctttttttatccattaatcaatatgtttgttatttattaacatattaataatcttttcttgtcttttttctaaaatatttttattccactctaagttattatctataaaaatcttactacctttaaatgcatctactctaccttttaggtatttttcttttttatctttataatttaaattactcaaacttgaattctttctcttacttattagaactaagttagctagtttatgtgtccattcctctctttcttcatctgtaaatatttttctccattcactatttacatttggattctgaggtagaacatgctcaacactaatatttgtatatccagataaatgtacagtattatctgacattaagtattccaacttaagcaatacatatttattaaatcttcttttgtatatatccccttcaatcatattcttgtatgctctttcatcaatattaaaaacttcactattttcaataaattcatttaagctattactgtctatcttctctatttctttcattatcttattcatattttctgttcttgtagtaggacttacttgtgcaattaagtctcccgcaaacttatactctaactttattaaaaaatcatctaatctattaagcttaaatttatcataatagtacattattactggaatccaatcctctgactgaagccctattttcataatagttataagatttttatactcatttgtcaattgtttattctctaattctattatctcatcataaatttcatcatacttactcagtaagtctatagtatcttttcctttttttaatttgcctttttcatatatatttttttcaaactcatctaataagtttgcattagctttttgctttactaatatatttcttataaaaactaaaaatctatcgaaattattcccatactttccttctatatcttcccagactttagaatatttctttaagtcatttttatcatttatttctcctatattgatagattttagtatatcagcacttgtaagtggtattcctctatcatttaatatagtaaacattctaaatgcatcttcggtattatctgtagaaacatatataaataatgctttatttagtaagaatgctacaaactcgtctagtctttctttatcttttaataaattatttataataagaattccattagacatattagatattgatgtgttatcatagtttgatttttctctaagatcttcttctctttgcgttccattatctcttattataaattcatctataaaacttcctacattatcccttatacagtaagttaatctacttcttgatggaatctttttaagtttattttctttttgataaatcatctctttcattgtagatttgtaatcttcttctatcaataagtctcttaatactgctatcatcataaagaaagtagttaatctttgttgtccatctaaaacttcatattcattaaattcactattctctgttttctttaatactaaagatcctaaaaaataatcattgtcttctttattttcaaatgcataatatagatcctctattaactcctctatattatccttttgccaaacgtatggtctttgatattctggtactacaaaccaaaaatcttcagaaaaaatcttttgtaatatccttttatctgcttcaatagttccattgctcatattaaatgcccccatgatagtttactttatatttattttaccatattatgactttaaattattaatatttcattttatctggtataactcctcttactccacctttaggacaatttgtatctcctatgtatcttggtatcaagtgaacatgcacatgcattactgtttgtcttgatgctcctccacagttaactcctatattatagccatctggtgagtatttttcatctagtaattttttaccttcatctacaagagaaaatatagcttctctttcttctttcgttatatcaaaaaagtcttttacatgtcttttaggaataaaaagcatatgccctttgtttactggaaatttatcaaatatagcataagctaaatcattttctaaaatataatcttccatataacaaaaaatacagttttgtgaatttgaaagtttccaaactccccaagaaggattttcaaataattcttcacctttaaatttttcatgctccttgcatccattttgaagtgtatgtgcaacaacatgagatgtataagctaatccttcttcgattaaaattttagaaatttctccaaacttcatacattggttagattctaatagttctacaattcttttttttatctcttctctttcttcttctgtatatctcataatattatcctttctaacttttactacccctacctcgtgaaacacgaagtagggtacaaaaattaaatttcatatctatataataaatatttcaattcaaatataccatagttgactattttttaataatatggcaatcatttctaaaaataagccttttgtgagtttacctcacaatataacctttctaaatattttagaatacactcatacatcaatgtgaaaggattagcttttatgaaaaaaagaaatttaataggaacaaacttaaaaaatattagaagacataacaatctttcacaggagcaacttatagctcaattaaatttacttggactcgatttagatcgtacttctttatcaagaatagaaaatcacaatagagaagtttatgattacgagcttgtgtatttttcaaaagctttaaaagttagcattttagatttatacaaagatattgaaatttaacttaaatgctctctgcagtagtgagcattttttatattcctaattaagaggtgatattttgaatcaatttataatagatcaacctaccctggattcttactttagaggtatagtattatttggtaaaaactcagctacatataagtttgctcttggtaaagcaataatagagcttgcttctaatggaactgactttattcctttaagggatttggctattccatttataaagtatactaatgagcatgttttaaatggtaataagcaaataacttcaaattctagtaagtactttgatgcttttaaaaagtataattcaaaggattgtgatattgatgaacttgtaaaactaactcttagtaatccatttcaaaatgttattgatagatttcataatgtaaatggaactgaggtagatactaagttttatgaggtgacaactcgtgataaggttaagggaattgttttgactgataatttatataagattaatgaaaatagttcacttgataatttatttattgaaacagaagctagatggaatttagttgaaaatgcttggtctttaagtattaatccagctcttttaaatgtttcttttgataatattgataattcattgtttattactgataataaacttggtagacggattgatataacttcttgtagagatgctttaaatggttaccaaagaggtaagtgtttttattgtggtgctcctattagtgttgatcctaatagtgataatttgtgtgatgttgatcattttatacctcatacttttcaacaaagtgttgatgaggatattaatattaatggtgtttggaatcttgttttaagttgtaagagttgtaatagaggtgaaaatggtaagtttgcaaagcttgctgatcctgatccttatttaaagaaactttatgataggaatgagtattttataggtagtcatcatccacttagggagactcttattaatcagactggtaaaagtagtgaaaataggcgtaaatatttaaatgatagatataatttggctttaggtacgttgttggttacttggagaccatctattgtttttgaataattttgtttggaggtgtttttatgaagatttatgataagttggttagggatagaattcctgagattatagaagctagtgggaataagtgtgagatagaggttgttagcgatgaggtagcgctagagtatctttataagaagcttaatgaggaagttggtgagcttttagaggataaaaatcttgatgagattgctgatgttatggaagttctttttgctattggatctaagtatggttatagtgaggatgaggttttaggtagaaggaatgagaagaaagatactcgtggcgggtttgggagtaatttggtattaaagaaaacttattaataatcatcaataaaataagtgatgtataaaattatttatacatcacttattttaatattactctgatttattttgttcattaataattttaataacatctttttttgcttcttttaatctatttccataaacatagcttttcattacactcttcatatcagctaaaatacatacaaccttcttattatcatatacactatccatcttagcatttcctgcaaattcaaatttatttgcagtattagatctatatggtaatataaaagcatcatatgactctcttcctgtccttaagtttatatattcagaataaagcatttgtttatttatatcagaactttgaggtaaatgttttattaatttcgttataccatatttatagtacttagcatctataacataggtttttccatcattatttaagataatatccggtcttaagttgcttgcatcactttcttttccatcgatttcccaaatagctttaggataatatttgcttggatcgtcatttcctaatacatcatttaacatgtcctcccaaatattcataaaatacttggttttgtattctttaaatgattttatatctttttcatctccatcattttctaaaaagtttatcatatgaataagaagcctttttgttttatctacatttactgttcttaactctttttttaataagcttatgcatacagagtgtgtgtaaggcaatttattaggtccttctattctaatatttggatataaccatcctatgatatctacacatttttcaacaatatacttttgaataagcaatattatattattgatatcattatttttttccttaacaataaaatctaaatacactagatcattatcacttatatatggtgtactagattttatagttctcgcccaatttatatttccttttttatcactcttatatctatgtatatattctttatacaatccattaatttcatagtcatttagaagccaaatagcattggtcattgagaaattattgccttttccagtagttaaatctctctcatcctctgagcatgatttggcctttttacttttaatatatttatcaaatgctttaattaaaattaaaacatcttcttttatatctttatcatcagaagaaagtttataacctcttggaaaaataacctttaaatttcctttatcaaatgatatccctacatattctaagtcaccattttcctccaaatcaatatgacaaaactcttttaagctatgcattagcatcttcctcttctttttcatcagtagttgttttcactacatgtttctgcatctcttctcttagttctatattaaatatatctatactatcttcgcttgaaaacttattaattaattgagagaaagtccttatttctttatcaaatattttttctttatccattttaaatacgtcatcccataagtataataatactttatatccaaatttgctacagtcattcaattcatcagctttaataaaatatggtcctatttgcttatcctctgatatcatcatactgctattttctttagacatcatatatgtatttatagtatttacaaaatttccccatctaatatttaagttagctatagtattatttttaaatggatgatcatcatcaaatttaactggtaaatattcaaattcccatcttcttttgaatgctgtatccataacaaatacattttgatctgctgtattcatagttgctattatatttaaattatttggaatatatattgagccatctttatatttataatttactttaagtatctcatccttagttatatatttaaatatatctggattatttactctatactcacttgttccatcagtttttctatctaaaagttggaataagtctccaaatacagctgccgtattcgctctattcaattcctctattataagtgaatacatattatttggatcttttaaagcttctactaatatttctgtaaatgtacctggtacaaattcatatactaagtttccattatccttaaccataggtcttatatatccaacaaaatcattgtatgtgtattctggatggaatgtaactcttttagcatatttattataatatgtatcattaacatacttactttttcctgtaccaggagctccaaaataaattttattaactccctttaggtctttgttaccctcaagcactgagtcaagttcttctacagcttcttctactatttcttcataatatctagcaaatgatttcggatttgaagatccaactatttcttctattaattgtttatcttcttcaatatcatgttttaaaagcataacatagttcattaaatcattatcatcatttaagtatttaaaaaatattaaaatatcatttggatacatttgttcccttaactcataaaatatctctccatcagattctctttttgacaagcctatttggtctccacttgattttggaaatttccaaatagtacatttggatggtatgaattttccttcactttctctatttatatataatgtttctacataaacatcaaaagtactatcactgttaagtcctctattaaatgctatctctcctaatattgagtagaaaaaatgcattgattgtgttgtacaagctatatgacttgtatttgatgcccccagtggtttattagagttaattacatctgccactggtaatttttttataaatatagctttaatattttctttgttaaagctatcattatatttacgagatataatgtctcttactaagtcaaaacctgctttagttgaatggttattatttaatatcatttttatcacgctcccctaacttattatataccaaaatatggattagataaaaataaaattttaagataaatataaatatatttagcaatgttttgtcttttaatatgaatttttagacaagatataaaaataataagtattctaaaagactttagtaaagttttagtattaatttaaaataagttctttcacactctgcttttaaattattcaaaatgtgaaaaaactcattaaatatattttttaaattttatctatcgcaattaaatccattatatctatttgttcatatatttcttcatctttattttttttacaatttaaattaacatttctaaatttataactttttccattaagaatatttggataactttttattatactctccattaaatttattagaacatctacgactatagagtttcctgcctgcttatacatctgagtatctgatactacttgcttaaatgtatcatcatatcccattaatcttaaacattctctaggcgttaatcttctaacttttccatcttgagtgacataattatcaactcctgctctgtgcattttatgcatagtagacaataatggcctagctacttctaagtctatctccggctttatatagtaaccttttgtaccagtagacattacatgttttagtactttttctgaaaggaagtgtttttcatctatttcacctttttcattactaagctttatatctccatctatagattcatatcctccatactttacatttgtttccaaaaagtcttgcatcgtgtattttaactcttgctcagttggaaattcgaattcttttacatcttctttaaatcctactacaaatactcttcttctagtttgaggtattccataatcttttgcatctaataatttataatatattttatatcctagagataaaaacgtatcatgaataactttccatgtattcccaccatcatgtttaagcataccttgcacattttcataaatgaatacttttggctctatttcttttactaatcttgcaaagtcataaaataatgttcctctagtatcttctaaacctctttgatgacccattatagagaaactttggcatggacttcctccaacaaataaatctacctgtcctttgtatttcgtaccatctataaatctaacatcatataaaaaatctttatcatctaattcgtaatttgctaaatatgtctgcttgacaaaattagttttacgccttgattcataaatttttcttatatactcattttgttcatccacagtttcaaaatttttaatttcttctcttagattttcttcatcttctatttcaacttctatatctccgttgtcacaagcaaatactatattatggtctatattcattctttttaaagcccactctattgctcctataccactaaatacagttgctacactcatactttttttcagattatcttcttcaaatacacctgtttttgatacttctttaaatatttcctctagcacattaacgactatagagtttccgcactgtctatacatttgttgatctggtactactattttaaaatcatcatcatatcccattagccttaaacactctcttggagtaagctttctagctacaccttctactccattaaactctcctacataaactctttcatcttcttttgcccactgttctagctctataggtctaaatatcatatctccgcaccaattaaattgttgattcgctgcttgagttctagatatatccgcatttatactaactcttttctttaaacttttttccatagtaatccatttaaaccctttttcaccgtggaaatattttttatcaatctcttcttctaaataatcttttactactttttctaatggcattttattaggaaatttaaaattatttatatttaagtcttgtctaaaaccaacaataaatagccttgttctgttttgtggtataccataatcttttgcatttatcatttccattctccagttataccctaagctatcaaatatctctgatatagttttaaatgtatttcctttatcatggcttaacattcctggaacattttcgtatataaatacttttggttgtatttcttttactaatcttgcatagtcataaaataatgttcctctagcatcatccaatcctgctctacgaccacttatagaaaaactttgacacggacttcctcccacaaataaatctactttgcctttataaaaatttccatctaaaaatcttacatcttgataaaaatcttcgggactaatttcataattagcagtataactttcctgcacaaaattccttttaccagttctgctatacatatcatctatatatctttttgtttgataatgatctaatcccttcacctctttttctatctcttcgtactcttgctttaaatatctttccccgttatcacatgcaaatactacttcatgaggtatttttaatcgttttagcgcccattcaatcgagccaattccactaaatactgttgctaattttatcatattgtctctcctatattttaatttaatgaattaattatatcacaatctcttatatccggcaaatatccggtgttttcattttattttaataatttattttaaatttgatcttaataagttttatttttacggaaaaatgcatagacttttttctaaaagttagctgtggaatagtattttgttaaactaaaactgaatcgaaaaattttaataaaaacatacatattttttattggaataaataacattaagtgagaaaagcttgtgtaaggtacttcattaaaaagaatatcgaagttatgtatatcatcactattaaggataaaaacaaaatgaatttaaaaaacctactccaaaagaaattttcacaatgctacagattataggcttcgtagaagctgcaagtaaatataaaatttttcccatcgaaagagatttagataaacctaaacagttggatgagaaataatatatttttcaaatactacattgtcacacttcatacctactatgataatatttcctaaacaataaattctaggaggtaaccatatgaaatggtatttagacttcggtcatggtggcaaagatcctggtgctttaggatctaataacacaaaagaaagcgacacagtattaaaaattggtatgttagtaaagtccaaacttgaaaaacactcagaaaaagtaataactactcgtgaatcagacttatattattccttagaacagagaaccaataaagctaacaaagaatcttgtgactacttcattagcatccacatgaactcatctaccaataaaaatgcaaaaggaacagaaacttgggtatatgactcaaacagtaaattatataatttggctcaaaacctctcatcaaatttatcaactaacctaaaaacccctaatcgtaaggtaaaagaatctaaaaaattcttcgtacttaaaaatactaaaatgccagcactaattatagaaatagactttatatctaacccagaaatagaaagcctatgtgttaatgaatcttatataaaaaatgtagctgatacaatagcttctacactactttcatttataggaaaagatgactatttagtaacagacgatacagaaagttcgaatttttataaagtatgtataggtgcctttaaggataaaaacaatgccattcgccttaaaaatgaagctatttcaaaaggctttaaagatacctatataatttaatcaaataactccttaaaatattttttcaaatactttctttgaaggctcaaacacctatcccctataattatcttaacaatacaaaaggaggtgaaacacatggctgttagtgaaactaaaaatccatctgctttaaaaataaagctagattgtgggcttaatgatgatggtaaaactattgtaaaatctaaaacttactctaacttaaaatcagatacatcagctcaagatacattagatgttgcaagagctattttatctttacaagttcatgatgaacttgagataaataagcaagataatactatcttgaattagttatctaataaatttatgtgaaaggaggtgttttcatggaaactacaaagaaattagtaatgtcttttaaaagtactttagagagagttgtttctatatcagttgatgatcctagggaagatgtaactgaagctgagataaaaacagttatggatatgatagttgaaaagaatatatttgctcctaatggagctgatatagtagaaactgttgaagctaagatagttgtaacagatactactgaatatgacttagttgtctaatcttaaaggagggtgtttattcatcctccttttatcatatcttgaaaggaggtattttttatgaattcagaaatccaaacactaattgctaatgttggctttcctattgctattagtatgtatttacttattcgcatagaagctaagctgcagactcttagtgatagtattaatgagttaagtaaaaatattaatgttatgagtgttaaatagtaaatcatgaatataatcccgataaatacaaattaaaattatactattttttaagaggacaggtcccccctgttcttttttatccatacatctatcacacttatagctttgtgttttcctcaaggaactttctaacctcataaatctcttcctctgttggctttctatacaaaccttgctcctatttatcaacacttctcttatagtatccattgctttaaaatcccattaacataacccatattacatgatccattatttgtagcaatttctatagctcttttaaataatctaacatctatcgtttcactaacttcaactaaccaatcacgagaaataccattaataagacctatattttcttcaaaaattttagcataatcacctatattattttttacatacatacctacagtatttttttcatcttattctttttctttttgtttttctttttgtttttctttttatttttatttttctttttctttttctttttccccatagtggtccttcaaattagaatcaactacaggtatgggtatagatacactatctatagttgtatcaaaatttaaacttcagtatctatactgtatccatacatatcacaaatagtatcttcacaataaacaatctttacatactcctcaaatcttaaaataaaaaggttataccttagaagaaatggcaaaggatttaaataccactaaggttatactttctagctatgaaaatggtaccagagagcctaaaagcgagactcttatccaactatcagattattttaatgtatcaatagattatttatttggaatgtaaaaaaggcaattgaagaaataaaagatgaacttgaaaatagtaattctttaatgtttgaaggggaatgtttaagtgaataattttattttgggtatttaaaaggtgtctagtatttagacacctttagtttgtttatctattatatttcttatttgggattggcttatattgtatcttctagctaaagccttgtagtctccatcaaaagcttcttttattattttgtttctaataggtcttgttttttttattataaatttaatataaatttactaattataattaacttatagtaaattatatctttgtaataattcttcaattacagttcctgaaatttccttcttaactatatctaatttaattttatctaataatggtaacttaatatcttttaattttttcccatctagcatcttagaagttgaatcaagcaacaccctaatatcataacaagaattaaatacctcaggaactccacggtcaacatcaagtaatgtatatacagcctccatagcagttcttacagaatactctgttgtaaatacagtatcacgaacagtatctgcaaattgaccaataaatgcaaagttaacagctttatctggtactacttttggtctatctccagctgttcttggcataaagaatgaagtaatgtatggcatcatgcaaggaatacaatgagcagaattttttgccatctcaggaatttcatctactggaactcctaaatgatatagccattcttgagtaatttcataacctgtacactctttcattggtttttttatgaaatctccatctacatcagtaaataatccataaacccatacaacaagctcattatctggttgagctttaaaatgtggttgtctatttaaagtataactcattagccaagatgaatctttaactgtgacaattcctcctgtaacaacttttccactaaatggattacgtttacatactttttctatatatggtggaattttattatctaaagtagttatagtagcagattcccaattagttttatttatatcagtacagaatttatcaggtctaccaaaagaagaatcttgtgcggctatgtttttccaaagtctccagcaccctccttcagtagtatttaaaactggtgcatgattatcatcacctaaagatgagttttctgtgcaactaccatttgtaataaatactaagtcatcttctactaaatcaatagtttcttcttttccatctttaatgcaaacaatttgttttgctatctttttatcttttgttatttcaaatttcacattggtaacagttgtattatattgaaaatgaactccattagattctaggtatttaaccattggtaaaattaatgattcatattgattatattttgtaaattttaaagctgtaaaatcaggaagtccaccaatatgatgaataaatctttgaatatatcttctcatttcaagagcactatgccactcttcaaaggcaaacatggttctccaatatagccaaaagtttgattcataaaattcttttgtaaatacatcttcaatttttttatcatataagtcttcttcttttgccataaataattttattatttccatagatgctttttctgttaatccaaattttccatctgtgtgagcatcttctccacggttaactgtagccctcattaaagaataatttgggtcttttttatttaaccaataaaattcatctaatacagaaactccttcagtttctattgaaggtattgatctaaataaatcccataagcattcaaagtgattttccatttcacgtccaccacgaataataaatcctttctcaggatcattaattccgtcacaagcaccacctgctatatccatttcttctaatatatgaatatgttcgcctttcatttgtccatcacgaactaaaaaacatgcagcagctaaagatgctaaaccagctccaactaaatatgctgattttctatccacaccttcaggtttttgtggacgtgcaaatgcttcgtaattcccattactataatacatataaaatcatcccctatactttaaagcttatttatgataaaagctttagtaatttatttattaatataatattcccatttaaggttttattatatagacaatattaaggctttgtaaaaattttaaacataactataaatctgtaaaaaaattagacaaataataatatttgtctagtttatattttatatttatttttgtactaatcccatttatctgttctgtatcgctctaaagcctcttctatatttccacaaatcaatgtattcaaccgtctaataatatctttaggattttctttcattccttttttaatccattcaaggacaaggcctacaaatgcatacttataaaaatctgcaataaattctttatctttttccctaactgccatatcttttgccttttcttctactactcccataagaagtagctgtacttcattatataagtaacgttctagatgttctctacttacagagttgaatgtatttaatacaaaagatttattctctagtatgtagtcaaatatatgttcaaatccctgttgccaagtattatatgtctttttcccatctaaagctcttgttgcttcatatgtgtaaacccaatctaataaatcgtaaatatccttgaaatgataataaaatgtctgcctatttactccacaatcttctgttatatctattacttttattttttccaatgatttttgtgctaacatttttttcaaagatgcagcaaatgattttttagtcatttgagacatatgtatcccctccattattttaaacttataaaatttctatttatacattctccttatcaaatatttcttacacttttattatttttcattagaatatatagttccaccaattaatttttcttctttttctaaataagctccaaattttggatttattgctttgaaaaatagatttataaaatttaataatacaaagaatactacatatgttgctataaatatttctatatttcctaataattcaaatacatttcctattattttataacctatttttccaaaatatgttgataatttaaaagctgctaatgttgcaattgctaatgggaatgtaaatgctgcatatgttggtttaaatccttctttgaaaagttttagtatatatccgtatacaactactaaaagtattaatccagttattattaaccaagttagcatatatatatttggatttggatctatagttaatatcccaactattccaagtggagctggtgagcaaattataccaacagtaggtaattttttatcatctagtatctcacttttaaatactatataaagaactactggtaatagtaatgtgtaaaatataaatccaaacataagcataaagtttgctattggtggaattattcctcccattcctttacttgccacacttcctgttatcatacctgtatatatgataaaacaagttggcattatattattaaagttcttttctttaattcttattattgtataatatactacaatagcataatgatatactactgctcctaaccataaagcactacatacagttggaaattgtggatagaaaaatccagaaactaaccaagttaccatacccatagttggataaaatgttcctgtaactggatctcttaattcttttaacattacttttggaaatcttataactctcattagcattaatgaaagcattattattgctatagttattgcaattggttttagataaccgatatctttaattaaccagcaattactaagtgttataaatgctaaacatgtgccacttattcctatgtgtaaattttcaagcttatctaaatatctagtcatactaaccaccctctaatttgttattgatctatttttaatatttatttaaatattttttatatttatctatgctgctataaggtaaaattcttccatagctcctaatttaattaattccctctataaatcactttaaaacagttcatatttaaaatatttttcaaatactttctttgaagggttggcttcgggataagtagttagagttgtttcattcacacaaagaccaaagagcggtctttaagtgtttcttcaacaatctctaactacttccccttcgccttttgtgttctactttttttggagattgtaagagatgaggtatttttatgaattcttaaatctaaatactaatatcaataggaaagcttcagactttatcttatagtattaatgaacttagtaaaaatgagagttaaataaaaagttatttatataatcactaataaaaaaagacaggctttcgtaacctgtcttttttatatgttaattaaacaatatattatttaattaactattttttcttaaattccttattatctaaaataataactcctgagttatcttcctttgctaccttttttgtgtgatttacaagttctacaatgtccttgtatgattgttttgctccctttacaagcaatggtactcctataaaatcaatttttaaccacctagaaaataatccaccaaaagtcattggtaatggaaccgttggggatgtatttgaaaatataattttttcatttaataccttttgtttatgaagcatagatgctaagttatataaccctggaattaaaacctttgaacgtccccttcccacagtatatacttcgtttccatctttatctcttccatgataaaaaagttctccacgatttccatatactaacttattaaagttaggtaaattcaatatttcatccttagtcggttctcgatttgcatcaagtatttctaagtgataagcacttgctaaaatagatgagtgagttcctccataacaattgtatatgtatatcattaaaatcacctaatttcttatttttgctttattttaataattgtagtatatacattaatcattggagttaaacaacatcttatactaatatttaaaatctaaaagcttattttttaattgattttcaatatttcttaattctgcttcagcttccatacgtttttgacgtccttgtgtttgtatattaagtatttcatcaagagttgaaattaacgactcattagtagctttaagtgtttcaatatcaacaattcctctttcagactcttttgcagtttctatagttgaagtttttaatatttctgcatttttacgtaaaagttcatttgtcatatctgttacttctctttgaacttttgcagcattagcagcatgagcaactccaagtgctaaaaccatttggtttttccaaagtggaatagtatttataattgtagattgtattttttcagacattaatgaatcattattttgaattaaacgaatttgaggagccatttgtaaagaaatcattttagttaattctaaatcgtgaattttcttttcaaatctattacaaagagccacaaaatcatttaattcttgagcatcctgaggattaccactgtttcttgctttttcttgtaatttaggaagttcttccttttctaatttttgaagtttctttttcccagctaatatatacatagaaagctctttaaaatatactttatttatttcatacattttatctagcatggcaatatcttttaaaagctgtatttgatgcgattcaagaatgttacacattttaccaatattattttctacattctcatattttattttcatttgggaaatcttatccttcccttttttaaagaaacctaaaatcccttttttctcttcggattcttcaaagttctttaattcataaactacactagatagtacttccccaatttcacctaaatctttagtttttacattattaagtgctgactgtgaaaaatcagaaattttcttttgagcacctaccccatattgtaaaatagaatttgaattatttatatctattttatctacaaattgatcaaccatctttttttcttcttctgtaagttggatttcatcaattattttttcttctttcttttcttcttttactcctaaatcaagaacttcctcttgaaatggttgaaaagttaattctggttttatatcaatagacccttctttaaattcatcactcattcttttatgcctcccttttatctaaaacttactttttaaaatcattttctgctagtccctcttgtttaaataatgttttaagaacagaaatatctgtagaaatatctaaaacaacatcttcaaataaatcatctaataaattttcaaaagcgctattaataaggtcaatactcttttcgatttcaatcttagcattttctatattctcgccttgaactaattgattattcatatctttgtatgaattaattaattttatagtaataggaagataatggtttataaatttattaacttcttgtatcttattagggtttttttcaacctgaataagtatttggtttgaaatatttcctaatttatctaactttatagctatttcttctttataaagctcatttcttatactttttatttgttcaatataatttcttcctattctaatagtagattctacttcatctttttctaaattttctatttcttcatttaacttttcattattattttctttagctatttgttgcttttttaaatttaaatagtcattatagacttcatcatttaacataaaataagttttttcttcatttatatgaccttctaagaacatacctaaatcaatcattttgcttaggtctttaacaacaaaactatctttctctttagcaaattttgctaagtccttaattaagaaataattattgtcctcaataaatcttatatacttcttaaaacgttttactctttttcttaaagttattcctcttagtaataaacctaaacttattacaaataataaaaatgcaactcccaaaataatattgctacctatgataccaaataatagtttaaatattaaaaatataagcgctgaagaagcaaaagttaaacatccaatcgctccaaatattatataaagtattcccgatatacttccagctggttttttactaatatattttgatatatcatttttagcttttttatttaaacgcatatacttttcactatatccattaaactttgatttaaattggtttaaggtatcctcagttttatcgttaatatcttttttcaaattagcaaaatctattgctttaagtgcattgctaactgtagacataatttgatcttctaaattagaaaaatcctttttatccattatcttgcctccagattatttttcttataattaacataagtctatatatactatatcgttattttaatattttaaatctattatatcttataatttagctaattgtaactactaacttaaaaatacacttttagtattaaagtcaaatattatataaaaaatagccctaggcaatctatataaatgcctaaagctaaaagtatcccttactctatagattatatctttaaaattacaataactttgatttactcaccttttctagtatcatccttgctaatgtgttgtactccaataaatataagatttattagttctgttaggtttttccattgtgattcctttgaatcaagataataaaagttttttgttccttctttgcgtacattcacaatttctgcttctttaagtattttaagatgatgagatacagctggtcgtgaaagatgagttttttctgtaatttcccctaccctaattccattaaaatcactttctagtagtgtaagtaaaatcaactgtcttgtttcatcacccatagcagaaattgccttttgacatagtttaaattttgatgttatttcttttaatctttcttcacattctttttccataatatttacctcacacttataagtatcttacattagctgtttctttttgtgcagtacgtctgtatttcacatctggatatccaataactagggttgtaaccacattatcattatgttttaggtttaattctttttttaattttgatgaacgatttcctacacttgtaaaaaatccactatacagtacccctaatccaaaagattctgccattaatgccatatttgatgctgcaagtgagccactaattttatctttagttactaccattattgcaataggtgcctttttgaaaaagaagttatcatcaatttcaacttcttttgcgcttttcataaaaatacttacaattggttttattcttctaaaaaattttactgcagttttttcatacttatctttgttattatctaaaacaatgtatgatacatcttgtgtgtttttagcactaggggtaaatctccccgcttcaataatttgttttataatttcttcagatacttttttatttttaaacttacgaatagttcttcttgatttaattgccattaataattcatctggatttaaagtaggttgttttgaaagttctattggttcttcatcaaatccagttagtgtaatagctcctgttggacatattgctgcacagtgaccacactttatacagtcttgattttttattactgattttttatctttaataattatattatttactgggcaatcatttttgcaaagactacacccaatgcaaaggtctttattaacttcaattatgtgttgttctttcataatatattcatctgcctttcgtttatttgtttaaactattatagcatttaaatattttaaaatttcattgggaaagaatttgtttaccattaaatttttattaataaaaatagttttattatatactcaatttatcttaacacaatatggatttaaaataaaaaaggattaagccatactgacttaatccttttttatatgataattattttaatagagaaatatttgtatcaattacttctggttctcttttaaataagaattcaccttttctaacagaacaattaactccaactctttctaatattgcatcaaattcatcttttgcatttaatactatgaaattagcatccttaccttctgctataccgtatttatcttgtatatgaagagttttggcaccatttactgttattaaatctagtgcattttttatttcttcaaatgacatcatttggcaaatatgaattcctgcatcaagaatattcatcaagtttccatttccaagtggataccaaggatctgaaatagaatcttgtgcaaaacaaacattaataccagcatcatttaattctttaactcttgtaagtcctcttctctttggatatgtgtcgtatcttccttgtaaatgaatattttcagttgggcatgatataaaattaagttttgataatgctagaagtttaaatagtttaaaagtatatgcattattataagaacccatagcacaagcatgacttgctgttgtaagctctcctattccattcatataggcttcagcagctaatagttcaagaaatcttgattgttcatcatctgtttcgtcacagtgaatatcaattaacttgttatatttcatagcaagttctacagttttcttgacagatttttctcccatttctcttgtaaattcaaagtgaggtatagcacctactacatcagcacccattttcaatgcttcttctactaatttatccccatctttatatgaatacattccttcttgaggaaatgctatgatttgtatatcaactaaatcttttacttcttcttttaattccataattgcttttaaacaagtaagttttggatctgttacatctacatgtgttctaagatattgagttccatataaaatctctttttttagtgcaatttttgctctgtcttttatttcatcttttgtcatctttgattttgtctcagaccatctttgaattccttcaaataaagttcctgttccatttgttgcaccatccatacgagctgtatatacataatctaggtgaatatgtgggtctacataaggtggaacaactagatttccttctaaatcataagtctctacatctttatatttttgcgaaagatttggacctatttctttgtattttccattttcaacaagtaaatcaactaatgtttcattcccttttaatctagcatttttaaataattttgctttcattttaataatctcccttctattatttttaatattttcttagttacatccaaagtctaacatgaaaatatacactagtcattgtactaatcatccaataatcttttaatatgactgtgcacataaagaccatatttttatatatttatttgtattttttgcacattgtattataatatttcctgagtatatactaatagtgcaatgaagcttattgaaaataaaaaaagttcattgtataaaagccttgataaaaacttttcaactaaaaaagggggacgttattatgtacgaaaaatttaaaatgagaaacatgacatggcaagaatttgctcagaaaaaagatgatgtaattatattaccaataggtgctacagagcaacatggccctcatctacctacttgtgtagatgctgtattagcagaggaatttgcttttcgtatagctgaaaaaattaatggtgtagttgctccaactctttcatatggatataaatcaaaaccattaagtggtggaggtccattatttccaggaactattgatttaaatggagctacattacaagctttagtaatggatataattgatgagtttgttcgtgatggatttacaaaaatatttatattaagtgctcactttgaaaatgaagcatttattgtggaagctatggacttatgttctgcaaaatacggagacaaagtaaaacttcttcttactaactggtgggatccaatgtcacctgatgtaatagataaagtatttgatgaagtgccattcccaggatgggctctagaacatgctgctgttacagaaacatctttaatgatgtattttgcaccagaacttgttagagaggacaaaatattagatacagaaaatgctactccagcaacttactttagatatcctatacaaaaagatatcgttcctgaaactggaatacttgcatcagctaaatcatcttcagctcaaagaggtaaaataattgtagatgacgttgttccaaatatcgtaaaaatagttgaagaggcatttaagtaaatcatttagaaagagataggtacatttatgaaattaaaaggaatagtactaacaatgctatcctctattacctttggttttgcctttacattagggcctatgacctatggtgctggaggaagtaatcctgtaacattaacttttttaagaaactttttaagtttaccatttttattactaatagttttatttttaaaaattgatttaaaagtaacaaaaagtcaacttaaaaacttgatcatattaggatttgtaggaaatgcaataacaacattaatgctaaatatagcttttgcccatgtagatgtagggatagtaactccaattcactttacttaccctgtatttgtaacacttggatgtgtactattctttaatgaaaagctaagtaagcaaaagattatagcattagttatagctatgtgtggtataggatgtttctttattcaatcattaaattctgcttcttttagttcatctacattacttggattaattttagcagtagcttcaggagcattttatgcattctatattatatttatggataaaagtggtctaaaaggtgaatctccatttaaaataacattctatgtagcaattgcttcaagtataggtatgtttttctatggtatttttactaatgaacttgttttatcttctcttacaactaaatcatggattatatcttcagtatttgcatttttatgtacagttgttgccctatcacttttacaagttggtataaaatatataggagcaagtgaggcagctgttataagtacttttgaacctataacaagtgtaatatttggagtgttattattaggtgaaaaagtaacacctctaaaaattattgcttgtatattaatttttgcaggagtattaatattatcttttgcaaaagaaaatacaaaagatgaaccaccagaaactaatatggaattagaagtttaaaaataaaaaacccctatgtattatcataggtgttttttatttttaagattaataaattcataaattaatatactattaaaaagttctaaatctatcattgcatcatctaaatctatgtttaaaagttccttgattgttgataatctataaatcaatgtatttctatgtataaaaagttcttgagaagtctttaataaatgtctattattttggaaataacattttaaagttcccattaaatccattccatgatttttatcatattctaaaataggacccaagttttcataacaatacctttgaatttctttaatatcagaaagttctactaaccacctaataattcctaattccttatacttaataacttttaagtccttatggtatatatcaatcatagataaagctttaaaagcttctttataacttatttttatatcagaatttgactgtcttatacgactaaaacttaagctattttcaacttctggatatttagaatttacaagattaaaaacagcttctactgcttctattgatttttccccttcattataatcattggtaaatattaaaaacattaagttatttgcgtattccataggaatcaaagttttattttctgtatttatcgcttcttctagtgaatgaattatatgtttgttaatttgttctaaatcataggaaacattggatggcttttgcattttaaatatacatacatagtgaaaaggtcttaattttatattataaaattctgatagagcatgtatatcttcttgtatatgatcttgagaaaaaataattgattctaaaaagcgctttgcattctttttttcttcttgcttttgttctaatttaaataaaatttcttgtgtaatatctattaatttaatattccaaggcattacaattacaggaaaatcctcttcattagccttgtctattacatttttaggtatactgtctatatctttatcatcaattaaaattacaattccagaaagctttttatgaatacattcttctattaatgataaaaaactatcatcatcttgtcttatatctgtgtaaataacaaatatcaactcttcaccataaagccactgtgaaatagactctgtagttcttacgtaaggccaagaaatttcacggtttaatcccttttccccagccagtaattttgcttttgaaaaatttttaagttgaaataaatccctgcaacaaatagccataaaccccattccctctttcttgatttaaaaataactgtcttttaaattatattataaattttaaactgatacaatttataatgttttattattgagattttataagaaaaaatccaattttaaataattgaaattagccttaaaaaatgttatgctatcaaaagaaattaaaaaaatgtcgttactgtatatactatcaattataaaattgagattgattatatattaaagagcttatttttataggctctttttatatcttattaagaatcagacctttaggtcgttggcgacgtgaagtaatttacagacacgtagcttaagcaaaacgaatttttttaaatgataaagagaggtaattatatgataaaaattgacaacttgtcctactcgcttccacaaaaagacctatataataaggtttcatttacattagaagaggggcaacattgtgcttttataggagcaagtggtagcggaaaaagcacacttatagatataataatggatcccgaaaaatatgtatttgatggtaaattagaaatgaatccaaatttaagaattggatatgtaagtcagttctcacaactagacaaactaaaagaaactacagtttttgaatatatagcacaagagtttatcaagctacaagatgaaatagcatctatttgcagtgaaatggaaaactcttctgatattgatactttactagaaaagtaccaagaagctttagatgcatttgatgcaattgatggtgatgattatgaaagcaatattaataagaaactaaatcttgcaaatttaactaaacataaagataaaatgatatctgaacttagtggtggagaatttaaacttattcaagttattaaagaaatgcttaataacccagatttaatgattatggatgagccagatgtgttcttagattttgagaaccttaacgctcttaaagatttaattaattctcataaaaaaacaattttagttattacacacaacagatatttattaaatcattgttttaataaaattatccatcttgaaaatacagaactacaagaatttgatggcagatatattgattacaacttctctcttcttcaaactaaaatcgagttacaagaaatggctattgctgatgaagaagaaattgcgagaaatgaagctttaatcgaaatattaagagaaaaagcaacctataatgctgaagcttctagaggtagagctctaaaagctagagttaaaatccaagaaagattagaagccagaagaattaaagccccatttgtagatattaaacaaccatatatcaatttagaaacaaataatgaaattgaagaaactattgctctaaaggcttgtgatttttctatatcatttgatgaagttcttttagaaaatgttaacttcgagataaaatctactgataaagtagctattgttggtacaaacggtgtaggaaaaactactttattaaaagaaatatttaaaaataataatgaatctatcaaaataaatgaaaatattaagctagcttacttatctcaaatgcaaagtgaagtagtaaatgagtctaatacaatacttcaagagttttatgatgttggatttgagacttatggtgaaattagaaaatatgtttcaagatatggttttgattcagatatacttacacaaaagattgaatctttatctggtggagaaaaaaatatacttcaattggctaaggtttctgcgagtaaagcaaatatgttactaatggatgagcctacaagccacttagatatttattctcaaatggctctagaaaaagccatagcagattacaaaggtgctattttaatgatttctcatgattatcattttatagttaactgtgcggattatgttttacttattgaagataagacagttagaaaaatgagcatgcgtaaatttagaaagatgatttatgctaatcattttgataaagactatctgcaaattgaagaaaagaaaaaatcagttgaaatggaaatagcttctgctttaaaggatactgattttgaacgtgcaaaaactttatctacaaagttagaagagttaattaaattactttaaataaataacccccttagaattgataggcttgtcaattttaagggggttatttttttaattaaaagctatatctcactaaactccgttatttatgatacgattctccataacttcctctatagagaataatttttatttatactttatactgtaacaatttaaatatattactttacgaagcattatttttacttcatatatgtattaaccaattcataacatctttctttcgtaagtctagctaatgaaccattataaactacataatacaatgaacctcctctattttcacttgcttcattttctgctgttttatctctatattctatccaactacgttgtttactttttagctcattcatttcactttctgtaagttgagtcttcaataaactataaatctcatttaacatattatcccatctctttaatcttgtatattctgcttctaccaactctccatttgtaccatttttatatagataatctaagtcactcattcctttttctgttgagttaagcttatttatatattcatccttatagctatgttttactgtttctacatccttaattgtatctttatttttatcttttttagctatatccttggttgcatctttattttcatcttttttagctatatccttggttgtatctttattttcatcttttttctctatatccttgattgtatctttatttttatcttttttagctatatccttgattgtatctttattttcatcttttttagctatatccttgattgtatctttattttcatcttttttctctatatctttcttcttatcctttgatatttcaggtttttcagttaaccacgttgcttcttttccacagtttgagcaaagctttgtttcttcttttgactctttaccacaattgttacaatatgctgcagttgcaacttttttactctgttttttttcatctttagcacatccagttagcactagtgccattattaaacctattgatataattacctttttcattttttatctcacctcttagttattatgctttactttttatttaatgtgttatatacacctaattcagttattattataatattttctatttgttacttttcgcaatttaaataaacgttttctatataaaccccaacaaatatagcaccctaataattaatacaacaaaatctagtaggattactatctattagaacttaataattttttatattcagaagtctgaaaatctaacggatttatttataaatattattgtaattttcataacttacaataataagtaaattattaaaatacctaaaattcactatctcaaagacaatattaacatcaaaaaagttttgaaatatttcataatatattgtttggcaatgattactggatatttgatccaaatttagattcagtaataaatatattaccagcagaatttttccttcattcaggaattatgatattaatacttatatttataattagcttattaatgatatttagttataaaaaattaaataaaaggagtagtaattaattactactccttttatttaatttataagctataattttttacctagatttagaatatctcctattttactcattatgtaatcatgactttttctattatgaggaattaaacaagaagaacaatcttttattccgttatctgtatatttaaagtttccgccacaattttcttttaaagcatataaaggacaatagcaaaataggcaattaaagtttttgggatcactcactttatggcaaggaaaatattcacatttatcattactaaaaaatttataattatcagacataacatatacctcctaaaatatttagagtttcaatataattatactaaaaatttacaatagtggtataataaaaaaaagtacattaaatgaggtgttacaatggaaaaaatagtagaaaaggcgttattagttggtcttaacataactactaacgtaaaaaaagttgatgatatagacattaatgaatctatggaagaattaaaagagcttgcaaaggcagcaggagcagaagttgtaggcagtattatacaaaataggccagcaagagaagctgccttttatataggaaaagggaaagtagaagagataaaagcatattgcgaatcattagatgctacagtagtaatatttaacgatgaattatcaggagcgcaaataagaaatatagaagaattagttcaaagaaaagtaatagatagaacaactttaatattagatatatttgcacaaagggccttaagcaaagaaggtaagctacaagttgaattagctcagttaaaatatagactacctagactatatggtatgggtggagagatgagtagaactggagcaggtataggaacaagaggtccaggagagcaaaaactagaggtagataaaagacacatattaaataaaatggcagatataagaagagaacttagggatgtaaagaaaaacagagaaactcaaagatctcaaagattaaaatctaatatacctatagttgctttagtaggctatacaaatgcaggaaaatcaacattacttaatgaacttataaaaacgcataaagaatatagtgttgaaaaagaagttttatcaaaagatatgttatttgcaacgttagatgttactttaaggaaagctttacttcctaataaaaaggaatttttagttgtagatacagttgggtttgtaagtaaactaccacatgacttagtagaagcatttaaagcaactttagaagaggttcactatgctgatttaatagttcatgtggttgatgcgacaaacgaaagttttgaaatacaagaaaatactactaaaaaagtattaaaagaattagatgctgaagataagcctactataatggcttataacaaaatagataagttagaactagatatatatcctaaaaatcaagaaaatacagtttatatatcagctaagcaaggcataaatatggataaacttacagaaatgattcaaacagtattgatggaaaatactcatagagtagatttattattgccatatgaaagaggagatgtatttagtaaattaaaaaataaatacaatgttgaagagtttgaatatgttgaaaatggaatagaattaacagttagcttggatgaagaagactataatatatataaagaatatataataaatgagtagggattaatatgaatatatgttgggataatatagaaaatttagaggattattttataacttatcttctatataaagaatctagaacagtatctcaaataagtaagataaggaatattgaaattcaagaggtaaatgaccatttaataaaggctaagatggaaataaaagctatgcttaaaagtcaactagaactatctaaagatgtattagataaatttttagaattaggcaaagatgatagaattaattttatgaataatctagatgatgagagattattacaatttaaaagaaagttatataaaagaattataaccgaaaaaaatgcagaagatttaatgatattaatatgggcaactggtgagttaaatgatgatagatttttagggattttacattcattaactacacatagacattcagatgttagaaggataacttactcggctcttagaaaaatatcttcagctcaaagtagagaatactttcaaagaggattatatgattctaatgcacaaacacgtcagtattgtgcaaaagctttagcaaaagtaggaaataaaagtagtctttcaatgattaaaagacttaaagagagaaaaaaagacgaaaaaaactatgtaataaaagcttatgaagatgcaatagaacagttagaaaaaactacttaattatataacataaacactataaatttaacatataatggattaacataagaaattacttaaaaatttatctccataacttggtgtaaaaatatggttaagtagggggaatttaatatgatactaagacgttgtgcagggggcatagtattttatgcaaacaaagtattaataatcaaaaatgacagaggcgagtggactattcctaagggaaaaataaatgatggtgatatacctagtgaagttgcgccattaaaagttaaagaggaaattaaagttgaagctaaagtactagatatggcaggagatactatgtatgaattttactcaagaagcagacaacaaaaagtatgcaatgctattatgtggtatataatggagtctgatgatacaaactataatattgttgatgatagtattaaagaagctggattttttaaagtcaaagatgctttggatatgttaactcataatagagaaaagtcgctagtagatatatcatataagaagtttaaagatttaaaaaaacaatgtgttgataactaagtatatagttattattacttaaatagaacaaggtatttaccttgttctatttttatgattataattattatataaataagtttaggaggctatattatgtataagacattacacgaatttggaatggacgagattattatagataaatctacatttattggatatgcaaagcctataaaaacagaagaagaagctattgaatttataaatgaaataaagaaaaagcataaagatgcaaggcataatgtttgggcatatacagtgggtaaaagtatgaatatacaaagatacagtgatgatggagagcctcagggaacagcaggtataccaactttagaagttataaaaaaagaagatttaagagatgtagtagttgttgttacaagatactttggaggaattaaattaggcgctggcggattggtaagagcttatactaaaggagctaaaataggacttgaagctgctaaaataattgaaaaagtaatgtatcaagaagttaaaattaaaatagattataatcaacttggtaaagttcaaaatgaaataatgaatatgggatactttataaaagatactatatatgaagataatgtagaaataatagtttactcaagaaaaaatgaaattgacggtattgtagaaaaaataaatgatataactagtgctacagcaaacatagttttaggtgaagaattttatttatctgaaaaagatggacaaataatactttaaaattaaagtaatgtctcaatataactaaagttattgagacattactttttaatttttacagttaggtttgggagaattaaatataccttttttaacttctaatattcctacgattagcaaaaacacaccaaatacttttcttagagtttctgatgaaacatagttagctaagaaagaaccagctatagctccagctactccaaaaatagctattggaattaccaaactcaatattacatttttattttttatatggattattaaagcaaatatagtcataggaacagatgaaagtaagtttacactttgtgctattttagggtctatgtttaaaaatagtataagcgcaggaattagtattgttcctccacccattcccattccacctattatacctgaaaaaaatcctattatgataagtagcattaaaacaccatccttagagcagctataatcattattattccaaatgaaatcctaagaaactttcctgtaagtttacaaagaattttagcacctattattccacctattatactccctattgcaactttgaatgttaggtttaaatcataggttccttttgatacatatataaaagaacttgtaacagttaaaaaaactactatagataaagctgttgcatgtgatttatgctcttctacttttaggatattatttaaaataggtactaataatgttcctccaccagatccaaaaacgccatttataaatcctgaaatagaacctataagtgagtttttaatattaaaattaaaatattttttattcatagtatcaccttcttgcattatttttcacataaagcataaattatatttaattaaaataaaaatatctgatataattggcttatccaaaaaatgtaaggaggaatagtttatatgacaaacataaatgataagatagataaaacggtagaatggcttagagagaaagtaaaggaatcaaataccaatggattaatagttggagtatcgggtggaattgattcagctgtagttgcgtatttaataaaaaaagcttttccaaatgactctatgggcgtaataatgagtataaaaagtaaccctcaagatagattagatgcacttaaagtaatacatggttgtaatatagaatatttagatttagatttaacagatgagcaagttagtatatatgaaaaagttataaataacttaaaagaaaaagacttatataatgaaaaaaataacagaatgagtgatgctaatttaagagcaagaataagaatgagtactgtgtatactgttgctaataatatgggatacttagttgtaggaacagataatgcagctgaaatacatacaggatattttacaaagtatggagatggaggagttgatttaattccattggctaatttaactaagaaggaagtgtatgaatgggctaaagttttaggtgttcatgatgatattataaataaagctccatcagctggactttgggaaggacaaactgatgaaaatgaaatgggaactacttatgatatgatagatgcaattgtagaaggtagaatagatgaagttcctcaaaaagataaagaaataatagctagattacatagggtaagtgagcataaaagacatactgcggcagctccacctaagttctaatttactaaattaaagttttatgctaaaattacggtgtatatatagtataaattaatttataatcatactaattcatattacatattaactatacctatataagatataagcataacaaagttttatttagataaaataatttacagagcaaggagtggaattatgggacgtataggaaacataattaatagaaaaggtaagcaagatgcaaaaagagcaaagatatttacaaagcatgctagagcgatagcagttgcagctaaagatggtggagcagacccagaatacaatgcaactttaaaaacagcaatagataaagctaaagcagataacatgcctaacgataatatagatagagctatagctaaaggtgccggtggcggagcaaatgaaaactttgaaactatagtttatgaaggatatggaccaggaggagttgcagtaatagtagaaactttaactgataataaaaatagaactgcaggaaatgttagatactactttgataaaaatggtggtaacctaggtactagtggatgtgtgtcttttatgtttgatagaaaaggtcaaatattaatagaagcaaatgatgaagtatcagaagatgaattaatggaaacagctttagaagctggagcagaagacttaatcgttgaagaagatggatttgaagtagtaacttctccagaagatttccaagcagttagagatgaattagaagctaaaggatataattttatatctgcagaagtaaaattattacctcaaactactactaaattaactgaagaagaacaattaaagtttatgaacagattagttgatatgctagaagatgatgatgatgttcaatctatagcacataactgggaaatagaagaataaataaaaagaggagatatatatctcctctttttatttatatttaaaactagaacagcttgtctcggaatacatattaggtcttttagtatcaggtgaaaccttaatagaatctaatgtacataagttattatcattataaacacaagtttctactttacaacatatacaagaacaaggaccatcatcatttgtattattagttaaattactataaacaaaattttctaaaaatgatgcacaagctgtatgttcgattgtttttgcttgagttccgtgtacatcaattctatttgcgtaacatatgtttttattattgtgagaacaattttcaacactacaatttattttacccatggaaatccctcctataatagtatatagtaaaattatttccaaatagatttgtatatatactaaatataaataaattaggcgatataaaaataatatattaatatatcgcctttaaaagtttagttattgtgtgaaaataatatatcataattttttatatccattaagattcttgcaattagtactgaacttccaggataagtttttatcaaaggacaaatatcatataatcctatctcaaaatctttaaaagtatagctactttcttgatctataaatttttcaaaatttttcacataattttttatatctataaattgtgcaagtgataggtttgcaaaaacacttattttgtgattcggttgttttaaaagtaatacttgctgtttaaattcaataaactccaatctatctaaaattctattatctatattcaataattaatcccccttttaccaactatattataagtttttaacagtataatatgaaaatcgattagtaaatggaacgaatatttaaaaattttaattaaaaattaatcaataaattgattgtaatcacagttttattaaacaattgtacatataatgtaaatataacttgtaaaacttgatacaacaaaaatagaataaatttaataaatgatagaaaaaggagattaaaggtatgaaagaattaataaaaaatatagaaaaagcaaaaagtatagattttgatagtttagtaagttgtagtgagggacaaatagaaacagtaactatggcacaaaaaaaaggtgtgggaataactgtcttagcttttggtaagggagaaggagtagggcctcatgcagcaaaaggggatgctttaatatatatacatgaaggtgttgcaacagtaaaaataggagaggacacaatagaagccacaaaaggtcaatttgtagtcatgccagctaatatacaacatcaagtaactgcaaaagaagatatgaagatgcttttagtagttgttaaggaggactaaaaaatgaagtatttaagaaatattgaagcatttaaatctataccaatgaatgaaatgataaatcacactggaaataagattgcaagtaaagctctaatagataatgacaatacagagataagatttttctcgtttgcaaaaggagaaagtatagataaagaatattatgaaatggaaacattgtttgtcataatagaaggtagttgtagagttttatataatgaaaatgaagaagtattgttaaataaaggtgatatcgtagctttagaggctgatataaactatggagtggaagctttgactgatgttaagttatttaatatattagtaaaagcataaataataaaaaagctatagcaaagctatagtttttttattattaataagtgaattcttttattttatcaaaatcttttactattagagttttattacctttaagttttatagctccaatttcttcaaacatgggtaattttctacttatagtttctcttgttataccacagtaatttcccattccttctctatttactggaagtttaattatgacaccttcattagatttaactccatatttttcgctaaaatccaaaatcatattggctattcttgaatgaatatcattagttgcaagatttatagctatgttttcagcttctacaagtcttttactaagttgatttattatttttaaagaaatgcttggatttttagctagaacttcatcaaaattttctttagacattatacatatagttgttttttctaatacagtagcagaaaagttacttattgggttatcttcaaacaaattagattctccaaaaaactcaccttcctttagtatatgaactatttgttcttttccttcacttgtaagtttagataatttaactgcaccactacttaagatgaatagattggatgatttttccccttcagtacaaagaacatcacctttattgaatataaggtgactcatggtaatagctattttattcatttcatctttgcttaaagcagaaaatataggaacttcttttgcatataacttttttttgcaattttcacagctgaatctttccacaaaaacatctccttttattttgtacttatattggaatatatggatggttaaacgtttatataaacttatatttaaattatataataaaatatatttattaaaaatataaataattttaaaatcctacaaattttgactacaatcacattttttttaagtaaagaaagttattatgtattcataaaggtaatgagcagataaattaggaggtaattattatggataacataaaacttacaaaagatatttattacataggaaaagttgatgatagagatgttccttttcatagattaatacttacaaaaggaacaacatacaatagttattttttagatacagaaaaaccaacagtaatagatactgttgatatgatttatgggagagaatttgtagaaaatttaagtaaattaacaaatttagaaaaaataaaatatatagttgtaaatcatactgaaccagatcattcaggtgcaatggcaggactttgtataaaagctaaaaatgctactatagtttgttcagagattgcagtaaatgaattgaaagaattatataagttacataatagagaatttttagttgttaaagatggtgatacattagatataggtggaaagacacttttatttaaaatgacaccatatcttcatacagcagagacaatgataacatattgtgtggaagataaaatattatttccttgtgatatatttagtacacatgtagctacatttgatttatttgataatctagcaaaagaagatataactgatgattttataggatattataatgcaataatagctcctcatagaaattatgtgaaaatattaatggaagctataaaagatttggatataaaaatgatagcaccatctcatgggtatatattaactcaagatatagataaatacataaacatatacaaagatatgagtgttatagatttaaatggtaaaaaagctagtatagtttatagtactatgagaaattcaactaaaagtatagcgaatttaattaagacagaattagaaaatgctaatatggaagtttcattattcaatgctaataaagatgatataaatgaaatattaaaagcaatagaaagctcagatgttgtattatttggttcatcaactagatatggagatatgataggaaatatagaaaatgtattaaaagaacttaaagaaaaagatttagaaggtaaaatagcaggagcatttgggtcttatggatggagtggagaatctatagagataatacaagaatatttaaatgatacaaacatgaatgtattaaacacttcaaatattataaaaaatacaggaatgacagaagttgaatttccaataagagtaaaattttcattaaatgaagattcaagtaaagaagttataaaggctgttgaatatataaagacagttataaaataaatttaaaggagaaagaaaatgcaaaaatatgtatgtgatgtttgtcaatatgtttatgatccagaaataggagatcctgaaaatggagtggctccaggaactaaatgggaagatgttcctgaagattggacttgcccagattgtggagcagataagagttatttctcaaaatttgaagactaaagaaaaatattaataaaaagagtgtcttaaggaatttagctttaaattttttaagacacttttttatttgcatactgatattttataaataattttaaataaatgtatgaaaaatatctaattggaaaaaataaccggtataaggaggttgtttttaatgttcgaaaagaaaaaagaatttccttggcgaataccgattatgatagttttaggcatagcagttctcgctggagggatttatgtaggatttaaaacatcagatgaagtgatctctaaagataaagacacaaaacctaaaaaggaagaagaaatagttaaagacacatttaagttaagcaaagattgtgaaatttgggtagaaaaaacatttgaagatggaacatctagtaatgaaccaccaactatgataggaacgataccatcagaattaataggaaagtcaaaggatgagataactaaatatctaacaacaaaatatccaaacagaacaataaaaaaattagataaatatgaaataactttacaagaaaaagaaaattttaatgatcccaaaaaagctaatcaatttgtaatagaagacaaaaaaggtattatagtagtttgcaagtacaatggcaatggagatagagaaatacttgaaaatactgacattgaaactgagtctttgcctaaaaaggttcaagaagaagtcaaggttggtatatctgcaacaacacaagatgaaatatattctaaactagaggattttggaagttaaacacttaaaataatttaataatatctaactataaagagatgaaagggaaacttttcatctctttatagtttgcatagaaatatggtattatatattaatacagaacgtaagtttcgtaaaaggagttattttagtatgattattttaggtatagatccaggaatagctatagttggttatggaattatagaatataaaaataataaatttagggttattgattatggagcagtaactacaccagcacatatggatgtattaaaaagattagaacttgtttataaaggtatagatatgctcatcaaaaactacaacatagatgaagttggtatagaagaattattctttaataaaaatgtaaaaacagctattacagtagcacaagcaaggggcgttactatgcttgcttgtgcacataataataagccagtatacgagtacacgcctcttcaagtaaagcaaggagtagttggatatggtagagcacaaaaagctcaagtacaacagatggttaaatcttttttaaatttaaaatcagtaccaaaaccagatgatgtagcagatgcattagcagttgcaatatgtcattgccattcgaataaattagaaaaaacacttaaaaatataggggggaaatatgtatagttatataaaaggaagtatagaagaaataaacttagatagcttagtaatagaagcaaataatattggatataaagttaatgtatcatcaaatacactatcagatttaaagctaggaaaagaatataaaatatataccaaattaatagtaagagaggatgatatgagtctttgtggtttttcaacaaaagaagaacttaatatgtttgaattattaaattcagtttctaagataggacctaaggttgcattaggtatattatcttttgcaaccccaaagcaaataggtgcatatatagttagtgaagatgtggcgaaaatgtctaaagctcctggagttggaaagaaaacagcagaaagaattattttagaattaaaagataagatagataaaaataatattgagtttgagccgacacttctttcacaagctccaatagctgtatctcaagatgaagcagttgatgcacttattgcccttggatattcatctcaagaatctaaagaagcagttaataattgtaaaaaaggtggaatgaatacagaagatataataaagaaatcattaagttatttaatgagtaaatctcttagataagggggcgaatttaaactatgtttgaagatgaaaataggataataacatctactatgcaaaatgaagatgttgatatagaaaacaatttaaggcctaaaagtttagatgattatttaggacaaaagaaggctaaagaacttttaaaaatatttatagaagcagcaaaagctagaaatgaacaactagaccatgttttattatatggaccacctgggcttggaaaaacgacattagcatctataatagctagtgagatgggtgttaatcttaggataacttcaggacctgcaatagaaagagctggagatttagctgctattttaactaacttaaatgaaaatgatgttttatttatagatgaaattcacagaataagtagaactgtagaagaagttttatattcagctatggaagattattgtttagatataattataggtaaaggcccatcagctagaagtataagacttgatttacctaaatttactttaattggagcaactactaaagctggtatgttaactaatcctttaagagatagatttggagttatatgcaagttagattattatacagttgaagaattggcacaaatagtaattagatcatcaagcatattaggagcagagattcaaattggaggagctacagaaatagcgagaagatctagaggaacaccaaggatatcaaatagattattaaaaagagttagagattatgcacaagttagagcagatggaaatataacagacgaagttgcaaatgatgcattagaattattaggagtagatagtttaggacttgatcatgtagatgaaaaacttctaaacacaataattgaaaaatttaagggaggtcctgttggattagatactttagcagcttctacaggagaagatagaaatacaatagaagatgtttatgagccatatctacttcaattaggatttataaatagaggacctagaggtaggattgcaatgcctttagcttatgatcatttgaaaataccataccctaataaaaaatagaaattaaataagcatattgacaataaatatcattaatatagaaaaatattattttttttgttatgatgtaatttgtactaaaatatagaaaggacgtttaaattgaaaactagcgatttttattttgacttaccagaagaattaatagctcaaacacctcttgaggatagatcaaattcaagacttatggttttagataaaaaaactggggaaattgagcacaaaatatttaaagacgttatagattatttaaatccaggagattgtttagttcttaataatacaagagttataccagcaagacttataggagaaaaagttgatactggtggtaaaatagaatttcttttattaaaaagaactgataaagatatttggcaagcattagttaaaccaggaaagagagctaaggtaggaactaagttctcatttggaaatggaaaacttataggagaggtagtaggacttgcagaagaaggttctagattagttaagttttactatgaaggtatctttgaagaagtattagatgaacttggaaatatgccgttgcctccatatataacaaaaagattagaagaaagagaaagataccaaactgtttattcaaaacataatggttcagcagcagcacctacagcgggtcttcattttacaaaagaacttttagagaagataaaggaaaaaggtgtagacattgcttttgtaacattacatgtaggacttggaacgtttagaccagttaaggttgatgatgttttagaacatgagatgcattctgaatattatatggtagataaagaagcagctgaaaaaataaataaagcaaagaaaaatggtaataagattatatgtgttggaacaactagttgcagaactgttgagtcagcaagtaacgaaaatggtgagattgtagaatctagtggatggactaatatatttatatatccagggtataaatttaaaatggtagataaattaataactaatttccatttaccagaatctacactaataatgttagtaagtgcattagtttcaaaagatgctgttttaaatgcatataatactgcagttttagaaaaatatagattctttagttttggggatgcaatgataatcaaataaatattagggggctaacatgaaaaagatagatgaaaagagtttagcacttaaaatagcctatatatttgaatcattattagcaatggttgtacttattgcagtatttttaggaacaattgatgtgcttagaataatatggcaatcatatatcgtagaatataaaactgtagtacagtatgctcaatttaatgatttattaggacaaatattattattagttataggagtagaattagtggtgatgttatcactacatattccaggggcattaatcgaagtattattgtatgctatagctagaaaattattattgctacctaaaagtgaaggaatgcttgagctacttttaggtataatggctatagctggattatttgcaataagaaaatacttacttacggatgataatagctcaatgaatgtcacaagcattcattttgaagaatgtgaagaagatgattgtgaatgtcataaaagaaatttagagcaagctttaaattatcaaaaaaaataataaaagaaagttaaggagagtcagcatgagtgcaataagatatgaacttataaaaacttgtaagcaaagtggagcaagactaggaagattacacactcctcatggagtaattgagacaccaatatttatgccagttggaactcaagcaactgtaaaatctatgacaccagaagaattaaaagaaataggatctcaaataatattaagtaacacatatcatttatacatgagacctggtcatgatttagttaaagaagctggagggcttcataagtttatgaactgggataaacctatacttacagatagtggagggttccaagtatttagtttaggtccacttagaaaaataactgaagaaggtgtacactttagatctcatatagatggatcaaagcactttataagccctgaaaaagctatggagatacaaaatgcattaggttcagatataatgatggcatttgatgagtgtgctccatatccagcagatagagaatatgttaaaaattctttagaaagaactacaagatggttaaaaagatgtaaagaagctcataaaaatacagaaaaccaagccttatttggtataattcagggtggtatgtataaagatttaagagaacaatcagcaaaagaaatattagaattagacttacctggatatgcagtaggtggtttaagtgttggagagccaaaagagttaatgtatgaagttttagattatacagtacctctaatgccagaggataagccaagatatttaatgggtgttggaagtcctgatgatttaatagaaggagtaataagaggaatagacatgtttgactgtgtattacctactcgtatagcaagaaatggtactgctatgactagtgaaggaaaagtagtagttagaaatgcaaaatatgcaagagattttggaccattagatcctaattgtgattgttattgttgtaaaaactatacaagagcgtatataagacatttagttaaagctaatgaaatattagctgcaagacttataactacgcataacttacatttcttattagatttaatgaagcaagtaagacaagctataatggaagatagattattagattttagaagagaatttttccaaaaatatggctatgaattataattattttaagttataatgattattataccgaacaaaaactaaaaggtttaatcaatataataaaaaggagtgacgtatatgcctcaagctgtagtagggatacttatgtgggttgtgttttttgcaatattttatttcttcttaataagaccacaaaagaaaaaagataaacaattaaaagaaatgagagataacttaagtgtaggagctaaagttgtaacaataggtggtatagtagctaatgtagctaaagttgaagaagatgttgttatactagaaatcggaccaagtagaacaaaagtaccatttgaaaaatgggctatagcatctacacaatcagaatcaaaataaaaataaaatcaataattgtaattacaaaacctccccttgaatataattttatatgaaagggggaggtttttttatggaaaaatcaagcaatatattcaaaggtttaggatatgcttacataataacattagcaagcttattaatttataatttattattaacatttacaagtatttcttcaactagtatagctatggcaacttcggctataacgacagcatctgctgcatttggtggattttatgcatctatgaaaataaaagaaaagggacttttgtacggggtattggttgggttaacttacatattatgtttaatgatagtagtatttttagctaaagattctttcacatttgaaatgactacagcatataaagcactattgacaactttggctggaggaataggtggcgttttaggggttaactttaaataaatttccacttatgtaaattttatgatataatcaaaaaaggtttagtaagataggaggtagttaaaatggaaaagaagcatataaaaactttatctaaagctactttaaaagaaagtgcggcaaaaggtggatgtggagaatgtcaaacatcttgtcaatctgcttgtaaaacttcttgtacagttgcaaatcaagagtgcgagagataataaatttattatttaacaaaaaggcagctatataagctgctttttttgagtgaaattgaaatatgtggatataaaagataaatagtctataaagctatttatatgataatatatagatataaacaaactaggagggcatattatgagtatgatacataagttttcaatgaacggatacaatatagttttagacgtaaatggtggagctgttcatgttgtagatgaggtagcatataacttattagaccactacaaagaaaaatctttagatgagataataaaagaattaagtaaaaattatacagaagatcaaataaaagaagcatacaatgaaataaaaactttagaagatgaaggattattatatacagtagatacatataaacatcatccaaactttattgatagaaaaaaagttgtaaaagctttatgtttacatgttgcacatgattgtaacttaaagtgtgaatattgttttgcagcacaaggagattttggtggggctaaagaattaatgagctttgaagttggaaaaaaagctatagattacttaatagctaattcaggaaatagaagaaatttagaaatagatttctttgggggagaaccattaatgaactttgaagttgtaaaacaacttgttgagtacggtagaagtgtagaaaaagaaaataataaaaacataagatttacaataactacaaatggtgtattacttgatgatgataaaataaaatatataaatgaaaatatgcacaatgtagttttaagtttagatggaagaaaagaagttaatgatagaatgagacctacattaaatgacaagggaagttatgacataataatgcctaagtttaaaaagcttgtagaaagtagacctaaagataaatactattatataagaggaactttcactagagaaaacttagacttctcagaagatgtacttcattttgcagatgaagggtttgaacttacatcagtagagcctgttgtagatgatgaaagtaatccatttgcattaagagaagaagatatggaaacagtatttaatgaatatgaaaaattagctgttaagtattcagacagattattaaacggagaaaactttaagttcttccactttatgatagatttaaaccaaggaccttgtgtaataaaaagaataacaggttgtggagcaggaaatgagtacttagcaataactccaaatggagatatttatccatgccatcaatttgttggtaaagatgaatataaacttgcaaatataaatgatgaagaaataataattccaagagagttaacagatacatttaaaaatgcacatgtatatagtaaagaagattgccaaaattgttggaataaattctactgttcaggtggatgtcatgcaaatgcagtaaactttaatggagatgtaatgaaaccgtatgagttaggttgtgaaatgcaaaagaaacgtactgaatgttctataatgatacaagcaagattaatgatagaagggaagtagatagagtgataaaggggtataaaggtaaaaaacccacatttgactcaagtgtttttatagcagaatcagcagatattattggtgatgtcaaaataggaaaaaatgcaaatatatggtataacgcagttataagagcagatgaaaactctataactataggcgaaaatactaatatacaagatggtacagttgtacacatagaatataattgtgaaactttaataggaaataatgtaactgtaggacataaagctcttatacatggatgtaaaataggggataatagtttaataggaatgggatctataatattaggtggagcggaaataggagaatatacattagttgctgcaggaagtttagttcctccaaataaaaaaataccatcaggagttcttgtaaaagggtctccggcacaagttgtaagagaacttacagaagaagaaaaacaaaatcttgttaattctgcattaaaatatgtagaaactgcaaataattataaataggttaaggaaaggggcaatataaaatatattgtcctttcttctcttataaataatattatttaaactaagactagggtgtgaaaaatgaaagtaagttatagacatttaaaaagatataaagaaatagttcgtatacttttaaaatatggatttagtattatagtagaaaaacttaatatagaaggtgtagcttacaagattccaataacaaatccgccagcagaaataaagaatatgtctacaggagaaaggttaagaagagcttttgaggaattagggcccacatatgtaaaattaggtcaaatactaagtactagaaaagatttattagatcaaagcgttataaatgagttagtaaaattaagagataatgtagatgtatttgacactaatatagctataaagatattagaagaagaacttaagatgcctataagtgatattttcctagaatttaattctacgcctatagcagcggcatccttaggtcaagtttatgaggctaagttaaaaagtggagagagcgtaatagtaaaagttcaaaggccaaaagtagaaagtataataaagtcagatatagagatattaaaagcaattgcaggtgctattaaagattttaataaagatttaaatgtagatatagaagggatagttgaagattttgaaacgcaacttttaagagagttagattataattttgaggcaataaatggacttaaatttcaaaatatattctctgatacaacagaagtatatattccaaatgtatttatggagtatacaactaaaagagtgttagtattagaaaaaatagttggagttaaacttagcgatattgataaaatgaaagagttaggttgggatactaaaaaaattagcgaaataggaatgaattctttatttaagcaaatatttgaatatggtttttttcatgcagacccacatccaggaaatatatttgttataaatgaaaattgtatatcctatatagactttggaatgataggtataatagataaaaagacgttaaatatattaaattctattgcatttgctgcagtggataaaaacatagatagaattatatatttacttatggaattagatattatatcttatgatactaatttaagtggattaagacaagatttactttatttaatgcattattattatgatgttcctatagataagttaaatttaggtgatatattaaatgaagtatttagattttgtagaacttataaggtagcactaccacctcagttagttttattagtaaaagcattgataactcttgaaggaacagctagagaactcaatcctaatttttctataactatagctggtaaatcatttatgaaatattactatttaaatagattaaacccagaaaatatattaaaacaatcaaagcaaagtgcacaagaagctattgcagatgtaagaataatacctagacaattaaaaagtatacttagaaatttagaaaaaaataatattaaacttcatatagaagatgtgaaattttctaaattagaaaagataataactgatttagcgacccaattatctttgagtttagttttagcagcattattagtaggatcatctttaataatagcatcacctaacataaataatagtttttgggttaaaacactagctttttcagggtttatagtttcttttttagttggtatattattagttataaaaataataagatctgaatatataaaaaaatagggggtgattgtctatgtttagcaaaaaatggacacttaagtataaaggaagtataaaggattacgatttaaataaaaaaatgaaaatttccccggaaataggtcagatattaaaaaatagagggattaacagcgaagaagatgctgaaattttcataaatccatctctagattacttaagagacccatttttaatgaaggatatggaaaaagctgtatatagaatagagtatgctatagaaaacaatcaaaatatatggatatatggagattatgatgtagatggggtatcttcaacttctgtactatgtttatattttgattctataggatttccagtaaaatactatatacctaatagattagaagaaggttatgggataaatgaagatgtcataggagttttaaaaaatcaagggtgtgatttgttaataagtgtagactgtgggataacatctgtaaaagaagtggaattagcaaatcaattaggtatagatgtgataataactgatcaccatgaagtacaagatgaaatacctaatgcttatgcagttataaatcctaaacaagaaaattgtaattacccatttgatatgttatgtggatgtggagtagcatttaaacttatacaagcattaactccagcagaagaatttaaaacttctatgtataattacttagagattgtaacattagcaactatatgtgatatagttccactagtagacgaaaatagaataattgttaaaaatgggcttaagcttatgaaagatggaataaacttaggactaaaagaacttataaaagtatgtggaatagatacggataaaataggttcatcacatgtaggattttctataggccctagaataaatgcatcgggaagattaggttattcatatttaggagttgaattatttacaactaaatctaaagaagaagctattgaaatagcaagtttactagaagataagaataatgaaagacaaatgatagaagctaaaatgtatcaagaagctgaagatataattaatggggatgaaagatataaagatgataaggtattagtaatagccaataaaggatggcaacatggagttattggaatagtagcatcaaaattaacggaaaaatattacaaacctactatacttttaactatagaagatgaagaagctacaggttctgctagatcaataaaaggttttagcatatttgatacccttgtaaagtgctctgatttgcttggaaagtttggaggtcatgagcaagcagctggattatctatggataaaaataatatagacgagttaagaagacgagttaatgaaatagcagattacaaccttacagatgaagatatgatagaaaatatatctgtagaatttgaattaaacgaaggttctatagattttaatttaattgaagaattacatagcttagagccctttggtatgagtaatccaagccctagattcataattagagatttagaaataagatctatatttagaatgggtaaagaaaaaaatcatctgaaattaaacttagaaaaagataaagtatatgaatgtgttggatttaacatggcttatatggctgaaaattatgaggttggagataaagtagacgtattatttcaactagatgaaaataattatatgggaaataggaaaatacagtttttgttaaaagatataaggctcgcatatccaaagaatgcaagtaaaaatataaatagtataaaattgtttgaaaacttaaagccatgtatagaatctaaagatatagaaaatatgaatgaaaatataaatatatacggaagtaaagatataaatatatttgattacataaatgataagagtttaataattgccaactcgataaatggattttttaaagctgtatcagatttatcacttacagaatatgaatttgatataaattataatattatagagaagataaacgacaaagttcaacttatattctttccctatattgataaaatagatttaaaaagatataataatattattctttatgattatttatatagtatagaagaatattcgtttttatatgaatatacaaataatcaatgtgagattataaagtattatgataaaaatgacttaatatatataaataatatagtaaatagtataattccaagtagagaagaatttatagctttatataaacttgtatctaaatatagagaagttaaaattaatatattagaaattaaatcaaatttaaatatagcgcctataaaattatttgctatgctaaatgtatttaaagatttagaattaatgaattttaatatagataataaaagcaatactttaaatatggaaattatgccaaagccaagttctaagattgatttaagttcaagtttaattttacaaggacttaatcgacttaaagataaatataaacacagctattaggaggatttaaatgaacttaagagattcaataagagagattaaagatttcccaaaaccaggtataggatttaaagacataacaactttattaagcaacggagaagcatttaagtttgccatagatgagataatagcagatctaaaagataaaaatgttgatgtaatagttggaccagaagcaagaggattcttaatgggaacgccagttgcttacggaatgggcataggatttgtaccagttagaaaaccaggtaaattaccaggagaagtagaaagctttgagtatggattagagtacggaactgatacattagaaatccataaagatgcaataaagccaggtcaaagagttgcgatagtagatgatttattagctacaggaggaactatgcaagctgctgctaaacttatagaaaagttaggtggagaggttgtttctatgcaatttttaatagaattagaagagttaaaaggtagagataaactatctaattatcatgtaaactcacttgtaaaatattaataacgttcaatagttggtaaaaagccaactattttcatatatatcaaaatttatactataaaataggtggtactatgcaagataagcaattacaagaattaatagataagataaaaacatatgctcctaatggagatatagacctagtaaaaaaagcctattactatggtaaaaaggcacatgatggtcaattaagaaaatctggggagccatattttatacatccaatagcagttgctaatatactttgtgatatggaattagatatgcaaactatagcagcagggttattacatgatgtagttgaagatactcaatacacatatgaggatataaaaaatgagtttggggaagaagtagcagaccttgttgatggagttacaaaacttgggcaaataaagtataaatcaaaggaagagacacaagctgaaaatttaagaaagatgtttttagctatgtcaaaagatattagagttatactgataaaattagccgataggttacataatatgagaaccttaaagttcatgcctcctgaaaaagcaaaatctaaagcgaaagaaacattagaaatttacggtggaattgccagtaggctaggtatatataaagttaagtgggaattagaagatatcgcacttagatatatagacagtgaaggatattatgacttagtagataaagttgctaaaaaaagaagtcaaagagaagcttatatagaaagaatagtacatattcttaatgataaatttaaagaagttaatataaaatgtgatatatatggaaggcctaaacatttctatagtatatatagaaaaatgaaaaataaacataaagattttgaagaaatatatgacttaatggcagttagaattatagttgattctgtaaaagattgctacgctgtattagggatggtacatactttatggaaaccaatacctggaagatttaaagattatattgctatgccaaagccaaatatgtatcaatctttacatacaatagttttaggaccggacggtgagcctgtagagatacaaataagaacaaaagaaatgcataatatagctgagtacggaattgcagcacattggaagtataaagaaggaaaaacaaatgtaaaagagagtaaattagaagaaaaactacagtggctaagacaaatgatggagtgggaaaaagatctaaaagatcctcaggagtttatggatgcattaaaagatgatgtatttaatagtcaagtttatgtatttactccaaaaggagatgtaatagagttaccagcaggatcaactcctatagactttgcatatagagtacatactaatgtaggaaataaatgtgtaggagctaagattaatggaagaatagttcccctagactataaattacaaaatggtaatatagttgaaatattgacttctacgaattctaatggaccaagtagagactggattaatttagtacaaactcctaatgctaaatctaaaataagacagtggtttaagaaagaacgaagagaagaaaatatagaaagaggaaatgtaattttagaaaaagaatttaaaaaatatgcaatacctacaaaagatgctacaattgaaaaatatatgattcagatggctaaaaaattcaatcagcctacagtagaagatttgattgctactataggatatggaggaataatgccatctcaaatagttccaaaaataaaagaactttatgaaaaagaagttgtaaagaaaacaccagatactaaacaaatagatgatataaataagcatagtataggagagcaagaatatactaaaaaaagaaagaaatcatcaccacaaggaattatagtaaagggattagacaatatattagttagatttgctaaatgctgtaatccaatacctggggatgatattattggatatataacaaaaggtagaggagttgcagttcatagaaaagattgcccaaactctaatttagatgatgaatatttcaaaaatagattagtagaagtttcttgggaaacatcaaataatactaagtttgaagctgagatacaaatccaagctgaggatagaagaggtattataaatgatataactcatattgtagcaattgagaaaatagcattaaatggtataaatgctagaaaagggaaagatagtgttattaatgtaaatttacttgtagaggttgaaagtatagatgcattaagtcttttaatgaaaaagattaaatcaattccaggagtagaggaaatttatagagttataaattaaggaggaactaatgagagctgtagttcaaagagtatcttcttcaaaggttacagtaaatgagaatacaattggaaatataaacaaaggattacttgtattattaggtgtaactcatgaagatacaagttcagatgtggattatttattagaaaagatagtaaatttaagaatatttgaagatgaaaatgaaaaaatgaatttatcacttaaagatgtgaagggagaacttttggtagtttcccaatttacattatatggtgattgtaaaaaaggcagaagacctaattttacaaatgctgcaaaaccagatttagctaccaagttgtatgaagaatttataaaaaaggctattaaagaaggtataaaagttgaaactggtgaatttggagctcatatgatggtagagctagtaaatgatggacctgttactatgcttatagattcagaaaaaaatttttaagggggataaagttatgataatagaaaaatttacagatcacttatttggagaaaatacttacctaatagcagataaaaatacaagagaaggtgctgttatagatccaggtggagatgtaaaagatttaataaagtatgtaaaagacaattttatagaagttaaatatataattcttactcatggacatggagatcatattggttgtgtgcctgaattaaaaaaagctacaaatgcatgtataatagcgcatagtgatgaaaaagaaatattattagataaaaagaaaaatttaagttatagaatgcactgtggacctactgaatttgaggctgataaatatgttaatgaaggcgacagtgtaaatttaggagatttaaaacttaaatttatacatacaccagggcatactaaaggtggtatgtgtataaaggtaggaaatcacatgttcacaggagatactttatttgcaggaagtatgggtagaactgatttatacagtggagataataaacaaatacaaaaatcattaagtagattaaaaaattatgaagatgatataattgtatacccagggcatggaccaaatactactatgggcatagaaaaagctaccaacccatatatggtataatgggtctttgttaagactaaagaaaaaggagtagtttaaatgttaggtgttaagttacaaggacatgactacaagtatgaagttgcagaattattaaaattatttactactcaatttaaatttataaatagtaatgatgaatttgaaaaaattttaataaatgaagttattataaaagataaacaaatagaaagtataactaaattctatgaaaataaggaactaaaaatttgcaaatcagaaagttttgatacaaatttaataaataaagaagatataaaaaaaggtacaaaaacaataataaaaagaagtatatttaatgttttagatgaattatttaaaacttatgtaccttggggtattttaacgggaataagacctgttaaaatagtacataacttattagatcaagggttaagtgaagaagatataagagaaaatcttaaaaataattatttaataaaagatgaaaaaatagatttagctttagatatagcaaaaagagaaagggtatttatatatccaattgataaaaataaaatatctttatatgtaagtatacctttttgccctacaagatgtgtgtattgttcattcccagctaatcctatgaaacaatttggtcatctaagagacaaatatgtaaaagcacttataaaagagataaaaggtttagcgaaacttttaaaagatactaataaagatatcgaaactctttatataggtggtgggacacctactgccttagaagctaatcaactagatgtattgattaaagctttatttgaagaattagatttaagtaatataaaagaatttacagttgaagcaggtagaccagatactataactaaagaaaagctagaagttatgaaaaaacataatgtcactagagtaagtataaatcctcaaactatgaataatgaaacattagctaaaataggaagagatcataatgttgacgatataataaattgttttaagatggctagagatttagggtttgacaatataaatatggatattatattaggattagttgatgaagatttagaaatggttagaaatactttagaaaaaataaaagaactgtcacctgaaagtctaactgtacatactttagctataaagagagcatctacattaaaagaaaatcttgataaatatgagcttacaagatatgaagaaatgataaaaatgattgatttatccatggaatatgcaaaagatatgggattaaaaccatattatatgtatagacaaaaacatatgcttggaaatcttgagaatataggatatgctaaagaaggctttgaatgtatatacaatattcaaataatggaagaaaaacaaagcaatttagctgtaggtgcaggtgcaataagtaagtacgtctatgtagatgaagatagaatagaaagaactgataatgttaagaatgttgaacaatatatagacagagttgatgaaatgatagaaagaaaggtaaaggaggtatataaaaatgttaactaaggctccaagagggacaaaagatataactccaaaagatgcatataaatggaattatgttgaaaataaatttagagaaatttgtgcgctatttggatatgaagaaataagaactcctatatttgaacatacggaattattccaaagaggcgttggagaaacaacagacgttgttcaaaaggaaatgtatacttttgaggataaaggacaaagaagtataacactaaaaccggaaggaactgctggggcagtaagagcattcatagaaaataagatgtatgcagatactcaaccaacaaagttattctatcaaactccttgttttagatatgaaagaccgcaagcaggaagacaaagacaattccatcaatttggaatagaaacattaggtagtgataaaccttctatagatgcagaagttatagcgttagcagtgcagtttttcaatgaggtaggattaaataatttacaaacgtgtataaactcagttggatgtcctacatgtagagcaaaatacaatgatatattaaaatcatatcttgattctaaaagtgatgtattatgtgaaacttgtaatgaaagaaaagaaaaaaatccaatgagagttatagactgtaaaaatccagtttgtaaagaaaatttagtggatataccatatatgatagaccacttatgtgatgattgtaaaaatcactttgaaaaagttcaagagtatttaactgaaatgggaataaactttaagattgataaaactatagttagaggtcttgattactacaaaaaaactgcatttgagataatatcaacagatataggagcacaaagtacagtttgtggtggtggaagatacgatggattagtagagcaacttggaggacctaaaggagtaagtggtataggttttgcccttggtgttgagagattattattgacacttgagaataataatatagaaatagaaaaccctaaagctacagatatatttattgcaactataggagagaatgctcaagctaagagctttaagatattaaaagatttaagagaaaatcacataagtgcagataaagaccacttagacagaagtttaaaagctcagtttaaatatgcagataaattaaatgctaaatatactatagtcataggtgatgatgagttgtctaatgatgaggttaagcttaaaaatatggctacatcagaacaaacaactataaaactaagtgagatagttacagaattaaaaaatagattataatttcaatatatggagggcaagttatggagactctaaatggactaaagagaactcactactgtggagacttaagagaatctaatatagatgaagaagttgtacttatgggatgggtacaaaagaaaagaaacttaggaggattagtattcgttgacctaagagatagaagtggaatttgtcaaataatatttgatacagacgtaaatgcagatgcttttgctaaagctgaaaaattaggctctgaatatgttatagctataaaaggtaaagttgctgaaagatcatctaaaaatcctaatttaccaactggagatatagaagtatttgctactgagttaagattattaaataaatcagaaacaccacctatatatataaaagatgatgataatgtatcagaagagttaagacttaaatatagatacctagatttaagaaaaccatctatgcaaaagaatttaatattaagaagtaaggttgcaaatatagttagaaattacttaacagaaaataatttctttgaaatagaaactccatttttaataaagccaactccagaaggagctagagattatttagttccaagtagagttaatgaaggaaaattctatgcattaccacaatcaccacaattattcaagcaattactaatggtaagtggtatggatagatacttccaaatagttaagtgtttcagagatgaagatttaagagcagacagacaaccagaatttactcaaatagactgcgaaatgtcttttgttgaacaagaagatgttatggctataatggagaaaatggtacaaagaatatttaaagaaattttaaatgttgatgttaagttaccacttaagactatgacttatgctgaggctatggaaagatatggttcagataaaccagatactagatttgggtatgaattaactgatatatctgatatagtaaaaacttgcggatttggagtatttgctaatgctgctaaagatggaagtgtaagaggtataaatgttaaaggaaaagctgaagatttctctaaaaaacaaataggtaaactagaagatcatgctaaaacttataaagctaaaggtcttgcttggataaaagtaggagaaaatagagaggttacatctcctatagctaagttcttcacagcagaagaaatgacagctatattagacagaatggatgctaaagaaggagatttattactatttgttgcagacaaagattctgtagtatttgatgcattaggacaagtaagattagaagttgctagaagattaaatatattagataacaatgtttatgaaatgttatgggtaactgaattcccattattcgaggaagatgaagaaactggaagaatgatagctaaacatcacccattcacatcaccacttgatgaagacttagaaggaattgaaggagacgataaagcttctttaagagctaaggcttatgatatggttataaatggatatgaagtaggtggaggaagtgttagaatatttaattctgacgtacaacaaaaaatgtttaaagcattagggttcactgaagaagaagcacaagagaagtttggattcttattagatgcatttaaatatggaactcctcctcatgcagggatggcatttggattagatagacttataatgatacttgctggaactactaatattaaagatgttatagcattccctaaaaatcaaagtgcagtatgtcctatgacaaatgcacctgcaattgcagatgaagctcaactagaagagttaaatataaaagtagatataaaagataaagagtaatagttaataaatactgctaaattaatttggcagtatttatttttttttattaaaatggtatataatataatataagaacagagaagaggttgatatatggataagaaattagctagtactaatgacaaagatttaattattaaaaggttaaataggattgaaggccaagtaaaaggaattcaaaaaatggttgaggatgaaagatattgtgtggatattttagttcagatatctgctataagatctgctataaataaagtaggaaatattattttagaaaatcatattaaaggttgtgtggctaattctataaaagaaggtaattttgaaaaatcagatgaactaatatctgagttaatgcaaactataaataaatttactaaatagggggataaatatgaatcaacatgggtatgtaatagaaatagtagatagtataactgcgaagataaaaatgcaaaagcattcagcgtgtgcatcttgtggtaagtgcgcatcatctacagataaaaaagatataattgttgaagtagataacacattaggtgctaaggtcggagattatgtggaggtaaatatggactctgtaaatgtaattaaagcagcatccataatttatgctataccgctaatagcgcttttggggggaactattttatcttataaggtgttaagttgttttgacataccatttaatatagaagtaataagtggagggataggtgtattattaactatactatcttatttagctataaagagtagagattttaagtttagagaaagtagaaactacatacctataataactaaagtgatagacaatatagatatataaaagaggaagcaatatagcttcctcttaattttttacaaatcatcattttggtctaaatcgttatcctcagtcattatattattttcataattagaatctttctttgtagttacatggttaaagctagatacagatttttttagttttattgtatttatagttttaacaaatgaagttacaattaatactccaagagatatagctccaccgaccaataaagcagttacacctgtagatgtagctagctcataattttcttgaacaagatacaacatagtattgtacatacctaatccaggaactagaggtattatacctggtattataaatacaatagcaggttgttttaaatatcttgcagatacctcgcttaaaattcctacaattgtagcaggtacaaaatttgataaaatagggttatctgttagtttaaataagtaaacatataaaacccaacctatagcacctattaagcctgcataaggtagtgatcttttaggagcacttaagaatatagaaaaacctatagtacaaataaaactaaatataaaatgtaaatatagaggcatagaactcattatagtacaccccctaatttaagccatacatcaagaacaaatcctacaccaacagcaatggcaacagcagttaaagtggcatcaaatgctcttgctacaccagatattaaatccccagatataagatctcttaacccttttatcaaagagaccccaggaagtagaggcattattgagccgacaataagagtattaggctgacttaaaaatccaatacttgacaaagaagtaccaattacagctataaatatagctgaagttaatgttgcaaatgaaggtatagagcttatactaaacattttatcaaatattataactgcaaaaatagatgttataaatgtaaagatgaaatctaccaatgtacaccctaataagactgagaagcaagcagagccaagtcctgtgccaacataaaccacccattgattataagattttactttttcaatatctttaagtaaaactatagcatctttcgtagataaatttttattagaaacaaattctctagaaaacgcatttaaaagatcaattttgtttaaattaatacctctattttttatagttttcataaaagtaattccatcgaatctttcatctgaaataattattactgtaggagaagtaaatacatttacatgttgatatcctctagagttacaaattctaagtatggtatcttcaactctataagtttcagcgccatttcttagcatgagttcacctgtgaaaagtgcaagtctaaagatatctttttttctatcttgatcataattaaactctctatccaaaactacacctccaaaataaatataataataaagattatatcaaatatttaaacataaatacatgtatttatttagtatatatctacatttaagttaagtttgaatttgctaaatttactaaataaatctaattttgaaaactatttcaaataggaatattaaagatcaaaaatagtatatatatattaggagtttataaacaatagccttatgagtatatatttatttataaagaaaggatgattaaatgtttgaaaatttaaaaaaatttgataaagatatttatgaaagtatggaaagagaattacaaagacaaaaaagaaatatagagttaatagcatcagaaaatattgtatctatggctgttatggaaactatgggaagtcatcttacaaataaatatgcagaaggttattcaggaaaaagatactatggaggatgtgaacatatagatgaagtagaaacattagctatagaaagattaaaaaaaatatttaatgcagaacatgcaaatgttcaacctcattctggagcaaatgcaaatattggggtttattttgctatattaaagccgggagataaagtaatggggatgaatttatctcaaggaggacatttaactcatggttcaccagctaatatatcaggccagtattttaaatttacagagtatggtgtaaatatagaagatggaagaatagattatgatgatataagaaaaaaagctcatgaaataaaacctagattaatagttgcaggggctagtgcttatccaagagaaatagactttagaaaatttagggaaatagcagatgaagtgggagctatgcttatggtagatatggctcatatagctggccttgtggctgcgggacttcatcaaaacccatgtgaggtagcagattttgttacaagtacaactcataaaactttaagaggtcctagagggggtataatactttgtaaaaaagaatacgccaaagctatagataaagctatattcccaggaactcaaggaggaccattagagcatataatagctgcaaaggcagttgcatttaaagaagctttagaacctgagtttaaagaatatcaaaatcaagttgtaaaaaatgctaaaaagctagcagaagaactaataaaaagagattttaaattaattacaggtggaacagataatcatttaatattattagctttaacaaataagaatataactggcaaagaagctgagaaaagattagatgaagcttatataacagctaataaaaatacgataccgtttgatccaaatggagcatttataactagtggtataagattaggcacacctgcagtaactactagagggatgaaagaagaagatatggtagatatagcagaggctatagatttatgtttaacttataataaagaaaaagaagcaagggataaagtagtagaattgacaaataaatatcctttatacaaagagtatgaaatatttaaaaagtagactttatattgtgagatcaaaggggctaagatagtatttaaatcttggccttttttgaggttatagctttattataaaggcatgttttagggttacattaatattactttttctaaaaataaaaaaattaaattaaattttaaaaaagtattgaccatattaaattaaggtggtatagtaatacttgtccttaagaaaagggcaaagacaaaatgaactttgaaaattaaacagtaggttaattataaaaattctttttaaagaattaaacaacaaacaaccaagccagatattcagataatgatagctgagcgatggacaacttttatttgagagtttgatcctggctcaggatgaacgctggcggcgtgcctaacacatttttgttaataagtatactttctatatgcatatattttgagactattagacaaatagatgtatcttgtataactgaattagaagttaaacatagtttaatgttgtcatttttaaattttttaacatttttatcaactatgtctctaattatgttaatgaataatcaaaaccgattaaaagagatacatgaatataataaaaaattagaagatatgacaaaagaaataaaaaaatttagacatgattataaaaatattattttatctatgagtggatatatagaagaaaatgatatggaaggattgagaaaatttttttattcaaatatagaacgttcaacaaaaaatttggatttatacaatctaagtcttgcatcaattggaaatataaaatacatagaagttaaaggggtaatagcttcaaagttaatagaggctcaagaaaaaggaatagatattaaggtgtatattccaaatgttatagaatatataaattttaatagtctagatttatgcaggattttagggattgtattagataattgtatagaagcttctttagaatctgaaaatccattaataactttatcgattatagatgaaaaagatttaacttcaataataattttaaatacatataaaagtaatataaagaatacatctgagttgtttaaaaatggatactcctcaaaaggggaaggacgaggaattggacttagtaatttaaaagaaattttgagtaattataataatgcttattttactataaaagcagaaggggaatttattcaaaaattagacatatataaataaggaggagttagggtgagaatatttatatgtgaggacaatgacgatcaaaggtatagccttgaaaaagctatagtatctattttagaaaatgaaaacataaaaggtgatatagtattatctagtaactcatctaagaaaattatagattatatatcagaaaacaaaggtagaggggtgtactttttagatataaacataggtgaggatatagatggaatcgaattagcaaggcagataaataatatcgataaaagtgcaataattattatgattacatctcataaagatatgagtcatcttgtttttaaatatcacataggtgcaattgattatattattaaagaagattatgaagaagtaaaacatagaataagagaatgtataatatgtgcaaataataaaatgaaagatagcttaaataaagactatttttttattgaaagattagactgtatagataagattaaatatgaagacattctttactttgaaacttgtaaaaaaagatttataggacttaatactactaaaagttacatagagtttaatggaaccctaaaagaactagaaaaaaaattggatgacagatttataagatgtcataagtcttatattgtaaataaaaataaagtaagaaacattaataaaaaacaaagaattattactatggaagatggaagtaaatgttatgtatctttgttgcttttaaaaaagacagttgaaagtattgtatcttaagatactatgatagcttaaatatataaaatagttgacatgtatatgaataagtgtaataattatacacaagagaaggctttaaattatcccgagaggatattaagcaatcttatttataaattaaaaataaaaacttccttgaaagtagtccagagagactagtaaggttatataaatagatttaatttgcatacatataacctctaactggattagttagaggtttttttaatatataaaaaataaaataaagtcttttaaactagtccagagaggctgggaaagatatcgtcataacagaaagttatgaagtattgaatccttatacctctaggtataaggatttttctgatattaggggctttatataaaaaggagagagtaaaatgataaatggaaaagacaaactaattgtagcaattgatactaacgactttgataaagctaaggaattaatagataagttagaagatagtgtagatatatttaaagtagggttagaacaatatgtagcaacaaggggtaaaacagtagattatttaaaagaaaagggtaaaaagatatttttagatcttaagtttcacgatataccaaatacaatgcaaagcgcagtaagagcagcagttagagataacgtttggctaatgacaatacatgtttcagatatggaaggaatgagacaatgtgcattagctgcaaaagaagaagctgaaaagttgggaatagaaaaaccaataatagtaggagttacagtattaacttcattaagtgataaagatttacaagatataggttgtaatatgactgcgggagaattagcaataaaaagagctagattagctaaagaagcaggaatagatggtatagtttgttcagcacaagaggttgataaaatagtagaagcttgtggaagtgaatttgtaacagtttgtccaggaataagacctgaaagtgcggataaaggagaccaaaaaagagttgttactccaaaagaagcgataaataaaggagctcattacttagtagttggaagaccaataactaaggctgaaaatccaagtcaagcagcaacaaatatagtaaaagaaatagaaaatgcctaagggggaggtaagttatgaaagctaagttaatattagaagatggaacgatatttgaaggtaaagcttttggttatttaaatgaaagtgtaggagaagtagtatttaatacctctatgacaggatatggagaggttttaacagatccatcatactatgggcaaatagtaacaatgacttacccactaattgggaattatggaataaatctagaagatgtggaatcaagaggagttcatgtaaaaggatttatagtaagagaaaagagtgataatccaaataactttagatgtgagatggatatagacacatatttaaaacaaaataaagttataggtcttgaaggtatagacactagagcattaactaaaatattaagaaacaatggtactatgaaagggataatcactttagaaaataatgcgacattagaagatgttgtttcaaaaatagataaattctcaaatacagaagcagtaaaaacagtaactagaaaagaaacagaatatataaaggggaatggtccaaaggtagcagttatggactttggagttaaagaaaacatattaagatcttttaaagcaagaggatgtgatttagtagttttaccggcaacaacaacagccgaagaaatactaaatgaaaatccagatttaatattcttatcaaatggacctggagatccagaagatttagaagatgttatagaaaacataagacaattaataggcaaaaaacctatagcaggtatatgtttaggacatcaacttttagccttaacactaggtggaaaaacagcaaggcttaagtttggacatagaggtggaaatcatccagttaaagatttagaagatggaaaagtttatataacatctcaaaatcatgggtactatgtttcacaaatgccagaaaatatgaacataacacatgtaaacttaaacgataacacagtagaaggtatgagacacagtgaattaccaatatatagtgttcaatatcacccagaggcttgtccagggcctaaagacaatgattatatattcgataagttcttagaattaatataatagattgcttaaattaaccagataaggagattaagagtatgcctaaaatagatagtattaaaaagacattagtattagggtcaggacctataataataggtcaagcagcagagtttgattactctggaacacaagcttgtcaggctttaaaagaagagggaatagaagttgttttaataaacagtaacccagctactataatgactgatgaagaggtagcggataaaatatatatagaaccattaacaatagaatttatagaaaaaataatagaaaaagaaagaccagatagtatcttagcaggtatgggaggtcaaacaggacttaacttagcagttgaactttatgattcaggtatacttgataaatataatgtaaaagtattaggaacttctatagaatctataaaaaaaggtgaagacagagatttatttagagaagttatgaaagaaataaaccaaccagtagtagtaagtgatatagtaactaacttagaagatggattagcttttgctaataaaataggatacccagtagtagttagacctgcatatacacttggaggaactggtggaggtatagctgaaacagaagaagaattgatagaaatactttctcaaggattacaattaagtccagtaagtcaagtattactagaaaaaagtataaaaggttggaaagaaatagaatatgaagtaatgagagatggaaacggaaactgtataacggtatgtaacatggaaaacatagatcctgtaggagttcatactggagatagtatagttgttgcacctagtcaaactttaagtgataaagaataccaaatgcttagaaaagcatcgatagatataataaatgccatagaagtcaaaggtggatgtaatgttcagatagctttaaatccgcatagtttagaatatgcaataatagaaataaacccaagagttagtagatcttcagctcttgcatcaaaagctacaggatatccaatagcaaaggttgctgcaaagatagctttaggatatacactagatgaaatacaaaatgcagttacaaagaaaacttatgcatgttttgagccaacacttgattatgtagttgttaaaatacctaagtggccatttgataaatttaagcaagcgaatagaaaattaggtacaaagatgatggctacaggggaaataatgagtataggaagtaactttgaggcagctatacttaaaggtataagatctttagaaataggaaaatactctttagtgcataaagcttctgaaagcagaagtatagagcagttaaaggctagagtagttgttcctgatgatgaaagactatttgaccttgctgaaatgataagaagaggctataaaatagaaatgatagagcaaatcactggagttgataagtggtttataaataaatttaaatggatagtagaacaagaagagaaattaagaggaatgcatatagaagacttaagtaaagactacttattagaacttaagaaaaaaggattctcagataaaggtatagctgacttaatgaaaataagtccagaaaaagtttatgaattaagaaatctatacaatataactccatcgtataaaatggtagatacttgcggaggagaatttgatgcattatctccatactattactcaacttatgaagaatatgatgaagtagtagtaagtgataaaaagaaagttatagtacttggctctggacctataaaaatagggcaaggaatagagtttgattattgttcagttcactgtgttaagtcattaagagcacaaggaatagaaactataataataaataacaacccagaaacagtaagtacagattttgatacatcagataagctatactttgagccattaacagaagaagaagtattaaatataatagaaaaagaaaatccagatggagttatacttcaattcggaggtcaaactgctataaaattagctaagttcttagatgaaaagaaaataaaaattttaggaacaagttgtaaagatatagatgaagcagaagatagagaaaaatttgatgaattattagaaaagttagatataaatagacctaaaggtaaagccatatggtcagtaaatgaaggtatcgaagaagctaagaagttaggatatccagtacttgttagaccttcttatgtacttggtggtcaaggtatggaaataacttatgatgaaaataagttaactcaatatttaacagatgctttcttaagagatagtaaaaaccctgtgcttatagataagtacttaactggtagggaaatagaagtagatgctatatgtgatggagaagatatattaataccagggataatggagcacttagaaagagctggagttcactctggagatagtataactatgtacccaagtcaaaacataagtgatgagataaaagctaaaattttagattatacaaaaaaaattgcattagagttaaatgtattaggaatggtaaatatacaatttatagagttccatggagaactatacataatagaagttaaccctagagcaagtagaacagttccgtatataagtaaggtaagtaaggttcctatagttgatttggctacaaagtgtatgctaggagctaaattaaaagatttaggatatggaacaggagtttataaagaacctaaattagtatctgtaaaagtgccagtattctcaatgtctaaacttgctagagttgatgtaagtctaggtcctgaaatgaaatctacaggagaagttttaggagttggagaaactttagaagaagcactatataaaggattcttagctgctggtaagaagatgtctaacaaaagaggactagtattagctactataaataattatgataaagatgagtttatggaaatagctaaagacatgaatgaattaggatatactttcgtagcaactgaaggaactgcaaaagctttaatagaaaatggaatagatgcagaaatagtaaatagagtagaagaagctagaccaaatatacttgatgttataagaaataaacaagttgatatagttataaatacacctactaaaggaaatgattcaactagagatggatttaaaataagaagaactgctacagagttctcaacagaagtaatgacatcattagatactttaaaggctttagtagaggttaagaagaaagaaataaatagagaaaaattagctgtttataacatagctgattaatagaattattcaattaaaaagtgcctcaaagtgatttttataatcattagaggtactttttttataattttcaattttactccataatataggcatattagtccaaaattattgtttttaataatgttaatgttaatatcataggaaagagaaagtggtaaaatattttcttgttatatattagggaggataaatgatgaaaaataagattttaaaaaaatcaattaatgcattttttgtgttaggattatgtacacttatgggaggtacatcttatgcttgggatggtaaaaaagacggaactggaacacatgcacttattgcagaacatggattaactatgttaaataatgatttaaataaaaatgaaccacaaccagtaaaacaaaacatagaaatattaaacaagtatttaaaagatttaaaattaggttcaacttttccagactatgatcctaatgcatatgatttatatcaggatcatttctttgatccagacacgggaaataacttcacactagataataaatggtatgtagcatcacctatttatgataccgctgaaacacaagtaagaaaatttgctactttagcacaagatgaatggaaaaaaggaaattacaaagaagctacatttttactagggcaaggaatgcattatttaggggacttaaatacaccatatcatgcagctaatgtaactgcagtagatagtcctggtcatgtaaagtatgaaacatttgtagaaaatcgaaaagagaattatgctttaaatacaactggaaatgatacaactcaaggtgtatataaagaggcgttagctaataaggattttgatcaatggatgactcaaaactctgtaaaatatgctaaaaaggcaaaagctttatattatagtcattcgactatgaaacataattgggatgattgggattattcaggaagagaagcagtaaaaaattctcaagtatgtacagcaggttttttatatagatttataaatgaagtttctgaggatcaaatagcaaatagcttatcaaatcagtttaatgtagttttaaaaacagcagataaggaatacgcaggaactgacgataatgtacactttggattcgaaactaaagatggaaataagtatgaatggaatttagataatgcaggaaatgactttgaaagaaatcaaatagataattatatattaaaagtaaaagatgatgtaaaagtcaatacaaatgatataacaaaatactgggttagaaaagaaaatagaacacctataagcgatgactgggaattaagcaacataaaattaatatcaaatgggaacgtaattcttcaaaaggatattaataaagtattttcagggaatgaaatttataatataaaataaataaaaataataaaagccatttatataaaaacttaatttatataaatggcttttatcatagatattgaatttatgcattttgagttggtggtatataagttctttgagctaattcttgatcaatcattaaaagaccagcaggatcattttttagtaatcttaattttcttactatcttttccatactttcttcttcttctgactgttcatcaataaaccatcttaagaaagatgatgtagtatgatctttttcagatattgctaaatcaactaagtcgtggattgagttacttataagtctttcatgttctaaagctgattcaaacacgtctaatggactttcaaagtttatctttggttgttcaattccttgtaaaaccactttacctccagctctacctatgtagttaaatattttatatgcgtggtctctttcttctctagcttgaacgttgaaaaagtttgcaaaaccatctaaattattatctgcaaagtatgcttccattgatatgtagaaatactcagagaaaaattccatttggagctgattgtttaatgcatctaaaactctttgacttgccataaaaaaacctcctaaatttacattaaaatttttactacaatattattatacactagtaataccaaaatttaacaataagaatataaagtatttaaaatactcaaaatatcaagtgataatatggtataatacataaattgagattaaaattctaggaggaaatcaatgttattattagctgataaatggaaagattatgaacttatagatatgggaaatggagaaaaattagaacgttggggaaatattgttttaagaagaccagatcctcaagttatgtggccaatagccaatgaaaaaggattgtggaaaaatcctcatgggcactatcacagaagtagtagaggtggaggtcaatgggaacataaaaagaaatatcctgagagatggacagtaagttataagaacttaaaatttaatataagtccaacaggatttaaacatacaggattattcccggaacaagcggcaaactgggattgggcaatggataaaattaaaaatgcaggaagaccaataaaagtattaaatttatttgcatatactggaggagctactgttgcatgtgcatatgctggagcagaagtatgtcatgtagatgcatctaaaggtatggttacttgggctaaagaaaatttacatacatcaggacttcaagatagaaaagtaagatttatagttgatgatgttgttaagtttgttgaaagagaaataagaagaggaaataaatatgatgctataataatggatccaccttcttatggaagaggtccaaagggagaagtatggcaaatagaagaaaagttatatggtttagttgaattatgtactaaggtattatcagacaatccattatttttcttaataaattcatatacaactggattatctccaataatacttgaacatatattagatgctacagttgctaagcatgctaaaggtggaaaaatatatggtggagaaatagggatacctacatctaaagatggaaaagttcttccttgtggaatatttggaagatgggagtctaaataatgataaaagtcatatatgaagataatcatttattagttgtagaaaaacctgttaatgtattatctcaaggagatgatactaatgataaagatatggttaatttattaaaggactatataaaagttaagtacaataaaccagggaatgtatttataggtcttgttcatagattagatagaccagtaggtggaataatggtttttgcaaaaacttctaaagctgcatctagattatctgaacaagttagaaataaaagttttaagaaaacttatagagccgttttaaatggaaatatgagaaaagatagtgatacattaaaagattatctttacaagaataaaaaaaccaatatggtaagtgtagtaaataaaaatcacaaagatgctaaggatgcagagttaagctataaaacaatagctaaaaatgaaaaatttagcatggttcaagttgatttaaaaacaggtagaccgcatcaaatcagagtacaattttcaagtagaaagcatcctttatttggagatcaaagatatggtcaagatataaataaaaaaggagatcaaatagctctttggtcttataaaatagaaataactcaccctactacaaaagaaaaaatggagtttatatgtgagcctccaaataaatacccatggaatttattcgaggtttaaaatgaataaatatactggtttttatatagataaacctctaggaaacaatatgttttcatataatgagagaaagaataaaaaaatatacgttcctaagcttatacaaggagatttaagtgatgtaaaagtaggaaatgaagtagtgtttagtgaaatagaatttgaagaagaaataaatgctataggtctaaagaatatggttaaatttaactatagagataagactgtatatatttttgacaatcacaatcattctttctatttttggataaaaagccttaaagaaggcttattcaataaagggtgtaagttagttcatatagatcaacataaagacatgagagagccagaaaattatgatgtagatgtagaaaatatagatgatgtttttagatatacaaactacgtattgaatgtagggaattttataaaacctgcattatatcataatattttctcagaggctgtgataatagatagtacttatggcttggaaatggatgtagaaggtgaaatagttttagatatagatttagatattttttcaaaagatatggagtatatgtcttatgatttaagagttaataaaattagagaatatataaaaagatctagtgttataactattgcaagtagcccgtttttcatagaacaagactatgctataaaagtattaaaagaattattcaattgtgatataatataagagttaattatttataaattaaaccatgacttagtcatgaataggaggaaataaaaatgagtttatacactacatggagatcattaagtgaaaatcataatagccaagaagaagaagttaagttttgggaagaatatttaaagaaagaaacagaaatatataatgaaatattaaacgctaaaaaagacgttatagaaggaaaagttagcgatttagctacagcttacaatacatcagtagaatatatgatgggattcatagatggaataagcgaaagtttaaaagaagatttaacagaagaaaaattagaaactatagaagcagatacagaagttaagttagaaatagattgggaaaagttatactacaatatggtagctgtagaagctcattggttatataacttacaaggatggaacaacatattatcagaagataagagaaaagaattacaaaaagctttcaaagctactaaaactgtagttaaggacgaaaagataggaagaaatgaaccttgtccatgtggaagcggtaaaaaatacaaaaaatgttgtggaaaataaggagataacatgtttttactaaaattcattgatgaagatgataatctatctacaaaagaatttaattcgttaagttctttgaaggattacgttaaggataacgacatcgataagacgtggcatcaagtggaagaagtaaaaaaagtaattcctaacctaaaagaagattaaaaaaggagcttaagctccttttttatttatagtattattttaaattagctagatctttagctatttgagcagctactttggcattattgtaaactaactctatattagcatctaaacttttaccagcagtaatagtttttactttatctagtaagaaaggagtaacttttttaccagttatattattctcatcagcctcttttaaagctgattctatagcgctatttatagtatcataatccatttcgaactcttttggtattggatttcctataaccataccaccttttaagtctaaatcccatttagcttttaaggcattagcaacttccatagaagaatctactttataatcaactccaaatccactttttctagtgtagaatgcagggaattcttctgtaccaaatcctacaactggaactccgttagtttctaaatactctagagtaagacctatatctagtatagatttagcaccagcacacacaacagcaacgtttgtattagctaattcttgtaaatctgcagatatatcaaaagtttcttgagcacccctatgtactccacctataccacctgtagcgaatactttaactccagccaagttagctaatatcattgtagtggctactgtagtagctccgtttagtttttttgatataataaaaggtaaatctcttctactagcttttaaaacatccttgctagtgcctagaaactctatttcttcagttgtaagaccaacttttaaaacaccatctattattgctatagtagcaggtattgcaccattttctcttattattttgctaacatttttagccatttctatatttttaggataaggcataccatgagatattatagtagattctaaagcaactactggttgaccttctgataaagctcttttaacctctgggtgtatatgcaagtatttttctaacattagatcatctcctttaatattttttcaacactatcaacagacatacttggattgatagtatttttgtgtagtaatgtaagtattgaagcagctgttgaaaacttagctgtatcagtcaaattgtagttttttaaataactgtaaactaatgctgctataaaggcatctcccgcgcctgtagcactcactatatctactgaaacccctggcagtagtaaagattcatctttattagcacagaatacaccgtcatgtcctagagttataaatacattttgaacccctttatctaaaaagtatttagcacatgtgtgtaaatcatcattgttatttatttttatacctgatagtatttcagcttctaacttattaggttttatagtagtaaatctacctactatatcttttaccttaaggcttttttgtgtagaaacagtatcaataaatataggaatatctttatatgttctacttatataatctataacttcaaatgataagtttgtatctaatatgatagctaaagagtctttaattgaagtatgtttagatactatataatcaatatcgattttttccataacatccatatgagatatagctaattgcatatcatagttattgtttaatatcgataaatacatagaagttggatataaatctgatacataacaatcagaagtatctatatttaactttttgcattctgataatattctatctccatagacatcatttccaacggctgatataagtttcgtatttatacctagtttagaaatattctcacatatatttctacctactcctccaagtgaaatatcaactttacctggattggaatcaaacatagtaagttcatcattaggggatccttgtatatcaacgttagagccacctataacagtgacaaaattacttttacttatgatataaccttttccttttatataaccttttttcattaagttcgttatatgtactgcaacagatgaacgagttatgttaagcatatctgctaaagtttgttgagaaaccatagggtcatctcttaaaatttctaaaatttctttttctctatcagtcattaatatcaccataaattaatatttgcttatacaaataagcatttgttaagaagatgataacatttacataaaacaatttcaatagtaaattttaattttgaattacaaaaattgaacaaattaggcagtataggaacaatattttgtcgactttcataatataaattaagaaaactaatatttgttaggaggacatctatgttatgaagataggagacactgtagtaagaaaatcctacaataaagatattgtttttagaataataggttttgaaatagatgagaataaccaaaaaatagctattctaaagggtgttgcatttagaataattgcggattctagtattgatgacttggaaaaaacaaatttttatgatatgaaaaatgctcttatagataaggatgttgaaaatattttatataagagtataaaaaaaactaaagaaagaaatagaaaattaagtagagctacacaaaaaacttcaaattacccaaaacaagcgcaaattcaaagtcaggtacaaaattcatatggtatgccaggaaaggtacttcatatagatggagatcctgagtatttaaaaatttgtttagatgtttatacaaaattgggcataccagcaattggtaaggcaatacctgaaaatttacaatacaaagaagttagaactttattagaacaacataatccatccatattagtaataacaggtcatgatgcaattgttaataataaaggaagtcttaaagatttaaaaaattatagaaatactgctaattttataaaaactgttagagaggcaagaaagtatgatccatcattagatagcttagttatatttgcaggtgcttgtcaatcaaattatgaagaaataattaaagcaggagcaaattttgcaagttctccaagccgtgtaatgatacatgccttagatccactgttagtagttgaaaaaattgcttgttcaagaatagataaagtagttcccctagaggagattttaagtcataccgtaacaggtattaaaggtgttggtgggatagaaacaagaggtaaattcagacttacaatgcctttatctatatataataactattgacaatgtttcaaattagaggtataaattataaaataaaatttataaaaaaaacagtattgactttttattaaaaaatatataaaataattagtttggtttgacaaaaaaggttaagtgtggtagtatatcattatgtgaacatataatgttaaagaaggtgatataatggccactgttcaaactttgaataaaataagacagactttagagaagcacctaggaaaaaaaattgtattaaaagcaaacaaaggaagaaaacaaatagttactaaaagaggtatattagaaaaagtatatccaagtatatttgttgttaagttagatgatgaggataatggatactctagagtgtcatacagttactcagacctattaactgataacgttaaattgaaagtaattaaagagacaaataaattaaatgtaagctaaaaaattatgcctattaaaaataggtgtaattttttttttgtttcctaaatataaatatagtgtgatatttatatttaatttaggaggggtaacgtatgaatctaataaaagatatattacaagttgacaacaggatagactttggaagatttcaaactttcatagaaacagaggctgttgtatcagataagaaagatgatgtatatgaaattataaaaacagaagggtacatagctttaaagaagcaagaagtattagatggaaagataatatttagaggaaacttcaactacaatgtaatttatttgacagaagataaaaatactgtatcaaatgtagaaggaagaatagagataaatgaagtagtagaaaaagataatatcgttgcagacatggaaaatatgcttttctatgatgtagaacatatagattgtacagttataaatgaaagaaagataagagtaggagcacttttaaatataagaggtagcttatttgaaaaaaatactatagatataataaaagatgtttctcaaatagaagatgttcaaaagcatagaaaagaggttcaatatgaagatatagttggaatagaaaagtcagaaagtgttataagagatactataaatataagtacagaagacatagctaatatagtttcaatagggcctagaataaaattaaaagaaacgagggtatctgataataaggttatagtaggtggggttttagatttaaatcctgtagcttacacttatgaaggagaattggttgaattagatagagttggattagattttactcaatttatagaagtaccaggcgtatctgagggaatgaaggaagaagctatagtagatatagttgatttaaattatgtatttaaaagaaatgaagaagctaatactggagctttagaaattgattgtacagctagagcaaaagttaaagtttcagaagatgttactagagaagtattacaagatgcatattcacctgatagaattttaaaatttgagagtagaaatgtagaacttaataaagttataaatagtggaagtgaattttttaatataagagatacgataaaaagtaatagtgatgatatacaaataaaagatgtagtgagcgttgattcaaacataatagtggaaaattcattctttgaaggaaataaaaatataatagaaggtgtagttcgtgtagatgctttatatactccagtagaaggattaagaccagtatatagactaacagaagaaattccatttactcatgatatagaagttgaaaatataaaggatactacaaatgcatttaataatgtaactatagatagagtagaatttgatttaaatagagaccaaattgatgtaacagtaaaagtgagaagatattgtgaagtattagataaaaagaaagatagttttataataaaaggtgaagatcaaggaccagtagatttatctcaaagaccaagtataactctttatattgctaaggatggagataagttatggaacatagctaaaaaatataatactacgatagacgatatagcagaagtaaatgaaataaaaccagatgatcagttacttacagggcaatgtctaataatagagaaaaaggttaatgtagaataaaaaatatatgcaaaataaaataatagggaattataattccctattattttattttttgtagtataatgtatactgtaaatatttatgaccgttttagcataagtaaggaggtaataatgaactctatagatttaaaaagcagagctaaaataaacctatcaatagatgtgcttgggaaaagagatgatggatatcatatagttgagatgataatgcaaaccatagatttatatgataacttgaagatcactaaaatagaaggtgactttataaaaataaaaagtgatagtgaggatatacctttaaatcaggataatattgtttataaagctgctgatattttaaaaaagagatttaatataaaagatggagtagaaatttctatacaaaaaaatatacctgtggcagcaggaatggctggaggaagctctaatgcagctgcagttttagtaggattaaataaggtttggaatttagggctgagtgaaagtgaacttaaagaaatcggtttacaattaggagcagatgtgccgttttgtataacaggaggaagtgcattagcacaaggtataggggaaaaattaactaacatacatggtttaagtgaaggtgtaaacatattagtatgtaagcctgatatttttgtgtcaactaaagaagtttatcaatctttagatatgaataaagttcaaaaaagaccagaaaatcaaaagcttatagagagtttaaaaaatgatgatataaaatatgtatctgaaaatatggttaatgttttagaagaagttacagcttcaaagtataaagaaataaagcaaatagaagctactatgatgaaaaataaagcattaggatctatgatgagtggaagtggccctacagtttttgggttatttgacaataaagaatatgcaataaaggccaaagaagagctactaatagactataatcaagtatatttagttaatagtagcaacaaaggagttgaaatttatggatagtttaacaaagttaaatctagataactataaacctctacgagatgtagttttcgaaaatttaagggaagctattttagaagggcatttaaagccaggacaaagacttatggaagttcaattagcagaacaattaggggttagtagaacacctgtaagggaagctataagaaaattagagctagaaggtctagtagttatgttgcctagaaaaggagcttatgtagctaatatgtcattaaaagatattattgatgtattagaaataagatcaagcttagaaggactagctgcgtacttagctgcagaaagaatacatgaagatgatgctaagaaattaagagaaatagctgaggattttaagaaaagtatagaaaataaagatgatatagatacattgctaaaaaaagatgtagagtttcatgagtttatattcaatactactaaaaataaaaagttaagccaaattataaattcactttgggaacaagttcatagatttagagctacttatatatcagactttgatacatcatacaatcttgtgcttgaacataataatatattagaagcaattatttctggaaataatgaagatgctaaaaaatatgcaatagaacatatagaaaaagcagaacatttcataatagaaaaagctataaacaataaggacttataaataaaaaagagactgttaaatttaacagtctcttttttatttatatagattaggaataaaactatgtattttggaaataatcaagatattaaaatatattagggggatatatattatgagaaatataaaattaaggatagttggattaagtttattattattatctatacttacaataagtacggtatatatatatggggaagtatctaaagtagagaaagtttctagtaattataaagataaattaataagatttcatgtattagcaaatagtgatagtgaagaagatcaaaaattaaaattaaaagttagagatgaagtaataaaatatttacaaccattgttaaaagaatctaatagtataaaagaaagtgaaaagataatactatcagagggtgaaaacatcaaacgaatatctaaaaatattatttcgaaaaatggttatacttatgaagtaaaggtaaatcttgaatatagtaaatttcctgcaaagcaatattcaaatatagttttacctgctggagaatataaagctttaagaattattataggagatggggaaggtaaaaattggtggtgtgttatgtttccaccactatgttttgtggatgagaataatggtgttatagataaagaaacagataaaaagttaaaaaatgtattaactgaagaagaatacaaattaatatctgggaaaaatgcagataaagcttctaataaaaaactaaaatttaaaatactagagatattaaaatcttttagtaaaaatagtaagtaatattttaaaaggagtgaattatataatatgaaataccacaccaaactttttttagtagtttttactttattatttgctagcactaacttaaataatatatttgctgaaaatgaaattaaagaaagttataaagattatgataaaaaaatagtaaatgagagagaatctgaaaaggggtctaaagaagttataagcattacaaatgatgagctatatttactatctaagttggtatctagtgaagctagaggtgaaagttatgagggacaagttgctgttgctgcagtcgttataaatagagttttagactcaaggttccctaacaatataaaagatgttatatatcaaaaaaatgccttttcagtagtaaataatggagaaatatataaaaaccctacagacagtgcatataaggctgctagagaagctttatatggaaaagatcctactagtggagctatatatttttggaatccagaaattgcaacctgcagttggattaaaacactagatccatataaaagaataggtaatcatgtgtttgcaaaataattaaatattaaaaaataaaggagtttatactcctttattttttttgtcaaatgcactataataatcacttagataataaaaacgcatataattataaaaaaatataagtgagatagaagggtgagcgagatggaaaaattaagtgtagcattaattttcggtggaaaatctggggaacatgatgtttctagagtttcagcttcatctatatttaagcatataaataaagaaaaatacgatgttcatacaataggtataacaaaagatggaaattggatttattataacggttcatcagaagatatggctaatggtaattgggaaagtttagcgaataatgatgttaaaataaatttgatacctaatgggaattctaaagttggtctagagtttaaagatggaagttttaaaaagatagatgttttattccctgttttacatggaccatatggagaagatggtaagatacaaggtgtatttgaaataagtaatataccttatgttggatgtggagttttagcatctagtgttggtatggataaacttatatgcaaaaaaatattttcacaaataggactgccacaagtaaattacacttatacgaataagtgggaatttaatttaaataaagaaaaagaattagataaaattgaaagtgaattaaactatcctgtattcgttaagcctgctaacatgggttcgagtgtaggaatatctaaagtttgtaatagagaagagcttttaaaaggtataaatgaagctttaaagcatgatacaagaatagttttagaacaaggtataaatgctagagaaatagaagtagctgttttaggtaatgatgatgtaaaagcatctatagctggagagataatacctgcaaaagatttttatgactatgaagataaatatgtaaatggagcttctaaattagaaataccagcaaaagtagacgaaacaacaatggaaagtataagaaatatggcaataaatgcatttaaaggaatagatggtagtggactttctagggtagacttttttatagataaagaaacagatgaaatatatataaatgaaataaatacattaccaggattcactaatataagcatgtacccaaaactttgggatgctacaggaattcaatatactgaccttatagacaaattaatacaattagccattgaaggtaaataataaagaaggtgtatattatatgaataataatccgattggagtttttgactcaggactaggtgggcttacagttttaaaagaaataactagtatactacctaacgaaaatatagtgtattttggggatactgcaagagttccttatggatcaagatctaaagagacagttataaaatacacttttcaagctataaattttttaatatctaaaaatgttaaggctatagtaatagcttgtaatacagctacagcaagaactttagctttagctcaggaaaagtatgatattcctataataggagttatagaagctggagctagaacagctgcatataccactaaaaacaagttagtgggggttataggaacggaaggaactataaattctaaagcttatgaaaaagaaataaataagttagatagtgaaataaaaatcataggtaaagcatgtccactatttgtaccgatagttgaggaaggttgggcagatacagaagtagctagattaactgctaaaaaatatttagaagagttacagtcatcaaatatagactctttagttttaggatgtactcactaccctcttttaacaaatacaattaataaagttgttgaaggtaaaattaaacttgttaatccagcaagagaaacagcaaaagacttaaaagatgtactaactaaaaataacttattggctgaaaattcttcagaccaaccttattacaaatattatgtgtctgatataccagaaagatttgcaacaataggaagagaatttttaaatacagaaatagaggacataaatcagatcgaaatacaaaagtattaaaaatatataaactttaggaaaaattccctaaagtttatattattatggaggttaaaaatgatagatgttaacatatctatgaataccaagcaatatgatagtttaggaaatgaagattgtatagaggttgtatcagtaggaaatatgtatgaaaaaaatggagatacatatattgtttataaagaagaattagaaaagggagcagttcatgttacaaccactataaaaatatcagagaaagagattttgataaaaagatttggagtagttaactctaatatgagatttattttgggaaaagaaacttttactaactataaaactcctcaaggtctatttaatataaagataaacactaataaattaaatgtagaaaaaacagatgagacaatagagatagatataaattataatatggagattgtaggattatttgagggtgtaaataaaatacgaatagaagttagaaaaaagaattaaaaaagagctgactatatatttaattattattagtcagctttttaaactttattaaatttaaattagtaaagagctttattccaccaattcatagaaggttgatcttgatttataggtttacagtcaaaattattttctttaagatgacataatatataaggcaatgattttactgtaatttgtttatcatgaaacagtataataggagtatggtaattatttaattcttttaaagtatttgatactattgaagatgtagtacaacctttatgagtatctgtgctatctatattccaatcccaaactttataaccataatttattagactattatactgaattgcagttaaatgtggcttacttccataaggaactctaactaattttatattataacctattaaatcttttagagtatgatttgtgctattcatttcatttaaagcagatgaattattagcataaaaaacagttttttcatgactttgtccatgtaagcctatagaatgaccttcgtttaaaattctttttactatctcaggataagcattaattctatcttctaataagaaaaatgttgctttcatgtcatattttttcaataaatccaatatttttggtgtatatttgtttggtccatcatcaaaagtaatataagctactttacttttggatataggactttgaaaacaataactgttggttgtcataaatgaaataaatatagacaacataactaaggttgatataaattttttcatattagatgctccttgtttataaattttaaaaattatattttatattgttattgtatgatattatttaaaatatatttaggataaagtaattttgtataactaaaattaaatgtatataaaaaactatccctagattaatttatttggtattatattacttgataaggttataaaaataaaataatttatacaaggatttgagaagtttttatagaaagtatacttgagttaaaaaactaagtgtaagaggtatagtttatgatagtagatagagtacgaagtactataaataaatataatttattacaaaaaggcgataaagttgtattaggtttatctggaggtcctgattcagtatgtttattacatatactaaaacagcttgaaaatgagtatgatatatctatatatgcagctcatttaaatcaccagataaggggtatagaggctcaaaaagatgtaatgtatatatctaatttatgtgatagtttaggagttaagcttttcgttaaatcaataaatgtcccagcatactgtaaagaaaatagcttatcaattgaagaaggtgcaagaaaattaagatatgaaatgttttatgaaataaaacaaaagactaaatcaaataaaattgcaattggacataatttaaatgatcaagcagaaactattcttatgaggcttatgagaggtacaggattacagggattaaaaggtatagaatataaaagagatgacactataataagacctattcttgatatagaaagaagcagtatagaaaaatattgtgacgaatataatttaaacccaagaatagatagtacaaatttagaaaatatatatactagaaataaaatcagattagatttaattccatatatgcaagaaaattttaatgctaatgtgattgaatctatatgtagaatgggtaataatttaaagctagatagtgattatattgaacaagagggtataaataaattcaacgaggtaactaaatcgagtgatgatgaaaatatagaaatcttactagataaatatactaacttgcataaagcaataaaaactagaataattagaaattctattaagtatattttaggagatactaatttcgtagatcaaaaacacatagaagatatactagatttagaggatgataataaaataaataaaaagttagtgttacctagaggtttatttgtttatagaaatagtaatagcatattatttactaacaaagaaataacttatgatgaaatagagttttcttataaacttcctaaagaaggtatgataaaggtaaaagaattaggattgtttatagaaactcaagtaatgagtattgaaagatttaacagtatgaaggttgataaatcctctaaaggatttgatttagataaatttaaaggagggataattgtaagaaatagagaatctggggataaaattaaacttactggaggaagtaagaaattaaagaatttattcatagatttaaaaataccaagagaggaaagaagcaaaattcctgtattggtggatgataatgaagttgtttgtgttggagattataaaatcagtgaaaattataaaattaatgcaaatacaaaagaagtcttaaagattacctttaagaaactataaattaaaacaacttacgaaaggagggcttcttttgaataaatttttaaagggagcaggtttttatctacttatatttatcattatagtaggtatagtacagttctcaggtagttctacagacaaagtagaagaaatgaagttttcaagcgtctatagagaattaatgaaagaaaatatatctagtataaagattgtagaagacacagttctagaaggaactataaagagtactaacaaaaagtttaaaacatacataccagaagaaattcagtctcaacaacttgcaaatgagttattaaagcaagctgacgaaggtaaattacagttaacaggagcaccaaaaccaactacaccatggttcttcgaaatattaccatcattatttatgctgttctttgtattaatattatggtttgttttcatgaatcagtctcaaggtggaggcggaaaagttatgaactttggtaaatctaaagctaaggttcataaagatgatgaaaaaacaagagttacatttaaagatgtagctggacttaatgaggaaaaagaagacttacaagaagttgttgacttcttgaaaaatccaaagaaatatatagatttaggagctagaattcctaaaggtatattaatggttggacctccaggaacagggaaaacatatttatcaagagcagttgcaggagaagcgggagtacctttctttagtataagtggttcagatttcgttgaaatgttcgttggggtaggggcttcaagagttagatctttatttgaagatgctaaaaagaatgctccagctataatatttatagacgagatagatgcagttggtagaaaaagaggagcaggtcttggtggaggacacgacgaaagagagcaaactcttaaccagttattagttgagatggatggtttcggtgttaaccaaggtataataataatggctgctacaaacagaccagatatattagacccagcccttttaagaccaggtagatttgacagacaggtagttgtaggagctccagatgttaaaggtagagaggctatatttaaagttcattctaagaataagccactagaagatgatgttaaagttgaagtattagcgagaagaactcctggatttactccagctgatatagaaaacttaatgaacgaagctgcaatacttacagctagaaaaagagaaaagaaaataaaaatggaaactatagaagaagctataactaaggtaatagcaggtgttgctaaaaaatctagagttataagtgaacctgaaagaaaacttacagcttaccatgaagcagggcatgcagtttgtgctcatgtacttgagcatgtaagtccagttcatcaagtaacaatagttccaagaggtagagctggaggatttacaatgcaacttccagtagaagataaattctatgctactaagaatgaaatgaaagaaaatataattgttttacttggtggtagagttgcagaagaattaactttagatgatatatctacaggagcttcaaatgacttagaaagagtttctgctactgctagacaaatggttactaagtatggaatgagttctaaattagggcctatgacttttggtgacagtgaagaagaagtattcttaggtaatagtataggaagtaagagaaactattctgaagaggttgcatttgaaatagataatgagataaaagatatagttgatgtagcttacaagaaaactaagaaattacttcaagataatatggatagattagagtatgtagctcaagctctattagtatatgagactttagatgcagatcaatttataaaagcatttaataaagagttacctttagatgttaaatcagaaaacgcaacaacagaagaagttgttgatacaaaagaggaaaaaatagatttatcaaaagatataaataaagatcaaaatgatgatcaaataaatgattaataaaaaatcaaaggctagggtttaccctagcctttagtttaattattattaaggcagaggtgttattgttgagagaaaaagttattaatatattgctagataatagtttggggtttatatcaggggaagaaatatctaaacaattaggtatatctagaaccgctgtatggaaacatgtaaaagctttaaaagaacaaggttatgatatagaatctgtaaacagaaaaggttacagattaaaagagatacctaatgatattcttagtaaagaaaatattatgcatgaaataaaaactgaatttattggaaaagatataattcattttgattctatagattcaacaaataattatgctaaaagtgttaccattgataaaaaaaatggaacaataattataagtgaagaacaagtaaatggtagaggtagactgggaagacaatggcactctaaaaaatatgatggaatatggatgagtattatattaaaacctgatatacttcctatggatgcgccatttataacattaatcgctggagcaagtatagtaaaagctcttaataacttagggatagatgcaagtataaaatggccaaatgatgtaatcataaatggaaaaaaagtatgtggtatattaacagaactatcagctgaaattgaaagagtaaattatataattttagggataggcataaatgttaaaacattagatttttctgaggatatagttaatattgcgacatcaattcaaaaggaagggtataatatatctagagtagaagtaattagaagtttcatattggaatttgaaaaaaattatatagattatatatatcataatgataagagtaaaactttagatatttgtagaaaacactctgcaattataggacataatatatatactataaaaaatgataaaaaagaaaaagttaaatgtattgatataaatcaagatggaaatttagttatagaagatgaaaaaggaaatagaaaagaaattatatctggagaagtatctataagaggagagcatggatatgtataataatattttagatgttaaagggattaaagtaggacaagtacaacaaatggaaggcttaactgggtgtagtgttattatatgcgaagaaggtgcagtatgtggggttgatgttaggggttcagcacctgggacaagagaaactgatttgttagatcctattaacatgattcaaaaagtgcatgctgtagtattatctggtggttctgcatttggattagaagctacatgtggtgtaagtaaatatttagaagaaaatgggataggatttgatgttggagttgcaaaggtacctattgtaactggggcagtattatttgacttaggagttggagatccaaaatgtagaccaaatattgatatgggatatgaagcttgtaaggtagctagttctacaaatcttgagcaaggtaattttggtgcagggtgtggagctactgttggaaaaataaaaggtagtaatttctgtactaaaggtggaataggaagttactcgattaagttagataatggattagttgtagctgcattaatagctgtaaatgcttttggagatgtatatgaagaagggaaagtaatagctggagttttgaatgatagtaaagatgaatttttaaatacttacgatcttatgaaacaaggtgtgaacaaaggtggatttaatatagataatacgactataggagtcgtggctactaatgctaagttggacaaagctcagtgtaaaaaagtatctcagatggcacataatggatttgcaaaaacaatatttccgatacatactccacatgatggagatactatatttacattagcaactggtgaggttgaaacggatgtaacgttgctaggttccttggctacagaggtagttgaaaagagtataataaatgcgattaaaaatgcaaaatcaattaataatataccctcatacaatgaaattaatttaaaataagaattattgacaatgttattacctattgataaaattgtttttgttgcagctggcatccttataaattaggagcctgactgattatgatatagataaataacaactaaaaattttaatgaaaagtccggcatcttttaagagctggaacggaggtgtattttagaaatgaaaacacaagtaggagtagagaaaaaaattaatgttaggcaaatggctataataggtatgttatcagctatatctataatgttatctatgacgccactaggatttataccgattggacctgttaatgcaactataatgcatataccagttataatcggatctataattgaagggcctatggttgggggaatattaggattaatatttgggctaactagttttatgagagccataactacgccaagtccaactaattttatgtttatgaacccgatagtttcgatacttccaagagttttaatgggtattgctacatattacatttataaaagtgtatttaaattaactaaaaatctttctgtttcagggttatgctctggttttttaggttcgattataaatacatttggagttttagggcttgtatatttactgtatgcacaaagatatgtagaagctataggaggagatacatctacagctggagctgtaatattaggaattgctgctactaatggtatacctgaagctattgttggagctttagttgtatctggagttgtaattatactaaagaaaagcaaaaaatagaaagaaggttagattagatgcttttagtatttgacgttggaaataccaacatggtattaggtatatatgagggaaaagagctaaaaaagtattggagaattagtactgataaagcaaaaacatcagatgaatatgggatgctgataaataatttatttcaatatgataatgtagacataaaatcaataaaagatgtgataatatcatcagttgtacctaatgttatgcattctcttgagaatttttgtataaaatatttcaacaaacaaccattagtagttgggcctggaataaaaacaggattaaatattaaatatgataatcctaagcaagttggggcagatagaatagtaaatgccgttgctgcaatagaaaagtataaagcacctatgataataatcgattttggaacagctacaactttttgtgctatatcagcaaaaggtgactatttaggaggaactatagcacctggtataaaaatatcaagtgaagctttattccaaagagcatcaaaacttcctagagtagaacttttaaagcctggaatgacgatttgtaaaagtacagtttcggctatgcaatctgggataatatatggatatgtaggtttagtagataaaattgtaaagatgatgaaggaagaattaggaaatgaagatgtgaaagtagtcgctacaggaggactatcatcattaatagcatctgagactaatagtatagattgtgtagataagttcttaactttagaaggattaagaataatctatgataaaaataaagaatagtaacaaggaattggatattaaatccagttccttttttatgataagatattataggaaaatgggtatagatataagtaaaactttaaaagaggagactatatatgaaaataggaaatgttacactagacaataaggtatttttatctcctatggcaggagtaacagatttaccatttagattaatatgtaaagaacaagattgtggtatgttatatacagaaatgattaatgcaaaagccctttgctatgatgataagaatactaaaaaaatgttaaagatagagaatgaagaacatcctgttgctgttcaaatttttggttcagatccagaatttatgggaggagccgcagaaatattaaatgaatatccaaatgaaatattggatataaatatgggatgtccagctcctaaggttgtaaaaaatggagacggatctgctcttatgaaaaatcctaaattagctgaagaagtattaaaatctgttgttaaaaaatctaaaaagcctgttactttaaaaataagaaaaggctgggatgataatagtgtgaatgctgttgaaattgcaaaaattgcagaagcgtcaggtataagtgcattagctatacatggaagaacgagagaacaatattattcaggaaaagctgattgggatataatagctgaaataaagaaaaatataaatatacctgtaattggtaatggtgatgtatttgaagtagaagatgctataaatatgataaataaaactaattgcgatgcaataatgataggtagaggtgctcaaggtaatccatggatatttaaaagaataaatcattatatgaaaacaggagaaatattaccagagcctacttgcgaagaaagaataaatacagctttaaagcatttaaaattagcagtagaggaacatggagagtatgttgctgtaagagagatgagaaaacatattgcatggtacctaaaaggtcttagaggatcagctagattaagagatgaaattaacaagatagaaagctgtgaagaagttgtaaacaagctaagtgactacctggaccactccttgacataaggatgatagtaatttataatatagcgcataaatgcttaagatataaaataagttttgtttaattttaaataataattaagagaaggagttgtaggggttatggaagataataaggaaatattattaactcaagaaggttaccaaaagttagaggacgaggtagagtatctaaagtcagttagaagaagagaagttgctgaaagaataaagatagctatatcttttggagatatatcagaaaatgctgagtatgatgaagctaaaaatgaacaagctcaagttgaagaaagaataataaagcttgaaaacatgctaagaaaagcagttataatagatgagtctaagatagattcaaatatagtaactataggatctatagttaaggttaatgatatggaatttgaagaagaggtagaatatacaatagttggttctgctgaagctgatccatatgaaggtaaaatatctaatgaatcacctgtagggaaagctcttttaggtagagcaaaaggagaaatagtagatgttcaagttcctgacgggattgctaagttcgagatattagaaataagaagataatctggaggtatacaaatgaataatgatcaacaacatgctaatgatcaagcaaaagaagaacttactgaagtgcttaaagtaagaagagataaattagctaagttacaagagatgggaagaaatccattccacgtaagtagatatgatagaactaattactctacagatataaaaaataattttgaagcttttgaaggaaaagttgtaaaattagctggacgtataatgagtaaaagaatccaaggtaaagctggatttatagatatacaagaccaagaaggtagaattcaatgttatgtaagattagatagaatcggtgaagaagagtatgctgtcttttctacatatgatataggtgacataataggtgttgaaggtgaagtattcaaaactaaaaaagaagagatatctataaaagctaacgatgtaaaattattaacaaaatctcttcaagtacttccagaaaagtatcatggactaaaagaccaagatttaagatatagacaaagatatgttgatttaatagttaatccagaagtaaaaaatgctttcgttacaagaactaaagctatgaaagctttaagatcttatttagacgaaagaggattcttagaagttgagactcctatattaaatactatagctggtggagctaatgctagaccatttataactcaccataatactttagacatacctatgtacttaagaatagctaacgagctatatttaaagagacttatagtaggtggatttgataaagtttatgaaatgggtagaatgttcagaaatgaaggtatgtctataaagcataacccagaatacacagctgtagaattataccaagcatatgcagattatactgatatgatggaaatagcagagaatatgatagcttacatggcagaagctgctactggaagtatgaagataaactatcaaggaactgaaatagacttcactcctccatggagaagaatgactatggaagaatgtgttaaggaatatgctggagtagatttctctactattaacacagatgaagaagctttagctgtagctaaggaaaaaggtatagaaataactcctggaatgagaagaggagaagttataaatgctttatttgaagagtttggtgaagataaattaatccaacctacatttataactcatcatccagttgaagtatctccgttagctaagagaaatgtggaagatccaagaaaaactgacagatttgaagctttcgcaaataaatgggaattagcaaatgctttctcagaacttaatgacccaatagatcaaaaagaaagatttatggaccaattaagaaagaaagaattaggagatgacgaagcttgtgatatggatgaggacttcgtaaatgctttagaggtaggtttaccaccgacaggtggtctaggaataggtatagatagagttatgatgttattaactaactctccatctataagagacgttatattattccctacaatgaaacctataaaagaaacttctaatgatgaaatagaagaataatataaataaagacctttctgattttaaaatcagaaaggtttttttattattaattcaacattaaaattataataatgatacaaaaatatgtagtttaaaattaaatgttggggtaaggtgataaataaaaatataaaaacaaaatgtatggggaaaaataaagagaggaagtgtgaataaaaaatagaaatctataataaataaaaatattgggggtaattaaatgaaaaatttaataaattggatgtgtttaatttctataatgattttagttttacaagttatgatttatatgaatagtgaagttataagtgattataacaaaattaatagaaaaagaaagttagtaaagaaaaagaatgtaagtattgaaaatactagatttgcagagtatgaaaattattatacacaaaaaattgcaaaataaaataaaaaagttttaaaaaagtattgacgttattaaaatgaggtggtatagtattacttgtccttgagaaaagggcaaacgaaataacaaaaaagagttgacaagaaagaaaaaacttgttaaactaatgaagttgttaaatgaactttgaaaattaaacagtaggttaattataaaaattctttttaaagaattaatttcaaataattcttttattgaaaattgtactaattgtaccattaaaaaacttaataatattatttgtatcataatttaaatactcatagtaggatatttaaattattaacaaactcaataaattatagtcctattatagtttaaaataataacctataagcatacagcccataggttatttcttataaaaatgtttttatataaaaatctattatctgattaccatataacatcgatattactgttgctaatgatatgaaaggtccaaatggaatcatagaattaaatctcttattttttattttattataaactataaatattatcccatatgctcctccaatatatatgctaagtaacaaggtcagtaacgataactttgttcctagaaataaccctatcattacaaatagttttataccttcgccacctattacttctttctttaatatatattctatgattaaggtcagtactaataatcctccacctgtaaatatagatccctttattgcatcaataaacggtattccataccctaaaaaattcactaacaatgcagttatgcttcctattagaactaatatatctggtattatgtaacaatctaaatctataaaagtaattattataagtaatgatgttaaaaacatataatatattgtaataaatttatattcaaaagttatatatataagtgtaaatagtattccagttataatttctactattgtatatcttggtgatattttttctttacaatatctacattttccttttaagaaaccccaactaagaataggaactaaatctatgggctttaatcttgtattacatctatagcaatgcgatggcggattaattattgattgcttattaggtatacgatatatgcatacattataaaaactcccaaatattactcccattataaataccagtactgtaaaatacatgtccattaatatacaccaccaattaatctattagtatattcaaagtcactacacctacttaatacactttcccttgatatcttaccctgcctaaataaattaacaagttcttgatccattgatttcatacctagttttgcacccgtttgtatcatgtttggtatctgatatgtttttgattctcttattaagtttcttatagctggcgtagtaatcattacctcaactgcgacaactctatttcttccatctatagtaggtataagttgttgtgaaattacaccttcacatacagtcgataattgagtttttatctgttgctgttgatccgtaggaaacatatcaactattctatctatagttttgacagcacctacagtatgtagagttgaaaatactaaatgtccagtctcagctgcagttaatgctatagatacagtttctggatccctcatttctcctataagaatcacatctggatcttggcgaagaatcgatttcaatgccgtattaaaactttcagtatcatttccaatttctctttgtgatattatactagttttatgataatgcacatattctattggatcttccaaagttattatatgtttttgttgcttttcgtttattatatctattaagcttgctaaagttgtacttttaccacttccagtaggtcctgtaactaatactaatcctttttctttttcgataaatttacttattacttctggtaatcctaatgttttaaaagatgggatttcagatgttattgttcttattgctattgcataatttcctttttgtttatatgcatttaccctaaatctctctccattttctattgccacggaaaagtcacactctccttgttttttaagtctttcaaaatttttttgtcctgccaattcttttaccatttcttttgtatcttcttttgtaagtagtttatctgataatttaacaaacttcccttttgttctagctatgggttcacaatctgttgttatatgtatatctgatgcccctaactcaacagctatttttaacacactaaaaattcccataaaaattctcctttttcaaactactatttatagtaatttgttttcccaaacatatatttaccctatttaaaagatttgttgttttttctaaatgttttactgctttatcttcattttgatttataaattcttgatctcttaaatcctcttttatactcacttgttgaattattattttataaattaagttatttatatctgttgaaatatcctgatcataggcaattttatattaaatattttcatgcataccatataaattggatttatttaatgtattattatttttagattgctctatgagtatttttataagttatttagccctaggtagattattttcttttaattcacaactccttaaaatttcattcaaattcttatcaggcatctgtatttacttatttataatttaaaattctaataaattggcttttatatctgttaatcctctataaacaatactttggttcacttcatattttaatttattatcagaatcttaagtagattgattcccattattacagatacttgttttgataaaaaatcacatactcattcttaaatatttccttggacattataatcagcctttattacattttgagtatttttagtattcttaatttgacttagaatctatttgaaaagtattaaaataataatatgatactagctaatattattattttaatagctagtatcattgcagagtcgtttttacttgttagtttattcttgactttcatatcttagactctctccttaacaagtacttttgtacttaatgctcacaacccttttgctaaaatctaatataaacttaactaccatatctatatagtataaataaagatattttacttattgcttatttttgtattttctatatctcatatttaactatatttaggtgaattatatgtaccagcttattgtaatttaattttttctacttttatttatttagttaaatgttcagtttcattttttaatatatcaatagcatgtatatcttttttatttttagcatttcctatattattcatattaactatcatacaaaattccatactaactaaagatacaataaaaagcgaaattaatacttcaataaaagtaaatcctttattatttaacttaatatataatacatatagtttgttgtactaataaaagaatcaaatttacctgaattccaattatttggattttctgtttcaatttttaaattagacaatgagacatatacattataaatttaaatatagctgttaaatttccttttagtttattttcttttttaggatttaatctttggtttaactgttgtttgtcagaactcttattatttaattcattctttataaatacttccatattaaaattttgaatttgtgtaacattttttattattctagataatacatcatttttcttatatatctatagtttcatctaacttgcagcgttgttggaatcacataaaaatttttgtatttcacaaaagattcaacattgtaatttaaaagttctattccattttgctcataatattagataattcaactaaaaacattgcctcttgtatatcatatgatagcttttgacttttatcacttacttctttttttaaattatataattcatcattattagctttgattttgcaatatttaaattattatttactttgttaaactaggtgaattcaaaataaattataaggtatccacagataataaatcctaatagtaatcaaactaatatagttatatttttaatatttattttcatcctttttatagtttcaagttttgcatgtttaaattaaattcacatataaactgtcctacgtttcttgtggaacctgaaatttattctattgttactaaatttgttttttgttctttacctttttctttttcattcttattgtttctttgaacaagcctttcaccataacttacatatatgtcaaaaagattctcaataccttttactatttcacttgaaaaagccactctaaaggtatttatcaagtctttattataagtaaacttatctatagttactatcttatctactgatttatcaaaatttctagatgaataataattcataaaaacattaacttttcctacaatatatcaactatcgttccataatagcctatatatactattatctttaaaaaacttaaatataatgtatctatagtatcaataacttcattatttaatttaaatttaaaacttatataatctgatctacttcattattataaattactgctaatatcagctctaaatatttaattccttcttcatcttcagttgtaacttcatataaaaatatctggctaatctatggctaaagacattatttcattaatttctatattcataaaaccttgtaaatctttttataacctttaggtattttatttgacttttatataacttctttagtatttaaccataaaattatgtttttactttcaaagcatcctctcattaaagcttgtctcagtaattcatagttctctaaatcataatctatatttatatctaagcaatacaaataaaaagagacctataaaaggtctcttttttacacgcatatttagttaaataatttacttactgactcgttagcaaatattttctttatagcatctccaaataaaggagctactgtttttatttttattttgtctatcttcttttcttcaggaagttgtatagtatcaagtactattaattcgcttatagctgaattctctattctttctatagctggacctgataaaactccatgagtacaacatgcataaacatctttagcaccaaactctttaagagcatttgcagcattaactattgttccagcagtatctatcatgtcatctagtaatataacatttttaccttcaacctcacctattatgttcataacttcacatacgttagcttttggtcttctcttgtctattatagctattggaacatctccatttaagtcattagcaaattttctagatcttgtaacacttcctaagtcaggtgaaactactactaaatcttcaatgtttttagtattgaaataatctgctaatatttttccaccttgtaagtgatctagtggtatatcaaagtatccttgtatttgagctgcatgtaaatccattgttaaaactctgtctgctcctgctgcagttattaagttagcaactaatttagctgtgattggatctctagccttagcctttctgtcttgtcttgcatatccatagtatggtataacagcagttactcttcctgcagatgctcttcttaatgcatctatcattattaataattccattaaattatcatttactggactattagttgattgtattacgaagacatcacatcctcttactgtttcacttatatttacagatatttcgccatcactaaatgtgccaacttcacacttagccattggtacacctatgtaatcagctactttttgagctaactctttcgacgcatttcctgcaattattttaatttcgcttccgctagtattcataattacctcccgaaaattttgttaaagaaaatatttatatttaaacgtaaatatagccaaaagctatatttacgttaaagtctaacttaaaaaattatttattttttttattctttttctctacccagccttcttttactacttgtctttctctagctactgctaaagctccagctggtacatcatgagttattgtcgaccctgtcgcaacatatccattttcttctactgtaactggagcaactaagtttgaattagatcctataaatgccccatcttttactactgatttaaatttattttttccatcgtagtttacaaatacagttccacaccctatattaacattctttcctacatgagcatctccaatgtaagttagatgtgatgctttagaattatcttctatagtcgcgtttttaacttctacaaagtctcctattttaacattgtttcctatattactttttggtcttaagtatgcatacggacctactttagtattattacctactttactatctattatagtagaactttctacctctgtatcatcacctattgttgaatttgatatacatgaattcatacctataacacaattacttcctataacagtgtttccttttagcatagctccaggatatattattgtatcatttcctatttttacatcagcttctatatatgtgtgatttacatctattatagttacaccattaaccatgtgcatagtatttatttttcttctcattatttcttctgctttggctaattctactcttgagttaacacccattaattcttctattgtagcaccattaaatgctccaacttttaatgaattctctctcattatctctattgtatcagttaaataatactctccttgagcattattattgtttatctttgataaagcttcttttaaactttttccattgaaacagtatatacctgagtttatttcatttactaatttttcttcttcattagcatctttttgctctactatctttaataaatcttcattttcatctcttattattcttccatatccagttgggttatctacctttgttgttaaaacagttgcatgatatccattatctaaatgatatttaaataaattttctagtgtatctgaatttactaaaggagtatcaccacataatacaactatagtatcattttctgatatatgttctttagccatcataactgcatgacctgttcctaattgttcagtttgcatagctatcttagtttcttcaggtaatacaccttgaactacttcactttcatgacccaagattgcaactatttcactaacacctgaatttttagatacatttataacatggtttaccatttctcttccacacactttgtgtactacctttggtaaacttgacttcattcttgttccttttcctgctgctaggattatagctttaaaattcataaacccactccatttcaacttttttaattattttagtaatctattttataatatgttagtctatttattttgtatacaatttgtcaattacaataactaatataccatttttgtgtaaaaaagtacatattattcaaataaaaaagagcctggaattcggctcttcaagaaatatattaaaaatatattatgttttttattcagcagctacttctaattgagatactgcttcatgataagcttttaatacttcatcttctagcatttgtctcatttcagcatttataggatgagctatatctctgaagtttccttctcctatttttctacttggcatagctatgaataatccattatgtccctctataacctttatatcatgtactacaaataaattatcgaaagttaatgaaactatacatttcattttcccctcgtcagttaattttctcactctcacgtcagtaattttcattttactaatatcccccttttgtgtttgacaaatttaattaaaaaaactgaaactgttttataatatattaattctatcaactcgttaaatttcctctattattttagaaattttttattatttttttactttttttttatttgatagaaatttgccctcaaaacttgtcttatccttctaaatcatccataatgctttcttcttctacaatttcatttatatctttagtagtccagtattcttctctaaatgtttgtaaatttggctcaacactcactacttcattattaattacatctatttgaattaaagatatataatcatcaaccattttcttaattgggttagttgtagatataaatactccctttcctataacttcagctccgaactcattcataagttctatcataccttttatagttcctccacctctcataaagtcatctattaatataactttacttccaggcttaacagcttttctaggtaaactcatactttctacttttgaactatttccacttacatatgtcatgctaagtgttggaccttctgatacttttgtgtcttttcttattataactaaaggtaagttcatggcttttgctgtcataagtgccataggtataccttttgtttccatagtaacaacataatcagcttgtgaataatctatatttgatgcaaatattttacctattttagatgctattctagggtcatatattaaatctatcagatataaaaatcctccagaaagaattctagatgggtcttttatttcttcacataggtttaataaaaactcttcattttctgctttagatgttttaggtatatatttaactccaccagctgcacctgatatcgttatcacttgtcctaactcaagtttttcaaaaacatttttaacaactattaaatcttcacttattgtagactttgctgagttaaatttagatgtgaagtagcttaatgtaaatattttattaggattatcagataatattttaactattgcacctatacgctccgtccttttaaatttcatgtaaatacctcctgtactaaaaacctatgtattttaacttattaatgcatattttatatcattatgttataatatttgttatgttttattcgaaatttaatatatttaatatgtagaaatattttataattttattttgcttaaaatattgaacattatactattatatcataaacatagttcttattgtagaacttttaatttactagaaaggtggtttcactatgaacatattctttataggtgttggcggtattagcatgagtgcattagctaaaatatgtttaaataaaggttataatgttttcggatcagattctacagattctcatttattagataaccttcgtgatcaaggagcaactatatatataggtcataaaaaagaacatataactgatgatatagatatggtagtttatactgctgctgttaaatctgataatgaagaattagttgctgctaaagaaaaaaataaattaattataaatagagctgcttttttagggcaaataatgagagaatatcaaaattctatagctgtttctggtactcatggaaaaacatctacaacatcaatgctatctgctatatttgaatatgcagaacttgacccaactatactagttggcggaaaccttagcataataggtggtaatgttaagataggaaaatctcaaaactttataacagaggcttgcgaatacgttgatagtttcttaaacttcaaccctaaaatatctgtcgttttaaatatagaagaagatcatttagattatttctctggaatagatgaaataaaagcatcttttaataaatttggtaaattattaccttacgatggttacttcataataaatggagacgatgaaaatactaaggatatattacatgaaataaaagctactgttattaaatatggtcaaaacgaaggaaataatgctctaattaaagatattaaattcgacgctgatggctatggaatatttaatataaattacaatggaattgatttaggagagtttaagctttctgttcctggaatacacaatgtatacaatgctacaggagctatattagcagctttagtttctggtgtagaattagaaactataagaaaaaatatatctttatatagtggtgtaggtagaagattcgaagttaaaggtaaatacaacaatgctttagttgtagatgactatgcacatcatccaacagaattaaaagctacattatctgcagctaagaaaattaagaaaaataaattatggtgtatattccaaccacatacttacacgagaactaaatcattattaaatgaattctctgatgcattttatgcagctgataaagttataataactgatatatatgcagctcgtgaaaaagatccaggagacatacattctaaagatttagttgataaattatatcaaaataatgttgatgtaatatacttaagtaaatttgaagaaatagtagattaccttgcagaaaatgttactgatgatgatttagttataactgcaggagctggtactgtatataaagttggcgaaatgctacttgaaaaataatataaaaaaagctaggtgaatttcgcctagcttttttatttacaataataactatttcttttcaattttaaatacatcatctcttaaataattaaataatccattatgaacttcataatacgctgttgctttatcagaagttacttttacatagtcatctcccatagtttcaagcgttatggaataaccatctccctttatcttaactgtaaagttgtatggacttctttctttacttttttctggctgtatttttccaactagtctttttacagatatactatatgctaaatcatcataattccatctccatggttttttaacttcatctccatatatgatttctatactatcccatgttttgtatttttttacagaatctatagatgtatatatactttcttgtaataatttatcaaatatctttttttctgatacaggtattttataaaactcttctttatttactgtaaatattctaaaataatctaaatcagtagaaaatctaataccattatctacataaccttcatatttactttcatagttacttggctttcttacttgtttaaatttagtagagaaaaactttatctgattccaatactcttgctctactcttacatcttgtaagtttttatctgacatataaactgtatcagttgttttcatctgagctagtaatgaccttgaatcttcttgtgtgtctttattttcgactttaacaggctgatcacttgcctgcttttttgagaaataaacatatgtagctgtatatactataaagaatccaattattcctacaagaatcaaaatcctttttttaatctttcttttctttgccataaaagccccccctatataattaacgattttattatactataaaatatgcaaactaaaaagcactacaattgaatcatagtgctgtttttataaatttttatattattttattattttttacaagaattgcctgggcaatttatacaaggttctacatggactgttataccttttacaaattgcatctcttttattatgcgtttttctaacttagttgctatctcatgaccttcaaaaacagttaagttcttgtttacacatatagttaaatctacatatgcagtagctccatgttttcttgttcttatttctcctaagttaattactccatctgtattttctgctatgtttactatctgtttttcttgatcctcatctattgaataatccattaattcattagctgaatcttttaatatatcaaatcctactttagctacgaataaagctacggctatagatgcaattggatctaatgctttaaaacctagtaaagctcctcctatacctataaatgccgcaatagatgaaagtgcatcagatctatgatgccaagcatcagcctttaatgatggtgagtttattttattagctacttttatagttattctatattgatattcttttatagctatagaaataatagatactactaatggtagtaatgtaggtacttgaactctatctaggttaaaaagtgatttaagtgcattaaatccgatttttaatgatacaactattaataatatagataataaaaacgatactaatgtttctgctttttcatgtccataattatgttctttatcatttggtgcttttgcaactttattaccaattaaaactcctactgaacttattatatcagatgctgaatgtaatccatctgctatcatagcattagattttccaactatacctgaaaatatttttataactgttaatactacattccaaattatagattgtattgttaccttattggcttcatcatatcttgtttccacgatattacctcctaatatatatactttattttattatccatttttattctttcttaaacctacatcaaatcttaactgcaataaattatagttttaattcaacattaattatcatttatcttaaaaatgaaaaatcacccaacaaatgttgggcgattcttttattatatcatatatttaattatgcttctttaattatttctaatacagctcttgaagaatttattatatcttctattgctatatattcttctaatgtatgagcatttttcattcctattcctaagttaacagcttttaatccatttccatttaatacgttagtatcacttccaccacctgttgaagcagtatatccttctattcctatgttagagaatgcttttttagcaagttcaactatctcagcatcatcagctattttaaatggtgcataggctctagttactttagcaattacttctgctcccatagcttctcctgcttttttgaattcttctaccatatgattagtttgagcatctaattttgattcttctaaacttctagcttctgcaactatttcaagttcaggcataactatgtttgtagctattccacctttaactatacctatgtttgcagtagtttcttcatctattctaagtaatttcatattctctatagctttagaagctaccattatagcacttactccattttctggttgtaaacctgcatgtgctggcttaccttttatagttacttctattttatcttgcgctggagcttttgttattatttctcctggagatccaccactatctaaaacgaaagcataatctgcatttattttagaatagtctagatattgagctccaaataatccgccttcttcccatatagagaatactacttctatatcagcatgatctaaattattttcttttattattcttaaagcttctaatatagctgctataccagctttatcatcagaacctaaaactgtagttccatcacttgttattattccttttgcttcatctattataggttttattccttctcctgggctaactgtatccatgtgagaactgaataatactgttttaccttctctgtttccttttaatttagctattacgtttcctgtttctccaccagctttaacaccagcttcgtctatacaaacttcacatcctatagcttctagtttttttactagtactttagctacgttaccttctttagatgaaggactatctatttttactaattctatgaattcatcgattaatctttgtttatttatcatattcaattctcctcctagtttgtattacatacatatattgtaaattattccataatttttttcaatagaaaacgatattatcagacttctctcacaatttacttcataatctttctagttctagaatcaacaaaacaaatccaatatccaagcttatcgcttctatcatcacatggtttatacatattaaatcctgtatgaccttgatctggttgctcatttttatttcctggaatagcgtacatatagtgtttacgcttgttgtattcatcatattgaactccaaataagtaatgtctatatctatatgattgtaaaactatgtcactatacatagtataatttaaagtatttatataccctaagtatggcatagtatatccgcacattgtcataggtgttatctctattttccaccatctagtattttctatagtatcccttgcaaatggcttaacttctttaaacattttcaatcctttttttatctgtctaggcattaataaatttctagccgtatttacttgggcttcttcataatttatttcctcatcaatttgttttatctcttcacttactttttcactacgttttaaattctcttcaattacaggcttattattgttaggttttgttgatttatttctttgatttttttgtctagaagatgatacgtactctatttcttcattatcttcttcattttcataattataatctgtattttcttcattatcttcttctatttctacatattctaaatactcatattcatactcacagttttcgtcatcatcaacttctacatactcaacttcttcatatacatactcttcgtcatcttctaattcttcatattccatatattcttcatctgatgtaaatattatttcttcataattatcaattttacttcccttaaatccaattaatggtacgcttttttcagatactaaagccacagcctttatgttagtattattttcgtctaaatttaatgcaaattcccctttaccttgttcactcaatactatacgccctaaatccaaagtgttgtaatcttctagtatagctaccactttatatccatctctaatatacttaagattttctacataaagtgctaccaaagatttttcttctgtaacttcaatttttgcaaatgcttttggcaatactctatctttatatctaaagttcatgtctttagcttctagaattatataatctcttttatacttttttttagtactcaaagctatcccccctataaaatataagtccctctaaacattatatgtttggacatgcaaaaaagtaccttctatttagaaggtacttttttactaacacaatttgaaagatttgcaaactcttctattgtaagagtttctcctcttcttttttcatctatattagcctcacttaaaacttctcttatttcatctttatttaaaaatcctaatgttcctaatgcatttagtaaagtttttcttctttgcccaaatgcagctttaacagttttaaagaatatatcttcattatctacattgtattttctttcttctcttacatgaagtccaattactgtagaatcaacatttggttgtggtataaacatatgtcttggagcttttgctactatttctgtatcacagtaatattgaacagctactgataatgctccatagtcttttgttccaggatttgcattcattctatcagcaacttccttttgaaccataacaactatatctgttactggtatatcttcttctaagaatttcataactataggagttgttatatagtatggaagatttgctactaacttaactggtcctccacttaacttttcttttactaactcttctacattaacttttaatatatcttgatttactacctctatattatcaaattcatctagagtgtctttaagtattggtattaaagttttatcaatttctatagctacaaccttatcagcaactttacccatttcacgagtaagtgtacctataccaggacctacctctattattttatctccttttgaaagtcttgctccatctaatattctatctattacattgtcatctattaaaaagttttgtcctaatgatttagaaaacttaaatccatgcttatctactacttctttagtttttctatgtgacgaaagtctatccatattttatctcctttatttatattattataaagtttctaaagctttttcaaactcttctctactaactccataattatttaatctatttaaaaattgttttgcatttccgtaacctatacctaatatcattcctaacttatctcttctgtgagatgcatcatcatttcctataagtccatttcttattaaatctacttgtccgaattcatctcttttatcagtactttctgttcttactttttcaagtgcttttcttatactttctggagtagcattttctatacctatatctccatttttctttgcttcttctcttggtaaaaatgcatgtttacatccaggaacttctgcagctattttttttcttattttttcacctgcaaagtctgggtctgtaaatattataactcctcttctttcttgtgctgattttattctttccataactcccttaggaaatccaaaaccacctgtagttataagttcagcatccactgctctttttacagccgttacatcatctcttccttctactactattatttcctttatcatctaatcacctttttcgctcattttacttaatatctttatattttaagctttatactaaattttatcaaggctacaaattcggttatagctaaaataaatgtctatttcgcaaaataggggcttatctctattttgagatagccccattatttatattactttatattaaaaaatctctttgcattttcttttgtagctttacaaacttgctcatatgaaattcctttttcttgagcgattttatcagctacaaattgaactaaagaaggatcatttctttttcctctatgtggctctggagccatatatggagaatcagtttctataagtagatactcaagtggtatttccttagctacttctctagtttttttattatttttaaatgttactgtacctggtatagatatataacaacccatttttacatactctttagctagttctacatttccactatagcagtgaagcacacatcctatttcaggacttttagtgttttttattatttcaaatgtatctccgtgagcatctctatcatgaattattataggtaattttagttcattagctaattctatttgtcttttaaaccacttcttttgaatttctctaggagagttatcatagtaataatctaatcctatttctcctatagcttttaccttttcattttctaatgcaagttttcttaaagtttctatatcttcttcagtcatttcacctacatcatgaggatgaactccaactgctgcatatataaaatcatatttattagctaaatctacactacttttagaagtttctatacaagctccaggatttagtactaagtctacacctttagcttttagtgaattaattaattcttctctatcttcatcaaatctttcatcatttaaatgtgcatgtgagtcaaataacatttcgtcatctccttatctaacttcgcaaccgtctttagcaccttctgttaatggtaatactaaatcatcaccgtcatctcctgcagctaatatcataccttgagattcaacgcctcttagttttacaggctttaagttacatactacagtaacttcttttcctattaaatcttctggcttataccacttagctattccagatactatttgtcttgtttctggtcctattttaacttgtgatactaataatctatctgctttaggatgcttttcacattttactattttacctattctaagctctatcttatctaaatcatctatagatatttcaggcttatgctctaatggagcttctgcttcttctttcttttcagcaaataattcttgaagttcttctacttctttttctatatctaatcttgggaataatgcatttcctttttcaacttttgtattttcttttattaatccaaaagttttagtactttcccaagtcattaaattttcatctgttatacctaattgagcatatattttcttagcagtatcgttcatcattggatttataagagtagctactattcttatagattcacataagttatataaaactgcatctaactcgtctttcttagcttcatccttagctaaagcccaaggcatagtttcatctatatacttgttagttcttcttattaacttccaagctgactctaatgcttcattaaattgtagtttgttcatttctatttcaaagttttctactgaagtcttagcagtttcttttaagctagcatcaaattcagtacttacttttggcattggtattattccatcattgtatttttcaaccatagaaacagttctacttactaggtttcctaaatcattagctaaatctgagttaagtcttgttacaaagttcctatgagtatagttcccatcttgaccgaatgcaaattctcttaataagaaatatttaagagcatctactccatatctttctatcatttgttctgggtaaactatatttccttttgatttactcattttatcattatcaaataatatccatccatgtccatatacttgtgtaggcatctcttcacctaaagccataagtatagctggccatattattgtatggaatctcattatttcttttcctactatatgaacatttgctggccaatacttcttaaattcagaatcatcttcgctcatatatcctaatgcagttatatagttacataaagcatctacccaaacatatataacgtgtttttcatcaaaaggaacttttataccccaatcaaatgtagttctagttacacataaatcttctaatcctttgtctaagaagtttgcaaccatttcattttttctagatactgggaaacagaagttagggtcagcgaatagttctcttaatctatcttcatattttgataatttaaagaagtaagcttcttctttagctatataagtgtctcttccacagtcaggacatttatttccttctaataattgagactctgtccagaaactttcgcatggagtacaatatcttccttcataagaacctttatatatatctccttgctcatatagcttagtaaatattttttgtattataacttcatgtctttcttgagttgttcttatgaaatcatcataagatatatccatagtcttccatagtttttgtatgtcagctatcattccatcaagatactctatttctgtcattcctttttctttagcagttttttgtatcttttctccgtgttcgtcagttcctgttaaaaactttacatcatatccacagaaacgcttaaatcttgctatagcatctgctgcaacagttgtataagtatgtcctatatgtaggttaccacttgggtaatatataggagttgtaacgtaaaaagtaggttttgtcatatatatttcctcctcaaatttatgttttctctataaataaaaaactcgccacctatgtaatatcataggggcgaggttatattcgcggtaccaccctaattatctataattattttatagatatcttagaagacgttaacgagtctaaccgttctatcttaaaaatagacttagtctattattcggataaaatagctccaagaccatattcagtaattcttttaacactagctttcacctaccctagctctctgtagaaaaaattgttacttactcatcttttcatagcttaattgtttatataatttacataaatattatgttttattcactatttttgtgaatatttttatattaacttattaagcttaattttattaaatttactacagtatgtcaatcttattttgctatattacttgcttttatataactttatcaaagaattgtttggttcttatgttctttgtattttcaaaaatttccttaggagtaccttcttctaatatataccccccatccataaatacaactttgttagcaacttcttttgcaaatccaatctcatgagttacaactgccatcgtcattccttcttttgcaagctctttcattacatctaatacttcctttaccatctctggatcaagtgcagatgtaggttcatcaaatagaatcatatctggtttcatggccaatgctctagctattgctattctttgcttttgtcctcctgaaagttgagatggataatcatttttcttttctagtaatccaactctatctagtaagtttagtgcatcacttatggcttcttctttacttactttttttactttagtaggtgcaactattatattttcaagtacagtcatatttggaaacaagttgaaattttgaaataccataccaatattttgtctgactttattaatatcacattttttatttaatatattttcactattataaataatttcgcctccatttggttgttccaaaaggtttatacatcttaacaaagtactttttcctgatccactaggacctaaaattgctacgatttcacctttttttatatttagatttatatcttttaaaacttcattttttccaaaacttttttgtatattttttaattgtatcataatgtaacacctcctattatgcattactagctttaaataatttacctaaaaagttagattctctctcacttttatttgctaacttaaattctaataatcccactagcttagataatgtaaatgtcaatataaaatatatcattgcagctactaatagtggttcaaatgccaagtaagtatttcctttaactatatctgcactatacattaaatcttgtatccctataacagatactatagatgactcttttactaaaactataaattcattagcaagagctggaagtacattttttaatgcttgtggtattattactaatctcatactcgttgagtaatctaatccaagtgatctactagcttccatctgccctttatcgattgactgtatacccgatcttaatatttctgctatatatgcacttgaatttatagaaagcgcaactactgcagaaatatattcagaaggtataggtcctaaacttggaaatttaattcctatagtaggaaatccaaaataaattatataaatttgaactaacaatggtgttcctcttaaaaactctatataaactctacctaaaaaacttaataccttatttctagatattcttgctaaacatattactacccctacaataaatcccaaaagtaaagtacatacagatatagcaatagttatctttgttccatctataaaaaattgtgagtaattactcaaaaacgaaaaatccatttttaatacctcctaaatttattgtgctaattgtgtagcttgttgaacatattcatttatttttcctttatcctttaagttatttataactttattaacttctaatattaaagttttatcatctgttttatttacagctatagctgaaccttcttctttattttcacctaaattaacttgagacactacaatttgaggatattgctttaagtaaccatctatagcttctttacttactacaactgcatcaacattattattttgaagtgctagtatgacatcagatatctttcctaatgattttatatcattggcttttataatatcttttgctatattttcttgaagactagctttttgaactgctattttcgtattttttaaatcatcgattgatttatacttattcttactttgctctttaactaagataacatgttccccattataataaatatcagtaaagttaactgctttttttctttcttcagttggactcatgcctgcaacaaccatatctacatttcctgatttaagagcccctagtaatccatcaaatttcatatcttttatatctaacttaacacctaattctttggctatttcttcagccatcatcatttcaaatcctacaatagtatccttaccatttatctctttatgaaattcataaggtggataatcagcactagttcctattgttaatacacctttatcctttattgtttgtagctgacttttttctccttttgaagaacatcctactaccgataagcttaatatacctatcaaaactgcatatattgattttttaatttttttcataataattcctcctaattaataattattagtaactgataatcgtttgataatttaattttaattttagcttcaaaacatgttttgtataataaaaaagccccttagcattttgctaagagacgaaattttccgtggtaccactctcattgataagttagtcaataaatgataatacataatataattctatatataaaaaaagtcccttggttaaaaaaccaagagacgaattatatccgcgttaccactctaattgataagtaaacttatccactcaatcctttaaggcaggctcaccgattaccatactattagttcaagtaatcttctccaaagctctcttcacattaaacttcattaccaggctcacaccaaccctagctcgctgaaacttcatttagtgctactctctttttcatagaatttattttataaatcttttttataagctaattatagttacttaaaattaaattgtaaatatattttttaaattttttaaaataattttaactaaataatatgtaacatataaatacagcagctactactcccgcaatatgactaatcatagagcatgttaaagtatgtctagtatttttaatttttaagcttccaaagtatattgccatagtataaaatattgtttctgaagcacctactatagttgcccccatcttttcaattattgtacccattccaactctagttgcaagttcattatacatacctaaagctccacttcctgataatggctttataactataagacctattaactctttaggtatactaagtaaatcagttatgggtttaaatataaattccaacatatctataccttttccacttttaaatattcctattgctaaaaatattcctattatgtacggtaatataccccaggtagcttttaaaccatcaattgcacctttgacaaagctatcatatatatctacaccttttatttttccatgaactactataattaaaattattacaggtattattgagttagaaaatatatttaacatcatctatacctccttctttgaaacaccttacaagttgtaatagcaactaccgtagagataagcgttgcaaataaagtagtaggtattatctcacttggattagcagcgcctccatctaatcttagttttatcatagtaaatggaataatctgtatagaagaaatatttattactaaaaacataatcatatcgtttgtagctgtgtcttttttattatttaatgtctgcaattcgttcatggctttaagtccaaaagcagttgctccatttcctgcccctagcatatttaaaactatattcataactatatatgacatagctttatgacctttaggtacagatggaaataatttttttaaaattggatataacatatcacctattttatttatcaatccagagtcttttgctatattcataattcccatccacaaagccattattccagctaaactaactgcaaattcaattcccctagatgcttcacttaatattacatcatttaattgccctaaattattggtgaatatacttccaacaatgccaataaaaatcatccaaaaccatatctttgtgatataaatccccccctcttatcaattttatgatattaagttatgagattatacttgaaacttattctatattatgattaagtataattatctaatttatttatatttttagggtaataaggagatatataatgaaaaatttaacacttcttactgatttatatcaactcactatgattaatggatattttgagaataatgtccataatgatattgttgtatttgatatgttctttaggaaaaacgcttgcaaaggtgggtatactatagtttgcggtatagatcaacttgttgaatacataaataaccttaatttttcagatagtgatttagactatcttaggagtttaaacttgttctcagaaaattttttaaacttcttaaaagaatttaaatttacaggagatatttatgcagttcctgaaggtactgttatgtttccaaatgaacctataataaggataaaagcgcctctgtatcaagctcaacttattgaaactgcactacttacaattattaattttcaatcattaattgctactaaagcttctagagtttgtttttcagctcaagatgattctgtattagaatttgggctaagacgtgctcaaggtcctgatgctggtatttatggtgcaagagcagctataattgggggatgtagcgctactgcaaatgtacttgctgggaaaatgtttaatatacctatagtaggaactcatgctcacagctgggttcaaaaatttgattcggaattagaagcttttgaagcttatgctaatatttatccagataaatgtcttttattagtagatacttatgatgttttaaatagtggtgtacctaatgctataaaagtgtttaaagatttgagaaaaaaaggatttgaaccaatgggtataagacttgattcaggagatctagattatttatctaaagaatgtaaaaagctattagatgcagaaggttttgataatgtaaaaataacagcatctaatgatttagatgaacacgctatttctgaattaaaatcttcaggttctcctattaattcttggggagttggaacaaaattaataacatcatctgattcaccttctcttggaggagtttataaacttgttgcttcatataaagatgatatctttgaacctaaaattaaaatttctgaagatccagaaaaaataactaacccaggatataaaaaagtggttagaatatataatactcaaggaaaagctgaagctgatttagtaatgcttgaagatgaggttatagatactactaaacctcttactatattccatccagtatatacttggaaaaagaaaatatttaaaaactatacaatcagagagttgctacaacctttatttattgaagggaaatgtacttataaacatagatctgtattagaaattaaagagtatactaaaaatgaattaaatactttatggagagaatataaaagattgatatatcctcaaacttataaagttgacttatccgaaaaactttggaacctaaaaaattccatgttaaatactaaaaaaaatatttaaatcagtatcaattgaagggggtccaaatatggatataacagactacaaaattatagaaatattacaaaaagatggaagaatttctatgaaagatttaggtaagatagttggtttaacttccccagctgtatctgaaagagttaaaagacttgaagagtctggaattatacaaggttataaagctatagtaaatccagataagttaggtagagtaattaaatcttttataaatatatctttacctagtgaaaattacagcagtttcatagaatatgctaaggatgataatcgtattgtagaatgtcatcatataactggtgaagactgtttgcttttaaaagtaatagttaaagatatgtatgaacttgaaaaagtcattgataaaataaaacaagtaggtagaactaaaacatcagttatattatcaacaataatagagtctaaatcaatattataaaatcaattaaaataaaaaggatgcttttagcatcctttttattttaatcctaaatattcttctagggttaaattattcatattaaaatgttgactatctttttttcctatatatctataatgccatgattcatacatatatcctgtaatatcttcttttccttcaggatatctaagtataaaaccatatttatatgcattttcatacaaccatttagcttgtggtgtattatcaaaccatgtacctattggtcttgatgtattacctgtagttatatctaatactaatccagtttgatgttcactaaatccaggtctagcagagtatctatctgcttctgcttttccatcctttttcacataattattatatagctgtacttgagtattataacttctatagccacttctaatatttattataatcccatctttttttgctgctgctttcatttctttaaaagccttcattgcctctgtatcttctctcccactttcaggagcatagtctttaggaagtccataatctttatttacaactaatataccatctatatataaaggtttttctccttctacataatcacttacattatgctttggtttttcttctttaacttcatgaacttgtgctttttgttcatctgcataagtatctttttctttagatgctattaagctataaatctgaaatacaaatactgcaatagctatagcaattactccttttttcaacatatcttcccccatatttcaatttctaaacaatataaataattatactttataattacatttacttctactaaattatttattttgtaattttatgtagcttatttaaattattgtttataatataaaaaaggcatctcaaaattgagataccctttttatattataaagctatagctttttctattctatttaatccttcttttatattatctaatgaagttgcataagaaagtcttatgtagttatcatttccaaatcctattcctggtacaactgctacttttgcatcatctaataagtaatctgcaaaatctactgaattatttatagcttttccatttatagttttacctattaatttgcttatgtttaccattacgtagaaagctccttgtggctttaagcaagataaattttctatagaatttatcttttcaaccataaaatctcttctttctttaaatgcattaaccatttcatttaaagtttcttctggaccattaagagctgctatagttgcatattgagctatagtattaggatttgatgtagcatgactttggaaattagacatagccctagctatttccttattacaagcagtatatcctattctccatcctgtcatagcataagcttttgctactccatttactactatagttaaatcttttatatcttgattgaaagaagctatacttgtatgagttccttcatataataatttttcatatatttcatctgatattacatatatattatgtttaacagctaaatcagctattgctcttaaatcttcttctttgtaagcagtacccgttgggttatttggtgtatttaatattatagctttagttttatctgttatagcagcttctaaagcttcaacagtatatttaaactctgcttcttctggacactcaacaaatacagggtttgcatctacaagtctaactaattctggataacttacccaatatggattaggtactattacttcatcccctggattacatattgccgataaagtgttaaataaagaatgtttagctccatttgatacaactatttggtcttgtgtatattctaagttgttatctctttttaatttatcacatatagctttttttaaactttccattcctgaagctgctgtatagcctatactttcattttctatagcatttattgctgcatctcttatatgcttaggagttctaaaatctggttccccagccccaaatcctattatgtctatcccctgagcctttaaacttttagcttttgcagttatagctaaagttactgatggctgaatcgacttcaatttatttgatatgttttttctcatgttttatcctccccaaatttaagtcaccttttgtaaaatcgttttccataaagttattaattaaacctttgcttcccaaaggctttaaatataaatacaataaaagtgtattaaccttaaatagttaatacacttttataatatacaaattttttaaaattgtctatatttaaattttaaaaaattttacttaaattctattatatctatataagtaatttgttattccataggtcatatatgattttataacacctgtgtcttcattaggtcttattaactttctagtagacacaatatcagcatatcctataataaaaatgtctatgctctcatcttttaatatatcaaatgcattaaataaaacttctttactcatattattatttttataaaactcaagtaatgtcatatggtatcttatatatttatataagatatttatatttttttcacttaaccctaaatttttacctatttcaaaaatttcatttgctcctataacttcatgttttttaaagtgaactctaccattatcgtcaatagtttgagctaatggtttccccatgtcgtgtaaaaatatacctaactttataagttcttttttcttaattccatcatctaatttttcatttaaattttcaagtactttatatcttatatgcgtatcgaaaaatgattcttctcgtattatttcttctaaaagttctaatgccagtattgaatgttcaaaacaatttataacatggaatttacattcaccaacagttttcatcttcgatataataggaaatacttgttctagttcccctaatttatccatctctcttagatgactatagctattttcactttttatacaatccattagcttcttaactaatgtcatgttttatcacctctattttataaatctaaaacttgtttgtatactatatcttttttaagttttctttctttgcatacaactttaattgcatcttttttagttgtaccttcttccataagctttattacatattctctatcatttagattatcatattcacaagttttttctatttcacccttaaacccttcaacgataagaacaaattcaccttttacttctctttcattaaatatatctatacatccctgtatatcatttcttattacttcttgatacttcttagttaattctctatttatagcaatatttctatttcctaatattttaatcatatcttttagtgtatcttttaatctgtgtggtgattcataaaatattatagttcttttttcatgttttaattcttctaattgttctcttcttctttttttatctctatctaaaaatccttcgaacgcaaatttaccggtttcaagacctgaacctattaaagctgttattgaagctgtagctccaggcaaaacaactatttctacatcattttctatggcttgttttattatttcctctcctggatctgatataccaggcattcctgcatcacttattagtgctatattttctccacttaacaatttattaattagatattcgcctttattatctttgttgtgttcatgataacttgttagtggtttagatatctcaaaatgatttaaaagtttaatactatgtctagtatcttctgctgctattaaatcaacctcatttaaaactcttaaagttctatacgttatatcttctaaattccctattggagttccacatacatataattttccactcatttacttctctcctatatcttcatttgcgtatatatcattgattgctttagtgtattgcccatcttcatcataaacatatagtgggtctaatatttttaaatccggtcttccacctttagtaaattgaactaacattatattaggagcttttccttgttttggatgtataaattgaatttgtttaggttctaatttatattttcttgccaatgttattatttctattaatcttgtcggtctatgaatcatataaaactttcctaaatcctttagcaatctagatgaagatcttattacgtcttctaagttacatttaacttcatgtctagatatagcctttttatcattaggatttttaattccgttatcatgcatatatggaggatttgaagtgactacatcaaatttattaacttctagagtctcatctatagtttttatatctccattaactatctttactctatcttgtaaatcatttagtaatacagatcttgttgccatctcatatacttcttcttgtatttcaacacctattatttctttagcctcacttttcccagctataagtattggtattatacctgttcctgttcctaaatctacaacactagctcctctttttacctttgcaaaattggctaataatacagcatctactccgaagcaaaatcctgttgtatcttgaattaacctcaatccttttaattgaatatcatctattctttccgtgtcttttaactttacgtccataaatttactccttgctataaaaaatctataatttaaagggtaggaattatcctacccccatattaatcttctagttttcttaattctcttagagtctctgcatcaagtctttcatctcttgaaccacagcctccacactttcttgcttcttgtaaaacttttatatcttcaacttcgtataatttgatatttttatcttgtaattctactttagcttgttctaaaagtgggttaatttctattactttcccttttccatctggaacttgaactaccgatcctactgtaggcattttttctaatgcctcactatatacatcgtgttcatattttaagcaacagaataatctaccacatatacctgatattttagttggattaagtgataagttttgatctttagccatttttatagaaacaggttggaaatctcctaaccaagaagaacaacataagcttcttccacatggccctaatcctcctatagatttagcttcatctcttacacctatttgtcttaattctattcttgtcttaaatatagatgctaaatcttttacaagctctctaaaatctattcttccttctgctgtaaagtaaaatattaacttatttctatcaaatgtatactcacaatctataagaaacattgttaactcatgttcttttattttttgttgacatacttcaaatgtttcttttgccttttctttattctctaaatatattttagtatcttcctcagtcgctattctaacgataggctttaaaggtgatacaagttcactttcatctaattctttaggtcctacaacaaccttaccgtattctaatccccttgcagtttctacaactacatctatatttttctctatttcaaaatctacaggatcaaagtaatatatttttcccgcacttttgaatctaacacccactattcttatcatttaatcacctcatatatatttaaagccattacttgtacactcaaattaaagttacaattgcttcttaactttttcttagtctcctctattatatcaataatcttagacacttgagaatagttaatttttttgctcatattttgcaaatacgttattttatctatatttataatcatatctttatctatattttcttttagcatcattatatctctaaagtaatttatagttatatctaaaacttctattatattatctttatatttatcatatttattaggaagttctaatacttctactacatttttttctaatattgtttgtatgttattttggatatcttctctcataatcatgaagtctgatgactcagataattccaatgctttactaatacttcctcttgaaaaagttgataacatgctagcttttttttcatctattcctctatcttctaaatacgtttttaactctacaagtggtatcggtaaaaacttgactatatcacatctagattttattgtatctagtaaagaatttttattattagttataagtattattattacatatataggaggttcttctaatgtctttaataacgcattttgtgattccatagtcattttttctgcattatttattacataaattttataatcaccatgcggttttattattacatctgtttgtagatttcttatttgagcgatttttatacttgcaccttgaggttctatatttatatagtctgggctattttcaatatgttctgttttgagtaaatactttgcaaactcttttgcaaatgtactttttccaaccccatctattccctcaaataaatatgcatgatttatcttatcttttttaatagaatttgataagtatttttttgcaaaactctgacctataattttatcaaaatacatatttacttctccatagaatctatagtttctttaactattttatatatttcttcatgaatactatctatacttcttaaatcttctttttctatacaattaatttttttccaatcatacttgtccgctatatgtaaagcattattgtatgatctagttaaatattctatatcaccttcatgtatatcttttttatcttcacctgtaaatttattttttctattatccataagttttttactaaattctataggaacatctaaaaatactacacaatctggttttggtattttatataaattaaattcataatcaaataaccaatcaataaacttatctctttcgttttcatccattttagatgcttgatgtaccatgttagatgtagtgtatctatctgctattataattccaccttcattgtagaatgactcccattcagttttaaaagatgcatatctatctgctgcaaaaaaagtagatgctatatatgcatcaacatcatcagcattttttccaaaatctccgttcaagtacattttaactaaagcagatgattctgatttataatttggatattctactttttttacattatatccatcttcgattaatttattatataattttttagtttgagtagcctttccactagcatctgaaccactctctataattattaacttacctttcatattttacacctgtcactatataagcaaatttattaaaactgtataatcttgcttaatagttaattcctttctacttagtttactttatgtctataatttgaatatattcaagattagaatctttaactccgctaacattcatgcctttctctctacattctataatatattcaataacctcttccgtaatctcttctccaggagatactaagctaatgccaggtgggtatggaataatatactcaccagatattttacctatactatcatttattttaacattttttttatcagtataaaatgcctctcttggagttaatacttttttaggcatatctaatggataatgtatatctcttaatgtaaattcattcttacactttttatcaatctcatataaagcctcttttaatttagagaaatcttcttttgtatttcctatagtcgatataagtaaaactccataataattagctaactcaacttgtattttatatttttctcttaaaattttttctaaatcatatcctgttattcctaatttctttgtatttaaaaatatcttagttttatcgtcagattcatctgttgaaatatatttaagtttataaatatcattttttaattctgatatattttcaagtaactcctccatcaaatcttttcctctatttaagtaaatatctacagcaatctctagagatgccataagtaaataagatggacttgatgattgtgttattctaagtatattagataatctattctcatctattctattacccttaatatggatcatagatgactgtgtaaatgctggcaatgtcttatgtgtactttgtattactaaatctgcaccttgactcaatgcagtatctggtagtttatcacttaatcctaaatgagctccatgagcttcatctactactacaatcatatctttactatgagcatactcgcaaatgctttttaggtcacatatatttccaaaataagttggatacgtcaagaataatgcttttgcatccaagttactatctataacagtctttacatgttcaaatttaactccatttaaagtattactatgatcatttatatttgcttttatatatacaggatttatatctccaacaatacatgcatttatagctgattggtgacagtctctattcattataatcttttctttaggctttgttacagccattatagctgcctcaattccacaagttgatccatttatcaaataatatgttttatcgcttttaaatgtctctgatgctattttaagtgattccattatacattcttcaggtgaatgtaaattatctgttccaggtacttctgttgtatctagtttatataaatttctaaataaatcttcatatcctaattttttataaatatacccttttttatgacctggaacatggaacgatattatattttcatcaactaaatttcttaaagaatttataataggtgttttcattttaatagctttaagttaaatattatcctaaagctcctcctttcagtcatacactttattatacaaataaaagtcactttataaagtgacttttacattgatattttattaaattatattctcatatttattttacacttcattcagtgaaatacaaataacatttactgaatttattatatacaaaataaaaaaagattacgtggctacgtcctactctcccaggcagcttcccaccaagtaccatcggcgctaaagagcttaacttctgtgttcggaatgggaacaggtgtatcctctttgctgtaataaccacataatctttcatagattaatatctatttagttagagttagtactctaaaaactgaataacatttattagattaaataatctttaagcaaccgaagtcatcgacttggttggcgctatgaaaatcgattttgaaagattttcattttggtcaagtcctcgatctattagtatcaataagctacatacattactgtacttccacctttgactaactctataaaaaaagctataaaacgaaatgaagaattattttttaaagatgatgagggttttaagggtataagtgataatcaaaaattttatatatctaatgatggaataattatctattttgatatatatgaaatagcaccatattatgtatccattcctaggtttaaattatcctttaaagaatttaaaaaatacttaaatacagaatatatatgtattgaatgaaaaagattaccatttaggtaatctttttatagttaaaatctataaagttaaaaatagctatagattttaactattttacaaaaatatataattgacttataattaccaatgtagaaaaatgtcaaacaatacgaagtggaggaataattatgacaaaaaaagaaagagtagaagaagtaagacgtatagcagaaggttattttgaaagaggagaatttttttgttcagaagctgtattaaaaactataaatgatgaactaggaaaaccatttagcgatgatgtgactaaattagcatcaggatttcctattggaataggtaaatcaggatgtttatgtggagctgtaagtggaggagtaatggcgtttgggatggtttatggaagatgccataaagagcctatgaatgataagatgtttgtagcttcagcaggtttacatgatcatataaaaaatatatataaaagcacttgttgtagagttatgactagaaattttgagtttcaatcaccagaaagaaaagctcattgtataaaaataactggagaagtagcagcttatatagctgaaaaattaatagaagataataaattaaagtaataggtgattgagtatgaaaactataagaaaaggaatttctaagagtgattttgaaaatatacctatagcaatagctggaatatcgcttggatttatgagtatatcaacagcacttgtggaatttaatattttatgggttagacatttagcggttttattttcaactatatccatattaatattaattataaaagctatactccatccaaataaagtttggaatgaactaaaaaatccattagcaggaagtatatatccaactatttctatgactattatgttaatagctgtgtatgtggttaaatttaatttacaatttgcaaaaacattatggataagtgcaactatcttacattttataatttttattatgtttactatacatatgttaaaagattttaggttaacaaatatgttacctagttggtttatatctacagtaggtatcggtttagcagctgttacaagtaaacctatgaagatgccttatttatcgagaataatattttattattcattagtgttatttatagtgttaggaataataatgatttatagacttatatttatggataagctcgaaggtaataaaaagtttactttaatgataatgacagcaccagctaatatttgcttagctggatatttagctgtttatgaagaacccaatattatgttacttaaatttttagctttactaggatatgcatctataatatatagttttgtattattacctagacttataaacacaccttttacactagcacttgcacctttaacatttcctttaggaattggagttactgcagctcaaagatacataaaatatttaaatcatataggctctaatttagaaatagttttaagatatatattatacattcaagttatagtatcagttattgttataggatatatagttattaaaacaatacatttgttaattagagattttatattagtgaatagtacaatggaaaatatcaaagaataaacataataaattcaaaaaggagcagatttatgtttattgttgatcctattgaatggataggatattgtgcatctatattaattgcaatatctttaactatgacatccattgttccacttagaataataaattctataggatgctttttatttgttgtatatggaatttatgtaggtgtatacccagttgcaatagcaaatggagttataataattatcaacatatataatttatataaattatataaaattaaacaaaataaaaaaacttaagtaaaaagacttaaagcattaattatatgataattataattttgctttaagtctttttattttacacatatttatgacttggacataatgcaaaataaataaagaattcatatattaaaaatatatattattaaataaattaaatgggggatttaatatgagaaatattaatatggatttgatgtattttgaatatctatataaaaaaggaataattaaaaaagatacttataacaaaataataagagatattactgaagaaaaaaataaattggttactataaaatcagtctataatgatgagtatatatctgtagatggagaattaaatgaattgatagctggtgaaaaagatgtagagttatcggatagatttgtacttataaatataggcggaggtaatgctatattacaaactcaagaaggattttatataagagttgatgatgatgataatagggtatatgcaaatgaatttaatataaaagatgcaactatatttactttaatacctataaatgagaaagaagtagctcttaaaacagataaaggcaattatgtaaaagttggagaagaagaaagattaatagcagatgaatctatgcaaaatgaaaaaactgtttttaaaattaaagaagttgttgagataatttataatgatatagttatgatatctttatcagaagaacgttttgtaagtgctataaatggaggaggatcttatttagtagcaactgaatttgatcaatctgaaaatgaagaatttacgttattccaatttttaggaggagaatctattcttaaaacttcgcaaggatattatgtaagagttagagatgatttagttttagttgcagatactaaaaatatagaagaagctagtagattttcaggagaacaaataggtgatgatgtaataattgtaaaaactctatatggtaatttagttagagttagagagttagacaaatatttaatagcagatgcaaaagaaataactgaaagttgtaaatttaatatatatcagtctacaagaccaatctaatatagctttatttttcataaaaagtataaataaaacaaatgatgaaataattacctagtagatataaggctaagaaaccaaaaataactaaaattaaaaactattcatgtcaaattcatacaaaattcataaaaccatagtaatatttatatataggataaatacctcccaaataatcaatgttacaaccctaaaaacaaacattaaccctttaaaatagatgcatttgtatgcatctatttttttgtatataaattatagcagaatgtatggatacaaataaaaaataaatttaaattgtatcatagtagttaataataatatacaatcaaggtatagaagacttaataggggagtgatattaaatgaataacaaaactgtatatatgccaggacctactaatattaaggaaaatgtaagacaagctagatctataaaaactacaaaccctgatatagatattgagtttgtagagttttataaaaacacttgtgacaaaataggaaaaataataaaaactacaaatgatgtatatatactaaatggagaaggtatacttggacttgaagctgcttgtgcatctttaactgaaaagggagatagagtattaataatagataatggagtgtttggaaagggatttgaagactttgtaagtatgtatggtggaaaagctatactatttagcgaaacgcataaaaaatcaatagatatagataaattaaaaaactttttagaaaaagacaatgattttaaatatgcaacattagttcattgtgatacacctacaggagtattaaatgatttaagtaaaatatgcccactacttaaaaaatacaatatacttacagtcgtagattcagtagctgctatggtaggagaaaaacttttagttgatgaatggaaaatagatatagcacttggtggttctcaaaaagcaatatctgcacaacctggattaactatagtaagcgtaagtgaagatgctaagcattttataagaagcagaaaaactagagtaactggattttattgcaatttaagtatatgggaaaactactataaaaataagaaattcccatatacaatgcccataagtgatatagtaagtatagataaagcgttagataacattttagaagaaggaatagaaaatgtaattgagagacatagaagaatagctaattctacaagaactgcattaaaagaatatggactagaactttttttagaagatgggtactcaaatactgtaacagctataaatatacctaaaaatattggagctttaaatttaactaatcatatattaaataaatataatacaattataggtacttctttaggagagtatgtaaataagctattgcgattaggacatatgggtgaaaatgctaaactagaaagaataatatatattttaaatatattagatagcagtttaaaagatttaggttttcaaggaaaaggatgcttagtagaattatttaataaaaattataaataattctcatagtttttataactggaatgaatatagataagtttttgaaaacacattaataaatataaaaatagactataatgaaattcctttatatagtctattttttattttaatagctttacttatacatattaatatactaccattatttatagaaaattaagaaaaagttatcaaaagggggaagcgatttgaatttagatttaaataaagaatttgaaattatatttaataaaaaaagtgataatacatacttctctccaggtagaataaatttaataggagaacatacagattataatggaggtcatgtatttccttgtgcattatcttttggtacatatggattaattagtaaaagaaaagataacttaatgagagtgtattcaatgaattttaaagattttggaataattgagtttaatttagataatatgataaatgaaaagattcacaattgggctaactatccaaaaggggttataaaaacattaaaaaatcataactataaaataaattttggactagatattttattttatggaaatataccaaatggagctggtttatcttcatcagcatctatagaaattttgatgggaattatattaaatgatgtattcaatttaaatataaataggatagatttagttaaaatgtgccaggaagctgaaaataaatttataggtgttaattgtggaataatggaccaatttgcaataggtatggggaaggaaaattgtgcaattttacttgattgcaatactctaaattatagatatagcaaaataaatatggatggttataaaatagttatatcaaatactaacaaaaaaagaaaactagcagattctaaatataatgaaagaagaagtgaatgtgaaagagctcttaaaaatttaaaatccaaattaaatatcaatactttaggagagttaacagaagataaatttaatgaaaatataaatttaataaataataatacagataaaaaaagagcaaaacatgctgtatatgaaaaccaaagagttttaaaagctgttaaagctttagaagaaagtgatttaaaattattcggaaaacttatgatagattcacacaattcattaaaatatgaatatgaagttactggaatagaattagatacattggtagatatagctttaaaacaagaaggtgttataggttctcgtatgacaggtgcaggatttggaggatgtagtgtaagtatagttaaagaagataaagtggatgattttataaaaaatgtaggcaagttatatgaagagtcaatcggatattcaccaagcttttatgtagctaatataagttgtggtgcaaaaaaattaatttagttaggagtatgttatgattaattacgaaataaatagactaataaatttcgctctatctgaagaaatgattcatgaagatgatattatatattctaccaatttattacttgggttattaaaagtagatgagttttataaagtcgatgtagttgaaaacttagatactccaactcctatacttgaaaatatattagattatgcagtagataaaaatctgattgaaaatactactacacaaagggatttatttgatacccagataatgaattgtgttatgcctagaccatcagaagttattaaaacctttaataaactatatattaaaaataaaaaacaagctacaaactattattataacttaagtatacaatcaaattatataagaaaatctagaacagataaaaatataaagtggaaaactaaaacaaattatggggatttggatataactataaatttatcaaaaccagaaaaagatcctaatgaaatattaaaagctaagattactaaaagtgcatcatatcctaaatgtttattatgcaaagagaatgaaggtttttttggtaatataaatcatccatcaagacaaaaccatagaattataccaatttatctttcagaaaacaaatggtttatacagtattcaccttatgtttactataatgaacattgcataatatttaatgaataccatgagcctatgaaaataaatgaaaatacttttagaaatttatttaatttagttgataaatttccacattattttataggttcaaatgctgatttgccaatagttggaggttctattttatcacatgaacattatcaaggaggaaattatatattccctatggaaatagcaaaagaagaaatggtatttaaagttaatggatatgaaaatatcaaacttagtactttaaagtggcctatgtcagtaattagattaagcggaaaaaacaaaaatgaaattatagccttagcttcaaaaattcttaaaacttggaaaacttactctgataaatcaattgatataataagccaaagtaatggtgaagttcataatactataacacctattgctagaaaaaagaataatatgtatgaattagatttagttcttagaaataataggtctaatgaagaaaatccgtttggaatttttcaccctcatgaagatgttcatcatataaaaaaagaaaatataggacttatagaagttatggggcttgcagtattacctgcaagacttgaaaaagaaattaatatattaaaaggttatttactaaataaagtttctgatattaatgatgatgaatttgtaagaaaacatggaaaatggtataattatattatagataaatataattacataacaaaagaaaatgtagatgatattttaaaagaggaaatcggtgtcaaatttttaactgcactatctcatgctggagtatttaaaagggatgataatggtattaaagcttttacaaagtttataaagctattagattagaggtgataaagtggatttaaaaaaatcatataagttaaatggtaataatacaggttgcttattaattcatggttttacaagcaccccagcagaaatgtacccattggctaaggtattaaatgataaaggatatacagtgcattcaatacttttaagtggacatggaacaaatcatgaggaacttttgaaagtatcatatatagattggtataatgatgtagaaaaagcatatgaagaactcttatttgaatgtgaaaaagtagtggttataggacattctatgggagggcttttggctttaatgttagcttctaattaccatatagataaacttatatgcttagcttgtgcacttaaaccaaataatcgatgggtaaaatatacgggcatattaaaatattttaaaaaatacacggaatggaaaaatactagtaattttgtcgatgaagaatataataaatatagacttaactataaaacttttccaatacattcagtatatcaactatatcttgcatcaagggctgcaagtagttgcttaaaaagtattacttctgatatacttataatgcaggatacaaatgactctcaagtaaaaaaagaaggtgcttattcattatataatggcatatcaagtaaacataaaaaactagaatggattgatggggcaactcatagtttaacactaggacctaagcgagaagaagtatttaaaaaaatactagattttatagaatttaaaccagatgatttaatatattaattgttaaagtaatggatgttaaaaatcatattaatatgacttttaacatccattactttttattgcaaattttaaaatttgcattttttattatgattataaatacaatgtttatgaatataaaaggataaaaaaattaaatattaataaagcttaatttagtataaataggataaatgtggtataataaaaagatgtccaaaaaatgagaggtgagaaaattgcaacttaaggaacttatagatatagtaagagaaaatacacaaaaatctatgtgggctagaggatatacttattataaaaaaggaatagtagatcaagccactccacatatgaaaaatggaatattaacaattgatggaataataggtgcagatttctcaaatgaaatttactatacattgcttgaaatagatttaaagaaaaaagaaataataaaagctaaatgtaattgcatagattttgtaaataacgaagctgaaaattcaaattttatatgtaaacataatatagcatcttttcttctttatatagatactttacaaaaacaaataaaacagcaaaaactagataaaaagaaaaaagctcaagaactagatccagctaaacaaatgttaaaacttgctaaagaaagattaacacaaaataaaaaagtaaatttagatgtatatttaagtaaaaaagaaggaagcatcggtacatactatcaagctaattttaaaataggtagtgaaaaaatgtacgtacttaaaagcattcctgaatttatatatgcaaggaaagaaaagaatactataaaatatggtaaggattttgaatataatccaataacagattatttttctaaagaagatgaattaatagttaactttatagaagaatatataaatatagaacaaaatatatacaaagaatttaaaaatgacgtaaaacttatagatggtaagaatttaaatatattagaaagtggattaaaaaaatttcttttaaattttaataataaagaatttatattttcatatgaagataaagaatacaaaactaatatagaaaataaagatatagatataaatttttatataaatgaatctaaagataaacttacattaaattctaatagtaaaaacatttaccctctaaataataaaggtgatatattgttatttaatgaaaagatacatctcatatcagataaacaatgttataattacataccatttcataagcttctagtaaaagatggtcatatagattttaaaaaagaagatgcagattcactttttaatggtttattgcctgtgcttaaaagagcatcaaaagacatagcttttgatgaaaacttagaaaagcaaataagaaataatttagatgtgaaattttactttgataaactaaattacaatatatcttgttttatagactacgtatatacagatgaaaatgagaatgaaaataaaggctatgtaataagaaactttaaaaaagaaaatgaaatagaagatatagtttgctcatatggatttgaaagatatggtgataagttactatgtaaactttctcaagatgagttatttgtgtttttcaaagaaaaaatatatgaacttaataaattaggagagatatactactcagataaactaaaaaaagttaaagtttacaaaagcaatgatgtaaaagcaagctttaatttaaataaacagaactatttagagtttaattttaatatagatgatatcccaaaagaagaacttgaaaatatactttgggcattaagaaataaaagaaaatactataaattgggaagtggaagctatatagatcttgaagaagataaaatggttaaatttttagaattagtagatgatatcaaaaatagacatgtagaaaattataataaaatagattttaatgaagaaaataatgagatatcttatagtttaggtagtgccaattctatatatttaaaaaacttaatagatgaaaatgaatttaactttataaatgggattgaaaatataaatgaaatatcagataaatttgaaacaattgatgatatagaagttagcttaccaaaaaatttaaaagcaaatcttagagaatatcaaattcaaggttttaaatggtttaaaaacttaaatcatctaaaatttggaggtatactagcagatgaaatgggtctaggaaaaactattcaaacaatagcatttttactttctgagaaaggtaaaaaaagtatagtagtagctcctacatcacttatatataattggaaaaatgaacttgaaacttttgctccagatttaaatgtattagttttacatggtaataaaaatgaaagaaaagaattaataaaaactataaaagataatgatttagtacttacaacttatacaatattaaaaaatgactttaaagaattagaagatatagtatttgattactgtataatagatgaagctcaaaatattaaaaatccttactctcaaaattcagaagctgtaaaaaaagtaaatgcaaaagtaagatttgcacttactggaactcctatagaaaacaatttattagaactatggtcaatatttgattttattatgcctggatatttatattcaaaaaataaatttcaagaaaaatttgtgaaaactaatgataatattaaggaactaaaaaaacagatacaaccatttatgttaagaagacttaaaaaagaagttttatcacagcttcctgaaaagatagaaactaagttttttgtagaaatgactgatgagcaaaagaaagtttacaaaacttatgtagaagatataaaagataaaatgagagaaactgattttgaaaaagataaaataactatactttcgtatctaacaactttaagacaactttgtttagatccttctataaaagtagaaaattataaaggtaatagtggtaaaatagatgttttaaatgagttaataaaagaaaatattgaaaataatcataaaatgctaatattttctcaatttacatcagttttacaaaatataagtaaagaacttgaaaaagaaaatataagctatttatatttagatggaagaactaatccaaaagaaagagtagagttagtagatgaatttaataaaaataaggatataaaagtatttttaatatctttaaaagctggaggaacaggattaaatcttacatcagctgatattgttatacattttgacccatggtggaatcctgcaattgaaaatcaagcaacagatagagcacatagatatggtcaaaaaaatgttgttgaggttataaaattaattgcaaaaggaagtatagaagaaaatatattaaaattacaagaagataaaaaagaactaatacaaaaagttataaatgaagattttaaaaatgaaagtttgataaaaatgttatctaaagaagaattaatcaacttaattaccaattaaatgaaatttttaaacatttatttggtaaaacgcttgtaattaataattatatatgatattattaacacaaatagtaaagaagtgctgaaagattgtgctttaatttttaggaggattccataatgaaacaaggaatagtaaaatggttcaacaatgaaaaaggatttggatttatatctgtagaaggtggagatgatgtattcgtacatttctcagctatacaaaaagatggattcaaatcattagaagaaggtcaagctgttaactttgaaatagttgaaggtgctagaggacctcaagctgctaacgttactttagcataatttatataatatagtatataacactccttaagtatgcttgcatatttaaggagttttcttgtttaaaaaactatttaatcttccaattaagaataaaatttataaaaaatgaataaaattagaacgaagaacaaatgtttggtttgatataaattagttaggagcgaataaattgagtataaaggctttagatatattaaaaaaatactatggatatacaagttttagaaaaggacaagaagatataataaacacaattttaaaaggagaggacatacttgctattatgccaacaggtggaggtaagtctatatgctatcaaatacctgcccttatgttaagtggaatgactatagttatatctccattaatatcccttatgaaagatcaagttgatgctttaaaggctatgggtattaatgcaacctttataaatagttcgttatcttcaagtgaatttaataacattataaatggtataaaagaagatgagtataagattatatatatagcacctgaaagattagattcttatgaatttacaaatattataagatgtaaaaatataagtcaaatagccatagatgaagcacactgtgtatctcaatgggggcatgattttaggataagttatagaaaaatatcacactttataagtagtttagatactagacctattataactgcttttacggcaacagcttcattagaagttagagaagatataataaatttattatctttaaataagcctaaactatttataacaggatttaacagagaaaatttaaatattactatagaaaaatcttcaagtaaagatgaatacttattaaaatacatagaaaatcataaaaatgaaagtggaataatatatgcatctacaagaaaagaagtagataaaatatatgaaggactacttaaaagaggatatagcatatctagataccatgcaggcctttcaattgaagagagaaagttaaaccaagaagagtttataaaagataatataaatataatggttgcaactaacgcttttggtatgggaatagataaacctaatataaggtatgtaattcactataatatgccacaaagtatagaaaactattatcaagagataggaagagctggtagagatggagaaaaaagtgagtgtatattactatttactccaggagatatacatatacaaaaatatttaatagaattaggtacagataaccctgaaagaaaaaatatacagtataaaaagttgagagaaatgtctgacttagtatatagcaatgattgttatagaaaaaatattataaattattttggggaagaatttaaggaaaaatgtaacaactgtagtaattgtttagatgaaggagagataatagataaaacattagatgcccaaaaagttatatcatgtatagctaggatgaaaagaagttttggtataacaatgattatagatgttttaagaggatctaaaaataaaaaagttattcaatttggttttgataaactatcgacttatggaataataaaaaactactctcaagatgaattaaaaacttttataaataccttgatatctcatggatttatagattcaatagatggtacatatcctactataaagttaaatgataactctataaaagttttaaaaggggacttaaaagtagaatttaaagaaagcaaagtgtctaaagttttagaggtatctaatgaactttatgatattttaaaacaaactagatacaatatagcaaaagaagaaggagttgctccttatatggtatttggagatggaactttaaaaatgatggctagtaaatatcctacaactaaagaaactatgttgagtatatctggagtaggagaaataaagtatgaaaagtatgctaagccatttgaaagtgctatattaagatatgtagaagaacacaatatagtgcctaacaatacatataaaagcgatactaaagaattaaattttatagaagttacaacagataaaaaattatatgaacaattaaatgctaaaaggcaagagctagctaataaagaaagagtattaccatctatgataatatctaaaaattctttaaaagaaataagtggtagatatcctacaaacaaaaaacaactaaaagatataactggatttggacctgttaaagtagataaatatggagatgattttctagaaatcgtactagattatataaaagataaagaaatatctacaagttggatagagaaaaagaagttaaaagtaataatagatggagatagtagaagtaatgaagaaatagcaatagatatgataaaagacaataatgagttagattatatatctaaagaaatagaagtatcaatatctactatacttggatatataactgatatgataaaatcaggtaaggaaatagattttaaagtaaatttaaataagtactataatgatgatgaaaaaaatatgatattaagtatatgtgaagaagagggaatagataaagtaagtaatataaaaaagaagttacctgataatataaaatatgaaactataagagcagttatattagaaaattattattgtataaaataagatatattaattaaagtgataaatccatagctaaaatagttatggatttttatatgtaagtaaaaaatttataaaaagtaacaaatttcaggaaaacatcttgactttttcctaaaaatcatatacagtatattgtatacaatattaatatgtttaaaaaaatatcaacattattaaatggggtgtcaagacaaatacttgctctagagagagtaaatagtcaaagatgtatagcgaaagatttagatacaacaaaaactatatttgaaaataaaagataatactatggattaatccatagtattttttattatataaataatagactatcttaagatagtctatttatgttaagtatttaaaatttctttatttttatatgaataaacaaaatctataacttttccacttatactaacggaaattaaagataaagctatttgagaaaatgataaataaaccaaagataatcctaatatacaaaaatcagttatcatataaacgttaccgatttttaaagatgtagtcttagaaattactaatgctaaagcatcatctccaccagctgcacctcctgctctaactactaatccagaacctaatccaacagataatccagcaattatacttcctagtattaaattatcgaatttaggtataactggtcctatactttcgaaaaagctaaatgatatagaaaaacttatagtagctattatagagtacttaataaattttttaccaaaaaacttaaacccaattagcagtagcaataaatcaataataagatttgctagtgaaagtttaatgtcaaaaatattttttaacagtagtaaaaaacctaacactccaccttctgtaatattattttgatagttgaaattataaactccaaatgccagtattagtgaaccaactaatactaataaaatttgttttaatgatcgccgcctggccataatatcccttccttttctttgatttactattattatatagaataaaggtatatttgtatacatcaaaaaaacaaacataatattatacgaaaaaacaatgttatttgcaactgttttttctatgttttttttaataaaaaatatatattgttgaatctcagtattttcaacagttaaatcgaattctataaaaataaaaatttatattaattgttattaagtttagtttttctaatcttatgtttatattaatttttgttttatttagtaaaactaaacttaataacataattaataaaagattttttattatatttacattttatattgacattgttagcaaatatgatacaatgataaaaataaaaaatgagaaataactttgtataatcccaataatatggtttgggagtttctaccaggttccgaaaaatcctgattacaaagaaaatactttaattgtattttctttgtaatcaggatttttatatatatttttaaaagtaaataaaacaaatattaatttatataaacaaagattaaggagaggataatatgaactttaaaaatttaccaaaaatagaattacattgccacttagatggaagtgtcagaccaagcacaataatagatttagctaataaaaacaatatagatataccttctaaagatttagaagaaataaaatctatgatggtagctcctaaggattgtaaatcgttagatgaatatttaaaaagatttaaattaccaggacttataatgcaagataaagaaagtttagatagaatagcttttgaattaatggaagatgcatttaatgaaaatgtggtatatatggaaataagatttgcaccacttcttcatataaataaaggattaaatactaaagaagtaatagagagtgtattaaatggtataaaaagagcagaagaaaaatacgatataaaaggtaatttaatattatcatgtatgagaactatggacgttgaaagtagttatgatgttatagaagcaggaaaagaatttttaaacaaaggtgttgtagctattgatttatgttcaagtgaaaatgaacgattctctaaaaaatttgaagaacctatagctttagctagaaaatacggatatagagttactatacatgcaggggaaactggaataggagaaaatgtattagaagctgttgaaatcttaaaagcagaaagaataggacatggtgtatttataaaagattgtaaaaaagcttatgatgtagttaaacaaaacaatgtaaccttagaaatgtgtcctacaagcaatttacagactaaagctataaaagatatagttaactatcctttaaaagattttcataaagacggaattaaagtatctttaaatacagataatagaacagtttcagatatagatttaagtaatgagtacgatataatattaaatggatttaatatgaatgagagagactataaaataatatatttaaatagtgtagaagcttcttttgcagatgaaaatactaaaaacaaattaagagattatataaattaataaccaaaaaaaaagtattgttttgaactagcaatacttttattttttgatatataatatattatgatatcacaagagtgaagggtggtagatcttataaataatataaaaaataatataaaaagtaatgtgcaaaataatatcatatacaaacaaataaatataaatgacgtaaattcaagagctgcagctatgtcttattatttattgctttctatatttccatttttgatatttatgataaatttattaggatatatacctataatacatataaataagtttttgcactcatttgatgatttaattccacatagtgcctttgcacttatagaatctataataaaatcggcaatacatgatagaaatataagcttgacagttgtgagttttatttttactttatggagttcatctagggctgttagagtgtttataaaaggcataaataaatcttatagtcttaaagagacaagatcattttttaaacttatattaatctctttttattttacagtagaacttatagttttaatagtttcatctatggtatttttattatatggagaaaaagtaggatttgtagtatttaaattcttaggattaagtaagatatttattccaacatggaacttatttagatattcatttgtaatagcgataacaatatggatagttagttctctttttagatacggtccaaataaaaagattacattgatagaggctatgccaggggctgtactttctatatttggatggatattagtatcagttgtattttctttttatactaataatttttctaattatcaagttatatatggaagtataggaggtataatagcacttcttacatggttttatttgagtagttggattatgcttttaggatgtgaaataaacgctcttatatattataagggtgaaagatattaaaaaattataaataagggagataaacatggataagaatttaaattgggtaaatgaaaaaagaattgaaagaactattaagtcacttgaaaataacaatatgaatggatatttagtaaattcaaatgaagaattaattcagaaaataactgaattggttaaaaaagattcattagttgcatgtggagggtctcaaacactttttgaaacaggtataatagatcatttaagaagtggaagatataattttttagatagatatttaaaaaacttaactcctaaagacttaaaagacatgcatagaaaagcttttctatcagatgcatattttactagtactaatgctataacagaaaatggtgaattgtataatgtagatggcaatggtaatagaatagctgctatgctttatggaccagataaagttatagttatatgcggtataaataaaatagtaaaaaatattgatgaggctataaaaagaaatgaattattatcaggaccagcaaatgctaaaaggttagacactaaaactccttgtaaaataacaggttgttgtatggattgtaacagtagtgataggatatgttgtgaatattcagtaataaaaagacaaagaacaaaagatagaatacatgttatatttttaaatgaaagttttggttattaaaaaaaaccgtaataaacaaatttaactagttaagtgattgtttattacggttctttttttatataaatcactataataggaataatatgtaattaaatgtttaaactacatattaagagtattgtacggaggtgatattatgataagagaaagaagaataaataaacccatagttgctatagaaaaaggtattagtgaagggaagtccttagaaaaagcactagatatgttacccattaatgaaattataaaaccaggagataaagtagtaattgctccaaactgggttaaagattataagccaagctcaggaacagttgtaggacctaataccttaagaacattgataagatatattaaagagaaaaatcctaaaagcataactatagcagttggagctggaggggctaaaacaccagatgttatgaagaacgtaggatatgataaaatacttgaggaagaaaatatagaatttgttgacatgaattatggtccatatatagatttagatataaatcataatataataaaatctactcctataaataaaattgtaaatgaagctgatgttataatatcttttactcaacttaaaatgcacgaagaagctactataacagcaagtattaaaaacatagcaatgggttggccaccagcagagattcatggatatcctaagaaaaaaactggtatacatgaagatttacatggatttataagttgtataatgaataagattcctatagatatatctattgtaagttgtgataaagctatgattggaacaggacctacaggaggaataccaattgatacaaatggacttataatagttggaacagatcctgtagcagtagatactataggtgcaaggctattaggttttttacctcaagcaattgcatacctgtataaactatacaacgatggtatcggagaagctaaggttgaaaatatgattattaaaggaattgaacttaaaaaggctgaaaaattatttacaaaagctgcatatggtaaatctgttatactagataataatgaaataaaaaacatacatggatcgcaaccaaaataaattaatgctaggagaatttatatgggttatataaattttaaagaagaagtttttgtagctcaaaaacaattaaaaaatagaaaaaagaataatgaaaatttatttaatgatatggtaaaacataaagatttagctaaaaactataaaccttgtaaaacttatagttataaaatatttaatgaagatgagtttggtaaaaaaggaatcttggatgaagataaattttctactatagaaaataaggatatattatgttcaaaatttataggatgtaagtttgataatataaaatttaaagaatgtagatttataggatgtacatttgaaggttgtgaatttggaaaaggcggagtagcttttgaaaattgtagttttctaaaagaagatagtaatagtaagccatctttgaataaatatgataacttctcatgtacttttatacagtgtgatatatatgcaaaatttttaaattgtgtattagcctttgtaatttttgaacattgtaaaattaaaaatacaaattttgaacaaagtgatatgaatagtgtaataattaaagatagtgaattaaatatgataattatttcagattgtgatttatgtggagttaaagttttttcaacatatattaaagatttagagtttagagataagtttcaaactaaactagatgaaaaaagcttttttgataaaatatctataagaaataaaactaaagaagaatacgaaggtatttatatggtatatgaaactatagctgataaatttaaagaaaactctttagataataattttggagaatattattatttatgtaaaactacacaaagaaaagctcttaaatttatacctaaaattgaatcttatttatattggctaacatgtggatatggagaaagaccagaatatgcaatatattcatctttagttattatattagtatttgcgattttatatttatttttaggagttgaagtagatgaacaagtagttatatataatatgagtacaatgaaaaatttatcattaccaacatttttaactcattttaatgaagccataactttaagtgtaggagcatttggaggagtaggaacaataaattgcgagccaacccaaacaagctatattttaactaatttagaaattttaattggtattattatgatgggattaggaataggtacattaactagaaaagttgtaagatagttaaacttctaaattgtcgataaatgaggagtgaattttaaaagttttatatttatgtagtatttccaagccttgagtgtacactcaaggctttttactccatatataagttaatataaaacttatatatgataatattaagggagctattaaatagctcccttaaatatttaatttaaatatataactacattcagttattagcttaaatagtgtataattactaggagaaacaggaggagatgatatgcaaaactacataaaatttgaaaatgtaaaaaagacctattctatgggagaagtaaaaataaatgcactagatggtgtagacttcactatagataaaggagaacttgtgatagttgtaggagctagtggagccggaaaaagtactatattgaatatactaggcggaatggatacctcaacatcagggagtgtattagtagataataatgatataagtttatataatgaaaaagaattaactaagtatagacgacatgatataggatttgtatttcaattttacaacctagttcaaaatttaactgcaatagaaaatattgaactagcaactcaaatatgtaaaaaccctttaagtcctgaagatgttataagttctgtaggccttgatcatagaaaaaataacttcccatctcaattatcgggaggagagcaacaaagagttgctatagctcgtgcattagccaaaaatccaaaacttttgctatgtgatgaaccaacaggagcactagattataacactggcaaaaatatactaaaagtacttcaagatacaaataaaaaccttggaatgactgtggtaataataacccataatatggcaatagctcctatgggggataaagttataacagttaaaaatggtaaagtacataatgtattaaagaatgaaaagcctattcctatagaaaggatagagtggtaagaatgaaaaaccctttacttaaagatacatttagagaaataaaaaaatctaaagggagatttatatctgtatttgccataataacattaggggtttctttttttactggtataaaagtcgcatcaccagttatgaagctaactgcagataaatattatgatgacaataatttaatggatataactgtaatatcaaatttaggattaacagatgaagatgttaaagctatttctaatgtggataaagttgacaatgtatatcctacacactccaaggaagttttaacaagtattggtaccaatcaattagttttaaaggttcatggattacctgatgatgaaaagaacaaagattacataaataaagttaaaataacaaaaggaagatatcctaaaaacttaggagagtgtgtcatagaagactcgttaaatattccaataggaagtaccctaaagctttatggtgataataaagaagatctaagtgatactttaagaaatacagaatataaagttgtaggaaaagttgaaactccatattatatatcaaatgctaaaggtagtagtaatataggtaatggacaactagatagctttataatggttcctgataaggaatttaagttagatgattatacagaaatttatgttacagctaaagattctaagaagtttaattcttatgttaatgagtatgaagatcacataaaagaaactaaaaatactatagaggatataggaaatttaagagcaaatttaagatatgaagatattaaaaatgaagctaataaaaaattaaatgaaggaaaaaatgaattaaaaaatcaaaagaaaaaagtatatgaagaactttctctagctaataataatctcaaaaaatctgagaaagatcttaataatagtttaaatgaattaaatcaaaaagaaaaagaattaaacaatactttttctttatcagaagaaaaaataaaagaagaagaaaataaattagaagatagtgaaaaacatctaaatgaaaaaatagaagaattcaataaaaataaagattctattcaacaacaaatagataagtctaaggaagagttaaaggtaaaagaaagtgaaattataactcttaaagattatatagttagtatagaaagtttaatgtctaatgagtatgtagatgatgctaaaagaaaagagctagaagtcatatcgaatcaaagtaaagagaaattaaaaatctcagaagatttattaaacgattctaatgaaaaactaaaggctaaagaacaatcatttaaagaaacagagtcaaaattattaatggctaagaatgctgtagaaaaaggaaaagaagaaataaatcatcaaaaaagcaatataaaaactaataagaaagaagcattagatggacttgaaaaagctaaagccaaactaaataaaggtaaagaagctctagataaaggtaaaaaagaatataataaaaataaagaaaaagctgaaactgaattagaaaaagcagaagttaaaatattaagagagaagcaaaagattaaggatataaaatctggaaagtggtatgtacttgatagaaatgcaaactacggatttgtagattataaaaactctgcagaaagtatagaatcaatatctaaaatattccctgtatttttcttctcattagcagcattaatatgtttaactactatgactagaatggtggacgagcaaagaataaatataggtactatgaaagcgttggggtataactcaagctctatagtgcttaaatacgtattatattcattaatagctagtgtaggaggaagtattttaggaaatataatagggcttacagtttttccttcaataatatacaatgcatatacaagcacgacttatacacttccaagtgttaatttaagttttgatatgaaattattgttaatatctactataatagcagttctaacaactacgttagcttctgtatattcttgttacaaagaattaaaggaagttccatctacattgatgagatctaaggctcctaaagaagggaaacgtatattacttgaacgtataccatttatatggagtagattaaactttacacaaaaagtaacttgtagaaatatatttagatacaaaaagagattttttatgactgtaataggtgtagcaggatgtagtgctcttttagttactggatttggaataaaagactccatatcttctatagtagataatcaatacaataatgtaatgaagtacaatttaacactgacttatagtaaagatgtgaacaaaaatgttaaaagcaatgaaataaatagtataagtaaagataatagaattaacgactatttaaatattaaaagtaaaagctttaaagtaagtaaaaactctaatcaaaaagatgtaaatattatagttcctgaaaataaagataatataaataaatttataagtcttaagaatagggtaagtaataaaacgtataaattaaatgataatggtgttttaatttctgaaaaactagctaagctacttaaagttaaaacaggagatttaataactataaaaaatgaagaaaataaaacttttaaagttaaagtagatggaatagttgaaaattatgtaggtcactatatatacatgagtcctaaattatacgaaaaaacatttaaagtaaatgttaaattcaatcaaatacttataaatacaaagaataataaaatatcagaagacgagttaggaaaagatatgatgaagttaaagaatataagttcagctacatttaatacaaatgcaaaagtatctttttctgatatgatatctaatttaaacagtgttgtaatacttataatagtatcggctggaacactagcctttatagttttatacaatcttacaaatgttaatataagtgaaagaataagagaaatagctactattaaagtattaggattttatgataaagaagtatcttcttacgtatttagagagaatataattttaactataataggaacaattttaggtcttttcctagggatttttctacatagctttataatgactacagcagagttagattttgttatgtttggaagagaaataaaagttataagctttatattatcagctttactaacatttgtatttgcaacgctagtaaacttgtgtatgtattataagttaaagaaaattaaaatggttgaatcattaaaatctgtagattagtaaaggaatatataaaatgatatatgaaaatatggtaaaggctacatttataaaaagacctaatagatttatagcacattgtattgtaaatggaaaagaagaaatagttcatgttaaaaacactggcaaatgtagagaactactaattgaagggtgtacagtttatcttcaagaacacgataatccaaatagaaaaacaaaatattctttaataagtgttttaaaaggagatagacttattaatatggactctcaagttccaaataaagtggtttatgaggctttagtaaataaagatataatactaccaggtttagatgaagaaattacctatataaaagctgaaaaaacatataaatcttctagatttgatatttatatagaaactgaaaataaaaaagcttttgtagaggtaaaaggtgttactttagaagaaaatggtgttgtattatttccagatgcaaagactgaaagaggcgttaagcatattaatgagcttgtagaagctagtaaagatggatatataagctatatactattcgtaatacaaatgaaaggtgttaagtactttacacctaatactaaaatgcatgaagaatttgcaaatgtattaaaaaatgctagtttaaataaagtaattgtacttgcttatgattgtaatgtagattataaatctataagtataaatgaaaaaataaaagttattttataaagttttaaatggtgtaacttagttattaactaggttacaccattttttatatttaaacggaatataaaagttacaaaaaggttacatattttgaaaatccctttaatatacattactatacaagattaataaaaataagaaaggagattttatatggagctaaaaaataagaaaattttaataggattatgtagtgtattagctatagttggaggattattttacggttatgaaacagcaaagaaagaaataaaaataatctctaataaagaagcaaaagaaatctctacttttaaatatactatagatgaagttataaaagagcacaatttaaaatttgataaaaatgatataataaatttgactttaaatgaaaataaaaaagaaaatgctaaattagatactaaattagaggacaatatggttatagaacttgtaaatgtatctaaaggaactatatctgaatataaagaaatagattttgaaaccaaggttgtgtcagacaaaaacttattaaaaggtaaatcagtagtatctcaagaaggagaaaaagggaaaaatagtttagtatacgatgttgtatatcacaatggaaagctagtagaaaagaatttttcaaaagagctagtatctaaaaaacctcaagataagataattaaaaaaggaactaaggtagttgaagaagttgtagtagctacagctagaggcgaaaatatgaaaagagagtctaaaacatctttaaacacatcaacaaataacaattcagataaaaattcaagcgattcttcaaacactgtagtagcttcaagcaactcatcttctggaaaccatatgagtgtagtagcaacagcttacgcaggagatactataactgctacaggaacagttcctaaatggggaactatagcagttgatcctagaattataccttatggaactagagtttatatacctcagtttggccaaacttttatagctgaagattgtggtggagctataaaaggtaataagatagatatctttatgaatagtgagggtaaagcctatgattggggaagaagaactatagatatatatatacaaggataaaataaggcatatactgtattttttatatctttaaaggataatttattagaaaattcagaaaataattaaaatactattaaaacatagatatacttatagagattatacattaagggggataaaatatgaataaccagttagaaatgtttaaaaagttaacagaagctaaggggataccaggaaatgaaaaagatataagaaatttaatgaaagattatataaatcagtatgtagatgaaatctcaacagataaactaggaagtcttatatgcaaaaaaataggaaatgaagatggccctaaaattatgttggcagggcatatggatgaaattggttttttagttgcaaatatagatgataaaggttttataacttttcaaacactaggtggatggaatggtaaagttatggggagtcaaaaggttataataacgacttctaaaggtgatgaatacataggtataataaattcaaagccaagtaaagatgctaaagcctctatagataaagatactatgtttatagatataggagttgactcaaaggaagaagttgaaaaattaggtataaggcaaggagatatgattactccatactttgaattttctaaaatggcaaatactaaatacttattagctaaagcttgggatgatagagttggatgcgcattatgcatagatatattgaaagaaattaaaaatcaaaaacatgaaaatatagtatatgctgtaggaacagtacaagaagaagttggatgcagaggtgcaaaaacagcttctcaagtaataaacccagatgtaggtttttcactagatgtaagtatagctaatgatactcctggaaatgacactagattaggtgatggtaaacttggtaatggccctcaaatacatatatttgatggaggaactgtaggtcatataggtcttaaaaattacttagtcaatttggctgaagagcttgaaataccatatcaaataaatgctcttccatttggtggaacagatgcaagtcaaatgcacttagcacatgatggagctccatgtattagtataggaattcctactagatatatacattctcatgctagtataatacacaaagatgactatgataacacagtaaaacttatgagtgagtttataaaaagattaaataatgatgagtacaaaaagatactagaattttaattttaaatgataaaattaaaggactataggcttaacctatagtcctttttctatttacaatataatcgactacatatcccataattatagcccctggaatatcaataataagtcttattaaagtaaaatcagagcctagcgcactaatttcaaataataaagtagaaaatttagtaacacaccaggcatttaaaaagattatcatattagaaaatttaactcctttttttatcaatacagcagtaaatggaaatgctgcatacataggtccagcagaaaaaaatgcaattaaaaatgtcaaggtaattcctataactccagagtttgatcccatatattttataaaatactctttaggaacccatacatctaaaaggcctaaaagtatcattatagctggtaatacagataacatttggtctatactagatttagtactaataaaaatattgattcccaagttactatctacaaagtatattattatacatatcaaaaaacttattaagaagtacttatatctattaattaaaaattgtgcattcattatcctaaaatacctcctatcattattgcaactacaaatgaaaatataaacgcaagacagtttctataaaaagctgcttttttacctatatatttagcttctaaagataaagtcaatattccaaccattgtagaagttgaaataaaagctgcaacttgagcatatccagcaccactttttagtaatgaatctccagtagaaaatgccacaaatgtaggtattgtagtaatagaccctatggcagaagaaatggttattccaaatagaccagaatctttacctatgagatttgatatagaagctgggtctaaaatagataaaattactcccactagtatagctataaaaagaaattgcggcattatattctccagggatttaagtccatttataaaagcttgtttagttttttctttatcttttataaaagaaataatacaaagaattatacaaatgccataaagaataaaagatgtcataaaaaacctccttagttttattaaatataatatgagttttattaaatattagtgatttgtttaacttcctaagccttatgacaaaatacatcaaataaattaactttgaaatgaatttaaaataaatttattcctttaatattaatataattttaaaaacacgaataatatatgatttaaaaatgattttgtactaaaatatcgaaaaaggtaaaacgaaaatcaatatatatagtactaaattactagaaatacgaactatattgtactagaattaatgttagttttgatatttaacagtacttagggagggaatagaaatgaatttaaattatcaaaatactaaaactttaaaatcatttaacaaaaaaaagataaggctaacagaatctgaggcttttaccaggagtattattatttatagctactgtagctgcattaataattgccaatagccctttggttagtttttataattacttatttgaaggaataattatatttaatcattttaatttacatatgattgttaatgattttttcatggctatatttttcttagttgttggatgcgagataaaaaaagaaatattgtatggaaatctttcaaatataaaaaaagctgcatttcctataattgccgcttgtggaggtgttatttttcctgctataatttttttcttattcaactcaaaaactccttattctttaggaattggtatacctatatctacagatatagcttttgctattggagtttttatgatatttaaaaataaattaagttcttcactaaaaatatttttattatcattggcagttgtagatgatttattatcaatactcatgatagcacttttatattcatcagattttaactattatgctttaggatttgcacttataattgtaggttttatagtgttattaaataagctaggtaaaaaagattttttaacaccttatttgattctaggattaattctttgggtttcgctttatataagtggtatacatgcaactatagctggagttatattagctatgatgtttcctactaagagaaaaaataaaaatagcaaggttgatgtaactaaaaaagtagaaagattttttacgcctttatgtaaccttataatacttcctatatttgctttttcaaatacaggcataagtttagatataagttttaatatggcaagtgctgagaatttaatgagtggtgtaatattaggacttgttatagggaaaccacttggaattatgttatttacatatttatcaactaagtttcacatagctgaaaagccaaaagatgctagatggtcatcaatattcttagtttctttaattgctggtataggatttacaatgtctatatttgtaacagaaattgcatttgaaggaaatttacaagctataaatttagctaaattttcaattttgatagcatcacttttatcttgtactctagcctatattggtatagaaactatgcctaagatagtaaagatatactgtaaaaaatctaagaaattagcattaaataagtaattatatcaatgaatatctaaaattttagatattcatttttttatttgcagaattatgcaaaatttttttaaaaaatatgtatatatattgtataatggtattaatattttaaaagttactaagggggacaaaatgattgataatcttattatagttagaggtgctggagatatagcaactggtgttattcataaacttcatagatgtggttttaatgtattagcattagaagttaaaaaccccttgtctataagacgaaaagtatgctttagtgaagctatttatgatggtgaagtatgcatagataatgttacatgtaaatttgtaaaaaatgaacaagaattaaaagatgcttttaatttaagaaaggcttgtgtggccattgatccaaagggagatttaatttataagctaaagcctaaagttgtagtagatgcaataatagctaaaaaaaatataggaactaatattaatatggcacctattactattggattaggacctggcttctttgcaggaaaagatgttgattttgttatagaaactatgagaggtcataatttaggtaagataatagacaacggttttgcaattaaaaatacaggaatacctggtaatataaatggatttagtaaagaaagagtagtgtactcaaaagaatcgggaattataaaaaacatttgtgatataggtgatatagtaaagaaaaatcaagttatagcaactataaatacgggtaataaatatgtagaagtattagctactatggatggacttttaagaggtatgataagggatggaagtaatgtaagtaaaaacttgaaaatcgctgatatagatcctagggttgatgaaattaaaaattgtgatactatatcagataaagcaaggtgtgtagctggcggagtattagaggctattttaatgaattggagtgacatataaatgtatgaaggtatattaaagcaagtatatgaagagctagaaaaaggaaaccgtgtttgttttgttacacttacagaagtcaaaggatctagtccaggaaaacaaggtgctattatggcgtttttcaaagatggaacaataaagggaactattggtggtggacttgtagaacattctgttataaataaatgtagagactgtataaaaagtggagaagattttaactttgaatattctttaaatgaagaatctttagaagctactatgaagtgtggtggctatattaaaggatatataaaagtatttaagccaaagcctaaacttttaattattggaggcgggcatataggtcatgctgtatataaaatttctaatagtttagatttttattctatagtagtagatgatagaagtgaatttgctaataaagaaagatttaaaggtgtagatgaagtttattcaggaagcataaaagaaatattaaatgaaattaatttaagtgataatacatatgtagttatagctactagaggatatgaaaaagatatagaagctttaagagaaataataaattctgatgtagcctatataggaatgataggtagtcgaaaaaaatggaagtctttaaaagatgaacttattagtgaaggagtatctagtaacttattgaataaagtttatgcgcctataggacttaatatatcttcaagtagtgtagaagaaatagcatttggcataatggctgaaatattattagtaaaaaacaatggagaactttctcatagaaaagataggaagtaatatatacttcttataaagaggtgttgtaattatgatggataggtataatagagaagtaaataaacttattatatcattaggtaaaaattctattttaagtgtaaatgatttgaagtttattatagatggtgtaactaaacttggtataaatatgattgatttagatttagatgacagtattgatgaattaaaattatatgatttaatttactatataaaaaatgagtgcaatatagattatataagtataataactgatggaaaaggaattagcgataaagtaagaaatatattcttttgatattgtatatataaatgttgcacttctttcattttatctttcatttctatttgtaactttgaagctagttcataatctttactttctatagcttcctttatttgagtaaataaagattttttactcatagtatctttcattaaataatgttttaaattatttatattatcccaagctacttcatctaatgtattcatatcatcagtatcatgtaatttttttaaacttcttattatatctatattatcttgtataattctatttttaagttcttttttccatttatctattgccccagttttaaatgaatttataattttctcagtaaatacatccccttgtattaaagattctattttataactttgaatttctaagtttttcatattctcataaactgtagctggtggaattgaaaatctttgatttctttcttcaatactataatcttcaaatacatcattctcatctctatatgatctatctttttctaaataaaatccatcttctccaatttctttagataattctttttccaagtccttagtacttaatttactttctgctactgcttttataccatgaagtatagtttgataagctcctgctataactaagtatgtatttgatagtggatttggtgatcttaattcaaatcttgtagacaaaggactgtttatatctcttataagacctactaaaatagatctatttctagatggtaactcataagtatgtcctaatgatgtaactatacacacaggtgcttcaaatccaggtactaatctattaaacccatcatttgatgatgttacaaacggatttaacacttcataatttttaagtatacccattaatgccccatatccaaatttagttgtataatcacttgtcatgttatatggagaaaataaatttactatttttccatttttaagttttgcacttataccaaagtgtgtgtgttctccacttccagctactccatctaaaggcttagccttaaatgtaacttctagtccatttctagaaaatacatcctctataacttctcttgctagtaactcattatcagcacattgaagtggtgttgaatatttccaatcgatttccaactgctccatagcatgatttgttttaccatctatgcttatagaactagttattcctcctacttctttgtgtcccatttctggttctaaacctaatttttgaagtattattaaactattttctaaacaagttctaattattccttttgttcttttccaatattgttccttaaggctttgagatacatgaagtgcttctaaatctactttatcttctggagtattaacccaaaattctaattctgtagctgaagttaaatttatactttctatatcatatgggttttctatttctaattcttcaatcatgtgtggatatttatgtattatctctagtatagaatcttttatatactgttctgatttctttagtatacctcttgaacaaactctcttaccttcatgcaataaaaatgatggtatttttaaagttcctattggtaagttgcacttatcgcatatattttccatattataatctatataccatacagcatcattatccggcattaaatctacttttgcattgtttagtgttgctatgttatataattcaacactcgaaccatctgtttgtataccagaatttaagaaatcattaatatcttctaggaaaactttaataggtattttttcatctatagcgtttccgcctaggtcaacacccataagtgaaacaaacattatatttttatgcttagatagtatttcttttaaatctttttcgttgtgattttctttttttataacatataataaagattgcattgttgttcttcctttcacttattttattttacgaattgtacattacaatatatttaacaataaattgtagtttaagttcgcaagttaatttatattattatagtataaagatataatattcgcaatatttttcacttttaaacttaagtttaaaatcctatgtataaatttttttttacatagggtatactaaattaataactaataattttaggagagatttgtatggaatatatagttttcgatttagaatttaatcagggatttgataaagagaataataaaacatactctgatgaaaaatgtccctttgaaataatacaaataggagctataaaattagatgctaatttcaatataattgataaatttagcagttttgtaaaaccaaatatatataaagatattcatccttttgttggtaagatgactcatataacactagataaagttaaagacgcgccttcatttaatactgtgtataaagactttaaaaaatttatatcaagtaagtccagtataatgtgtgtatggggatcaggcgatttaaaagaattgtacagaaatataaattattattcacttccatcaaaaggattacccaagctctatataaacgttcaacaatatgcttcatcttactttaataatccaacaggacaaagtataggtcttcaaaacgctatacagatattagaccttcaggaaaataaagcttatcatgatgcattaaatgatgcttattacacagcattagttcttaaaaatatttataatgaaaatatagttgctgatacttatgtttatactccagtaaaacctaatagaactagatcaaaatcagctaagaagaaagttgattataatagcttatttgaggaattcaaaaaaatattaggaagagatttaacttctgatgataaaaaacttatagatttagcttataaaatggggaaaaccaatcaatttttaatagatgaagcttcacaaccccaacctaaaactaaaatttcaaataaatttattaaaaataaatctaaaaatggatttaaatataaaaaaagaagataggtcttataaattaggacctatcttcttttttatacatttaaaaataacatttttatttcttcatactgtgcaaattctacaatttccacaggtttatcttcacttctatatttttcgtctttacctacatatacatctacattcccaatttgattatatattccatctataatatttaaaaaatcttcactttttaaactttcaccttttgattttaaaaatattatactttcatttccttcatctctaattattgattctattccaaataaaagactatcttcctttatataaacaactttagcacctagtgctattcctttattaactttttctttaagctgtaataaattcataattccctccttattaaaagtatattaaattatattaaagaaattatgaatttatgttttattttataactaattctacaggacaatgatcagatcctaaaatttcagtgtgaatactagctgaaactaatctatcctttaatttttgagaaacacaaaaataatctattctccatcctgcattattttttcttgcattgaatctgtaagaccaccaactataaactccttctttatcaggattaaaatatctataagtatctataaatccagagtctaaaaactcagtaaatttgtttctttcctcatctgtgaaacctgcattttttttattagtcttaggattttttaaatctatttctttgtgagctacatttaaatctccacacattataactggcttgatttcatctaatttatttaaataacttctaaaatcatcttcccacttcattctataatcaagtctttttaatccctgttgagagtttggagtataaactgttacaaagtaaaaatcttcaaactctaaagttataactctaccttcattatcatgttcttcaatatctattccgtaacttacactaagtggtttcttctttgtaaatattgcagtacctgagtatccctttttagtggcatagttccaataatcataatatccttttaattctaattctatttgaccttcttgtaatttagtttcttgcagacaaaatatatctgcatctacctctttaaaataatccataaatcctttagtaacacaagctcttagtccgttaacattccatgatataaatttcatatttttctcctttgtttatctatttaaatattattttttttgcaaagtcttttggcagtgtagaagatacataaattccattacttatctcaaatcctccaaaactatattttctaggtattacatgaaaatgtaaattaaataaatcactacaatctatatttttagggtgcgaatgcatacataaattaaacggcatataaccacatactttatatattttttcaaataactttttaaatatatatgcaagttcatgtatattatcattttctaaatcttcaaacttagtactatctttacatataattctaacttcattactatacatagatgcataaggaactaatactataaatttactaccattatacacgactctttcatttaaacttaattctttttcaattgtctttttgtataaactttcattttcgttttcataatactcttttaatatattaatttcatttttaacatctttaggcaccatggacatggaaataatctgtgaatgtggatggattagagacgcgcctgctttttttaagaagtttttaaatatactaacatataatacgtctttatcatttatatacttctcatatctatttttatacattaaaaacatattattaaactctttttcactcatattataaaaagaaccattatgcctataagtatctatcatcacttcgtgatttccttttataccttcacaactttcatctataattgggtatttattataaactgacctacaaacccactctgacccatcatatatttcaaatgttttttcagctgcatattcttcattacctctacaaaatggacaatttaaatcatatatatcataaacttcttcttcatccataattggtttaatatcagtaggtctgcttgacctatcaggtgcagatataaccatatcaccactaaataagtcaattcttacatctttcataccaagcacctcttctaagagtatttatatatcaaatcatatatatttatatcttatataatattttcacaataatattttgttataactatttttgtaaattaatcaaatacacatttataattttacagattttaacatcaaatgtaaatcctcttactcttttattttaacattaaaaattgaatgatttttaatataacttctgctattatactcttgtaaagatattttacagatttttcaaacaaataataggggggtattaaaaatgaacttttctaatagagttatatctatgcaatcttcacctataagaaagctagttccatattcaacagctgcaaaggaacgaggattaaaagtttatcatttaaatataggtcagccagacataaaaacacctaaaagcttttttgatgctgttaataattttaatagtgatgtgttagaatatgcagtatctcaaggattacctgagttaatagaggaaatgataaattattactctacatatgatatggactttaaaaaagatgagatacttataactaatggtggtagtgaagctttactatttgctatgatggctacttgtgaccctggagataatatcttagtacctgaaccattttatactaactataacggatttagctcttgcataaatgtttgtgtaaaacctataactacacatccagaagagggatttcatttacctaaaaaagaagatatagtttctaaaatagataaaaatactaaagcaatactaatatctaatccaggaaatccaactggttgtgtatatactaaagaagaagtttatatgctatctgatatagctatagaaaataatttatggataatagctgatgaggtttacagagagtttgtttatgatggacttgattatataagctttggtaatatagataaagtaaaagatagagtaataatagttgatagtgtgtctaaaagatatagtgcatgtggcgctagaataggctctcttgcttgtaaaaataaaagtttcatatcccaagttctaaagttatgtcaaggaagattatgtgtgtctacacttgatcaagtaggcgccatagaattatataaaacgcctaaatcttattttaacgaagttaatgaagaatataaaaaaagaagagatgtattatacaatgaattaatgaaagttgaaggagttatatgtgaaaaacctaaaggtgcattttatatacttgctaaattacctatagaaaatgctgaagattttgtaatttggatgttaaatgaatttgaggttgatggagaaactgtaatggtatgtcctgctgaaggattttatgcaacaaagggtcttggaaaaagcgaaatcagacttgcttatatattaaatgaaaacgatttaaagaaagctgctagtatattaaagcaaggtattgaaaaatatattgaaattaaaaataatttagcaactaatatataaaaaataggcattcaattgaatgcctattttttacttgttactcaaattgggtttttatatacttattttaaattttcttttataagtatatcttctaaattttttattgactgcatgaacttatctctatcctcttcacttaattctaaaaatctagattctagctttttacctaattcttctaaaaagtctttagctattacgtctccttcattagttaagtttaatatatactttcttctatctcttaagtcccttgtccttgttaagtatccttttttagttaagtcatctaccatagtagtaagacttcctttttctatatttaatttttcacataagtccgtcattgttatttccccattattttttatgaatacaagtgctcttaattgagttctatttacatcagtatttgctgcatattcttttaaagattctagatataaacttgcatgtatctttggaaaagttttagatacaaagtctataatatcttttattatttcattcatactttcacctccaacccctttagattatcgtcaaatactagtttacactaattcttttgtataaacaacaccaaaacaacaattcatgtttattaaagcttttcaatattttttaaatcttattttattttctacatttttctacatctgaactatttgtaaaattaatatttttataatatttttttaaatttcattttattttctacatttttctacatttttctacattttcatacattttgcactatttacaaaatttacattttataatataattttaatcactgcttaaaaagcgtaacgactatttattttaatcaccgaggaggaaatttttttatgatgcaaattataacgagtacagcattacttttggctgtactagcattattcagtctattttgttacaaagcaccttatggtatgaaagctatgggtgcattagcaagtgctgcttgcgcaagttttttagttcaagcatttcatggtgcattattcggagaacaagttcatattgcattcttaggaagcgttggatctgctactggtagtttaagtggagttgctgcagctatattagttccattagctttaggtgtatctccagtatatgcagttttagttggtttatcagtttctggtttcggaatacttccaggatttgttgcaggatatttaacagcatttgttgttaaattcttagagaaaaaagctcctgctggtcttgatttaataattataatattaattgctgctcctttatcaagaggaatcgctacatttatggatccacttgtaaaatctacattaatgcaaataggacaagctttaacagctgcttcttcaacatctccaatatttatggctataatactaggaggattaataactgttgttggtaatacacctttatcatcaatggcattaacatctgtaataggattaactggacttccaatggcaataggtgcattagcagtattcggttcttctttcacaaacttcgtatttttctctaaaatgaaatttggtgataaaaaagacactatttctgttgcaatagaaccattaactcaatcagatgtaatatctgcaaatccaataccagtatttactactaactttataggcggagcattatcaggtattgtagttgctttagtaagtatgtacgttgctccacttgcaataagcgttcctggtatggctactccaatcgctggttttgctgtagcagttggacaaaacggaactcctgctttaattgctgctggtggatgtatagtagcaagtgtattctctggattattaggacatagaatattcagtaaccacaaaatagttactgttgctgaaatacgtggtgaaaaaaacaacgaatgtactgctgcttagaccagtatgttttacataaaatgatattataaataaagttgcttttacattgttaaaagcagcttttttcatatttaagaacaattttcataaaaaatcttacttattcaaaatataaactagcatatatctactctataataacactccaaaacagcaatctgatgcggttgcaattttaacattatttttcaaactttactttattttctaactctttctacatttttctacatttaaactatttacaaaaatgtttttttataatataattgactcatagcttcccgagacaagcgggaaaacaataacaagcatttgtttattttacatttaaggaggcaatcattatgatgcaaatacttacaagtacagcattattattagttgtactggcattattcactttatttagctacaaagctcctcatggtatgaaagctatgggtgcattagcgagtgctgcatgtgcaagtttcttagttgaagcattccacgcttcattatttggacaacaatttggaataaaattcttagagcaagttggatctgcaaacggtagtttaggtggagttgccgctgctatattagttccattagctttaggtgtttctccagtttatgcagttttagttggtttatcagtttcaggattcggaatacttccaggattcgttgctggttacttaatatcattcgttgttaagttcttagaggaaaaaactcctgctggacttgacttaatagtaataatattaatagctgctcctttatcaagaggaatagctcaagttatgaacccaatagttaatgatactttaatgcaaataggacaagctttaacagctgcttctactacatctccaatattaatgggtataatacttggtggcttaataacagttgttgctactgctccattatcatcaatggctttaacatctataataggattaacaggtcttccaatggcaataggtgcattagcagtattcggttcttctttcatgaacttcgtattcttctctagaatgaagtttggtgataaaaaagatacaatagctgttgctatagagcctttaactcaatcagatataatatctgctaacccaataccagtattcactactaactttataggtggagcattatcaggtgttgtagttgctttaataagtagttatgttgcaccacttgcaataagcgttcctggtatggctactccaatagcaggttttgctgtagcagttggacaaaatggaactcctgctttaatggctgctgctggatgtatagtagtaagtattgctgctggatttataggacatgcattattcaaaaactacaaaatagttagagctgatgtaatccgtggaaatggaaataacgaagatacagctgcttagtcagttattatataaaaaaagcacatcaaatgatgtgcttttttatttttacttatattagttatttaacacaaaatattcctaatatgcctggccctgcatgagaccctacacaagatccaacatctgtaattaatatatcactaattctaagctcattatttgtcatatctcttaattttgtcatatcactttcacaatccccatgtcctatagcaatacccattccctcagtatagtgttttttagctaaatcaaccattttagcaaatacgtgtttttttcctcttgcttgagccactggtgtaactagtccatccttaacttctaatataggttttatattaagcatattaccaattaccgccttagaagaagatattctaccacctctttgtaaatactttaaatcatcaacagagaatacaacatacatattatctctcatgtactctaattcttttataatctcttctatagatttaccttcacatgccatctgagcagcttttacaacctgcataccacatccatatgaaaaatttaaagtatcaaatgtatatatttttccttcagtatcatttttagccataacagcactttgataagttcctgtagctttagatgatcccgatatgtataatatttctttaccttcttttataaatttatcaaatacttctttaaattgagtatatgtagcttgcgatgtttgaggaagtttaccttctcttaacatgtcataaaaatttttaggttctaaatctattccatctttatattcatcttctccaaatctaacagttaaaggaaccatttctatatcatatttttcccttaaatttttaggtatatcagataaactatcacatattatctttaaattatccataataattcctccttcacaaataatattatacaataaactcagattctattaaaatttagttgttaaaaaaagcatagtttatctttatcaaattctatatttataaaatttccactaagtgaattcatatcagtcttttttatattaatataaataggagataatttatcagacttagctttttttaaacttacagtatagtcaaaaggattttctataatatttataagttccatattaaatacctcagtccttctattattactaatttttatatcatcttctcttatacatacataatttaaatcttcatttatactcatattgtttacatttatataaatatcccaatctatggcataaataacttcactttttataaatttaatttttgatatatttttaaaaccagttaatttagcctctttcaacgattttggacttttaaataattcatctttacttcttttgttgattgctaacccattatcatatacaactatatcatcacaaactctataagcttcatttatattatgagttacaaatatagtgttaccttcatagctcttaagtgtattccttaaattttcttccataatatctcttagatgataatcaagagctgaaaatggttcatctaaaagtaatatttcaggttctttaactaatgctctagccaatgcgactctttgttgctgtccccctgacaactgatttggatataaatcttttaacttcttcaaattaaatttatctatatattcattacaaatttcatctgcagcaaatttacttttattgattaaccccaattttatattttcatcaactgtcatatgagggaaaagtgcataatcttgaaatacaaaacctacatttctatcttgaggttttaaatttatatttttactagaatcgtataacaccttattgttcactataatctttcctttatctggggtttcaagtcctgctatacattttaaagtaatacttttaccacaaccagattcccccaataatccagtaattttattattttgatttatatttacctttagaacataattatttaactttttttctatatctatatataaagacatctttaatccctctttccaagttttctaagcttagattttgatatacaattagacactactataactatagatgataatccaatcataatcataacccagagcattgcttgattcatatttccgccttcagcctcaaaaaatatagctattggcatagtttgagttttacctggtatattccctgctatcatcaaagttgctccaaattctccaagtgccctagcaaaggatagcactactgccccaattattcctggataagctaaaggaataactattttgtaaaatatctgcttttcactaagtcctagtgttctagctgcgtataccatattattatctatttgttcaaatgaaccttttaaagtcctatacattattggaaaggataccactgtggctgaaattactgtcgctgtccaagtaaatattaaatttatatcaaaatttttaagtaaaattcctacaggaccatttttacctattataattaacaaaaaaaatcctaccaccgtcggcggtagtattaatggcaaagttaataatgtatctataatattttcatacttacctttataccatgccattttataagcaattaaaatacctaatataaatgttataaatgttgcacttaaagacgtttttatcgaaataattaatggtgaaatatccatttgataatctcctatctaaattgttgtcaaatctatgattcgtacccataattttttaatatatccttaacgtcattgctaagtaaatatttattaaactttttaatttgatctaaattattttctgatttaattattccaactggatatactataggtgagtgtaaatcatttgcaatattgtatatatgtaaatttttcttgtttactgtatcacttgaatataaaaatcctgcatctacatttccagacactacccatgctaatacttcttttgcatcttttccatatacaagtttgttttctatgtcattttttatacctttattaattattacttcatttgcatattgacctactggaacactttttaaatctcctattcctatctttttatattcatcactttttaaatcatctatgctttttatatcttttgtactactagctaaaactaatctattttttgtaaaatcattatatttattatctagcaaataattatctttttttaattcatccatgtatcttttagaagctgatataaatatattacatggagcgccttgaactatttgttgctttagagaacctgaagatccaaaatttaaaactaaatctatatctttattttcttgttcatacaacttttcaatttcttgaaatggattttttaaactaactgcaacacttacattaatttttgttttttcatgtttttcgcatcctaaaacaattatccctatcgagagtattacaaaaagacttaaaaattttctatacatagtaaatacctcctattttatacttttaattatatatttactcaaatttatagtcaattgcacaaatattctaacaagatttgcatttttcgactttattatatattataaatagttattttagggtataatagtatatattattagaggtggtgataatttgttagatttaaatttagaagctaatagatgtttgatatgtaaaaatgctagatgtaaaaatgcctgtccaattaatacagacataccaaatgttataaatttatataaagaaggtaaattaaaagaagctggtgaacttttatttaataacaatcctttatctgcagtttgttcaatagtatgtcctcatgaaaatcaatgcttaggaaactgtattagaggtattaaaggtgaacctattcaattttataaaatagaagaagaaatttctagaaaatttttagaagaagctaagtttgataaagttgataaaaatggtaaaaatatagctatagttggttctggtcctgctggccttacagtggcacttgaacttgctaaaaaaggttataacataactgtatttgaaaaaaacgaacaattgggtggtatacttagatatggtatccctgaattcagattacctagagaaataatagataacttagttgatatattaaaatctatgggagttaaatttaaaataaactctgttgtaggtcctgtattaactcttgataaattatttgatgatggatatgatgctatatttataggtactggagtttggaatcctagaagacttgatataaagggtgagagcttaggtcacgttcattatgcaatagattatttacgttctcctcaaaactacgatttaggtgataaagtagttgttataggtgctggtaatgttgctatggatgcttctagaagtgccaaacattatggctctaaagacgtttatgtagcttatagacgtgactttgaagatatgactgctactaaagctgaaatacacgaagctattgaagaaggagtacaatttatgacttataaagctcctgttaaaatagttaacgaaggaattattttagcagatactaaaaaagttgtagatgaaaatggaaagacttctttaattaaagtagaagatagtgaaaaactatttaaatgtgattctatactaattgctgttagtcaacttcctagaaatactatagtttctaataataaaggtctagatgttaataataggggtcttattatgactgatgatagtggacatactactcgtgatggtgtatttgcttgtggagatgttacacatggagctaaaacagttatagaagctgttgttgctgcaaaaactgttgccaactctatagatgagtatttaaattaaacgttaaaagctataaaaatttagatttttctaattttctatagcttttaattttatttacttaatttatctaccacacatcctaaaattattcctatactatagctgattaaatcttcaaataaaaatccatgtccaagaatcaatcctccaattatagtatttcttatattatttatccattcagcttgatataattgacttatttctatagaaaaagaaaataaaaaagctagcactaaactttttgtaatatttaatttaggaaataaaaatctaaatccaaagtaaaccatcatagcccaaagcatatctccaataaaaggagcaatatttcttgggaatataaacataaactttctagatagcaaccccataaacataattataattgtaattataaaatatcttatcctatttttcataatatcctccatacttttaattatacataaaaaaagagctaatctctatttagatatagctcttctttatatataatttaatttttaatttacataattatactaaaaccttaaattgatatccattatctttgaaatattttataatttgaggaagagccttagcagtattttctttaccataagtatcatgcattaatacaactaccatatcttttcctgctgatgttttaacagcataatcatataattcttgaggattctttttctttccttcagcatctccacttaaagcattccagtcaatagatgctataccattttcatctaaatacttatctaaaggttgcatacctttccaagacatatgtccacctggacatcttataacctcagttgagaagtaaggtcctaaaacatcttttaatatatcatcagtctttttaaaatcttctttgaatgattctaggtttaaaactctattaggatataatataccataatcgtgactatatgagtgattagctatagcatgtccttcttcaaattcttgctttataagttctttggctttttctccaccacgctctatattttgtcctgttaggaaaaatgttgctttaacattttcatcttttaaagtttttaatatctgtggagtaactgtagttgacgtaccatcatcaaaagttaaaaatactatcttttcaccgttattagaataatccattttttttaacttgtcttcaacttttttagcactgtaactataactttccgctccatgcttaacaccaatcatttttttcttagcttcttcagcctctttacgttttttctcttcttcagctaatcttttttgttctgcaatcttttgttcttgcttttcttttatagcttcatctacataagctttaactttgttaaacgaaccaaagattactaaacaagctaccattaacaaaaatgctctttttatgtttacctttcttcttctatttttgtttttaggattttcaaaaatatttttcttcataaaaattcccccctaactgtcgtttcctgtcattttttcttatgaattaattatactatatataactatctttttgtattacagattcgtaacaactatttcaaaattgtaaattaagtattttttaaataaaaaaactgcttacgcagtttaatttcgtagtattatattttattttcttctttatattcataaagataatttgaaatactcccaaattcttgataatacattatagtagtgtttataataatatatgataaccccaacattattaaaatcaaggtaatcccaattaccaattttatctttaacctcatatgggacctcccttttttaacccattttttcccatatttagattatataatatttttttattatttaatagtaattcttatctatttttttctacaaattaattcataaaaacaaaaaagttgggatatcccaactttttatctaaagtttactttaccatctttaattgaatcaagtacaactaatgattgtaagtttatatttttagattctaaaagcttagctccttcttggaatcccttctctataactataccaactccaactaagttagctccagcttgttcaactaattcatttaatcctatagctgctcttccatttgctaagaaatcatctaaaactaatatattttcaccttcatttaagtattttttagaaactcttatagtataatttttagcttttgtaaatgaatatacttgagcttcatatacatctttatctaaattttttgattcaacttttttcgcaaatacaactggaacatttccgaaatgttgagaagctattgatgcaatagctattcctgaagcttctatagtaagtatcttatcaatctttttaccttcaaatcttttagcaaattctttaccgatttcatttaaaaatgctacatctagttgatgatttaagaaactatcaacttttaatatatcatcacctgaaactcttccttcagttaatattttttcttttaacttttccataagtactcctccgaattgtagtgcctgcataaatactttaagaaagcttataagaaaactcctgtcataaaagacaggagtttatatttactatttatataataaataaacttcctgtagtcaaatcatttacggtgatttggtagaaactcttgacccttattgtcaaatttatacaggtataataattagttttttagtttatctaattataaatcattagagtatattaatcaatattaaatttctcatatatatcgtagcttgcattctatcttttaaattcaatttagcaaatttactaatatattttttcactatatactccgttatataaatctttttagacatgtctactttctttataaatctatttaataataattacgtatctaattcttctgatacttgtggattttctggctctatcggttgatctggtgttattggtggttgttgtgtttctggttctatcggttgctccggtgatgtcggtggttgttgtgtttctggttctatcggttgctccggtgatgtctgtggttgttgtgtttctggctttatcgatggttttgatattattggttgttgtggcttttgttcttgtattgatggtttctgataactttgtatctctagttttactggtttagttttttgtttaatgtagttttgatttttatatgtatttttttgctcattttttgttttaatttttttagtttgttctttgttatcttcaactttaattaaagtctgaattacttgctctgttttttcaatctctttttgattagcttcagcatcttttacaactacttcttgttctactcttttatattcttctttatcaagcattataggtccttgagataaagtaaacccagatactaccgcagttgttaatattgttgatgctgctactattttactttccttattcatttgtttactccttattatatattctttttatctcaattctcttgattttattaattttcctttagttaaattctttcatattttttctatgatagtcaaaacttctataaatttgtatatatctataaatttataaacttatttctagaaaataaaaacaaaaagagtctatttttaaatagactcttaatatagaaattatatatattttcttttaaacttaatttttatgttaatatttattagatttcctatgctctagttgcttttttcttaatcatatctataaatatatatatctcatctactttaaataccataactaatacagcatatactatagctccaattcctacagatatacctaatgatatgccttcttttataaatcctaatcctaatatagcaatacaaaacttataagtaaaataagttattactcccattataagacttgctattaatgacttaaaaaatgtattttttattttatcttgtccataataacccattcttttctttagactgccaaatagtaataatatacatataatagccgataagctagttgctaatgctaaaccaccatgccccatagcctttactaaagctaaatttagaataatattaagaatgactgctaaaacaccatttatcataggcgttttagtatcttttaaagagtaaaataccttacctaatatgtcccttaatccaaatcctattgtacctactgaataaaatattaaagcagtagcagtaagcgatgtagattttgcatcgaaagctcctctttgaaataatactctaacaacaggagttgataaaactattgcacctactgtcgttggtagtactactaaatttacacagttaacactattagctatagattcagcgaacttttccttattattttcagtagatagttttgacaatgttggatatataacagctcctatagtagatataaataatcctaaaataaacccatttaatttactcgcactatttaatgcagttataactccatcacctaaccctgaggctagacttctatctaccatagtattaacttggttaactgcaactcctataaatacaggaattactagccataacatcttcttcaagtatttatctttaaagtctaatacaggtttaaacttataaccttttttaattgcaaatggcacttggaataaaaactgtgatgccattccaagtaatcctcctatagctagaatatctatattcttcataatagcactcaacgctatagatgctattactactatgttgttaggaaatgctatcatgcctggtatagtgaaatctccttgtatttgtagatatgaagtcattatattgctaagtcctatacaaacgacacctattatcattattcttacgaatctaacagttaattctagttttactcctataaagttcatagcaaataactttactaatggcactgcaaatatatatcctaatatggctaaaattaaacttaagattactactatacacattatgttattagaaaattttaacgctcttttttctccaccatgttctaagacttcatgatatagcggtataaaagttgtagctaaagctgttcctattgctgcgaataccactaaaggtatattcatagctgttatgtatacgtcactgtatgcacttgttccgtaaaagtatccaagtactatctctcttgcaaaccctaaaacctttgatagcatagtgactaccataagccaaaatgctgattttgctaaactactcatatcttcctccaatttctaactttgcctaaataatattatatataaacttttataaatttaatataaatttaacatatttgtaataatattgtttttttattttaacttcttaacattaaagcatttatttatcaaaaactttacttcattcatttatttttcatatttaaacttatatctatataaaaatatttttactaaaaaactcatagattataatctatgagctttttatactactttttataaggttgcccaaatataaattcatgtagagcattcaaattataatccttatcccactctaaaacccaacctttttgtttgcttataatatgaccatttctatgaccttctaatggaaattctagttgttcaatattactatcttttatattataaactgtaaatcctaaatctatcatctccataggacttatattagttttagtatttcttaacaatatgtcagcagcctttttatacatcagaggatcttgttttaaaaattcgttataaacactttgagcaacttctctatgtctattgtctcttgcaaaagcactatcagtatatctaattctactaaatgctaatgcttggtacccatttaatttttgtaccccaggcttagttatatattccttaggagctttattttctctatctccatagtatttatagcaagcatctatataagtattgatttcatttatatctttagcttttatatctactgtcactcctcctatctcatctataacatctataaatgaaataaagtttacagctacatacttatctatatttatatcaaagttgtttttaaaaacttcttttaataagtcaattccaccatatgcatatgcatgagttaatttctcatatccgtgtcctggtatatcaacatatgtatctcttgctattgatgttatctttaactgtttgcttttactatctattgtagctaacataacagaatcagatctatttcctttatctatacgagttccatctatacctactaaaagtatattagttataccatctaccatcttgccactttgttcctcaccttgactagatttatatttattatctgaacctttaacataaatagaatctaacttcgcataaatatatccaaatgaacctaaaattattatagctatagctataaatattcctaaaattacctttgtgggttttctcatactaatacctcttatctaaattgtaattataaactaagcttatataatttaaaccttcagctacataatcagcaaacttctctttattattttcggtaaatagtttaaaaagtgtagagtaatatatataattatttatatatattataactaaaaaaagctgattcccaagtaatttagaagtcagctttaatattatttagactatccattaaaagttcctatacaaatatttatgaaatatagtttttgtgaaatatatgatttatggttaaatactttagttggattttgtggagctaaattatattttagtattcaaatgtcttttttaatatataaatagtattatcgaaattttatttaatatttataaaaacgttgaagtatgtgttgacctaggtgtttttttgtcaacagtaattttaggtttatatgttgacgaattttctcggtaacacttagggtacctaatttggtaacattttaaattagacgttctaatggtttcatcctagtgttactgatgttgacgaatttttatgtaaaatggtaaattagggataattagttatatatttatctaatttagatataagttattgcgaatttttttcggtaacgttaagaatagatatttcattttgaaatatctattttgtagatatgctattattaaatcgaattaaaatgtatctattactactgttttatcttatgatttttttaaatttttctttaccatatttatcaacatatctatttcttctatcttaagtagcttgactaataaataatatacaattgctccaactgttgctggagatactaccaaatttacatagttaacactagttgctactgactctgcaagtttttccttattatttatactatataactttgataatgttggatatatatataatccaattacaaatccatttagtctatttgaattatcaagagcagttataacgccatctccaaaacctgatgctaaattactcatgttttcctcccatttctaattttgcctagctacttttatatacaaatttgtgtaaaatttaaataaacttagcttatttgttatactattatttttaattttaatcttctcatcagttaaaaccgtttccttacatcctaaatatacctattattccaatattataaccttctcaaggctttatcaactttatctatttttcatatttattcctatttcgaataattttttgtatctatattttataaatagtctataattagttatacagtattatttttaggagggctttaatattggtaatagattttaatttaatggttttagtatgttttatagctatttatattttttcaagatcattaatttgttttataaagggtactaatttaaatattaaaaatgaaataactaatttgggtttatatatgtcggtagtatttgttttttctgctaccctatttcctattaagttaaatgtagcctatgaaggatttgagatttataacttaattccacttaaggtacctataggtatttttatgaaaaacagctttggatattttttatatcaaacactaggtaatatagctttatttgttccatttggattttttgtttattcaaagagtggatataatatgaaaaagactattatatgttgttctgctttaacgttatttgtagagttaatccaaggatttataccttatagattttgtgaaatagatgatttatggttaaatactttaggcgggttcataggagctataatttatatatattatctaaagtttaatgataaatataaaaagattaataatataaattgaataaaaataaaagagtgtatttctatttttgatagaatgcactcttttatttttaatattttttatatatactaagctacttccctaacttcatcacttttcttaaaatcaaaactcattacaaccaatactgctaatattcccacaagtactgctgtaagcccaaatccacctacaaattgttgtatcttacctaaaaatataccaactactccaaaatctccatctgagaatgtagagttagctattcctaaatttccaagtacaggaagtaatgctactggtaataatgatattactactccatttaaaaacgaacctattatagctcctcttcttccaccagttgagtttccaaatactgccgctgctgctcctgtaaaaaaatgaggtacaacacccggtataattattacaagtcctgctactcctaacactaacatagataccactccacctataaatgagcttataaatcctataagaactgcatttggtgcataaggaaatactattggacaatctagtgctggctttgaattcggaactagcttagttgctattcctttaaatgcaggtactatttcatttaataccaatctaactccattttgtattaatataaatcctgctgcaaaagttaatgcttgtatcatagcataaactataaagtttttaccatcagataaatttgtttcaacatattcaggccctgcaactaatgcaactattatgtataaagtcaacatagttattgatatagaaactgctgaatctcttaagaaacttaatgacttaggaactttcatttcctctgttgacttagaaccttttcctacagcctttccgattcctgctgctaagaaatatcctatagaagaaaagtgtcctaatgctaccgaatcgttcttagttattcctttcataaaaggctgacatactgcaggagatataaccattataagccctagtgcaagtgatcctgtaaatattaaatgtggtccactcattccacttgaaactaatataacagctatcatacaagccataaataaagtatgatgtcctgttaagaatatatatttaaatttagtaaatctcgctataagtatgttcatcagcataccaaaagtcattataagagctgtataagtaccatactcatccatagccatagcaactacagcttcattatttggtataactccacttaccttaaatccatattcaaacattttaccaaatggctcaagcgaacctactataactccagcggctgctgatataacaacaaatccaaccattgccttgatagttccttttattacgtcttctattggttttttctgaagaactaaaccaattataaccattacccctatcaacacagctggttcagatatgaaatctacaataacttttaaaaacccattcataatgtcccctcctaacgtctttttatattatcaatttctataatcctaaagctgcttgtaactttccttttaactcatctttatcaaataaagcatctagtactattaaatttggtaaatgagatgcacttgattctaagtcactagctgttataaatatatctgcttgttctggtgtagcatctgctaaagagttatgagatacttcatatccacttaaccctaattctcctaatatttcattaacattcatttcaaccataaaacttgatcctaatcctgatccacaaactgccattattcttttcattttaaattacctccataatttcttcttctttatttgtatttaatattttatttaatttactttcatccatacatatgcctgctaccttttgcataagctctaaatgtgatttattatctattgaacttaatgttaaaaataaactagtttcttttcccaaaaaatctactggttcatttaattttaaaatgcatagatctgtttttttagcaccatcctctggtcttgcatgtggcattgcaatttttggtgctatacagaaatatggtccatattcatctattttacttattattgaatcaaaataagatttttctatagatcctctattttctaaaatatcacatgatatttttatagcttctttataatcatctacctggttaataactttaactatcatactattccctttcttctgtttaccttgaatatttgtctattagttttaaaactatatttttatcatctgtatttataattgtttctatattatctttatctctaagcatctgagttaaacaagcaagtgcttttatatgtgattgcttatctttaggtgctaaagttactatcattttcacattatgattttcatcattagaaaacttaattttatttttaaatgtagtaatactcattcccaacttatttacaccgttttcaggattagcatgaggcatagcaacattttgtgctattactatatatggtcctaattggactacattatctatacaagcattcacatatgaattttcgatatatccaagttttataagattttctgatgctactaatatagcctctttccaatcgctagcttctttatttaaacttatagtgtcttcgtataaaagttctttaagtgtagctttttgaatttttgacttctctctactgttaatcattatagtttttatttcttctctcaatttttctttatctgaaatatttgcatatctttcaatactactcataatcttatctattgtttcttgttctttgttaaatgttgattgagcatttgaaatttgagatactaaatttttcttatctaaatctgtaagtactggacttacttttataaatttagatgcatcttcatcaatatctacagtacttatagcaaaatcataatatttatcatattgtttaaatttttctaaagataagatatcttctatttcaataagatcaaataactcttgtatctgattttttaataattgtgaagtagccataccaaaattacaaactataacaattttaggaatttttatttctacacccatcttgcttgtatatccaccaaaatacatagatacatatgcaatttcatcttcatttaaaaacatatccattaagttatctacatgttttatagcttgcttagtaaattgatatacagatttatactttttcttaatttcattttttactatgttgggataatatacaccatatttaattctaaataaagaaggcattaaatgattaagtatgtctttttccaaagtttcataatcatcaattgatatacatgatattttttcaaactcttttaccatcatcttaactgaagaaatatattcatcttttaatttgcgttcattgaaaaattttctaatatcattatcactcactaaaaatgtttgtatatagtaaacttccatatcacttatatccttagatatgatacttcttataatatttaacaatactttagcatcatcattagaagttagattttgtaaaaattgaatatcttctttatgaaaacagttcatgcttttcttgtaataatatttataaaaaatagttaaatacattaagatgtaatttagattattatgttttaaaatgtctaagtctaatttttcaatttctgtttttatatatttgtattcttcaattagttcatattcataaaaaaggtatccatactcattgtataagtttataaacaagtatcttttttctttttcttttccttctaatgtatatcccccttgagtgttaagagttaagttatatttatttatgtattttttaacttctttaatatcacctaaaatagtatttctacttacatatagactgtcacaatatttttctatagtcgatttttctaaacctattagtaaatctataattatttttatacttctttcttttggtgatagtatataatcatctgttgagtattttaataatttttttatatcatctttgtcacatgggtttatgtgatatcctaggtttctaatgttcgttatttctagtccacttttttgtaagtattcatttattttagatatatcataataagcagttcttttagacacatttaatgatttcattattttttcaagctttgtataatcattatttaatagtatgtctaatattttttgtaaccttatgttgagttgcatatttgatatccctttcttggttttattatactttattataatcattgcacaaaagtcaaaattaaagcactatataagtgcaataaattgtactctggtgttaaaacatatataaatataaaaaaactgaaggctagttttactttgccttcagctttttttatatttattaatctatttctatatcaaccgcaacctcatctataacaaactcagtacttttagcttcatcaatcttttgggttaaaaagttcataaattcatctctaagttctggtcttttaagtgcaaagtctactgtagcttctaagaatcctaatttatcacctacatcatatcttattccttcaaagttatatgcatatatagcttcatactttgctaaagttttaagcgcatctgtaagttgtatctctccaccttttcctggcgcttgcttttcaagtatttcaaatatatcaggagttataatatatcttcctagtatagctatatttgacggagcttcttcaacttgtggcttttcaaccatatcattaactttgtatactctatcttctatgtatttaacatctagtataccgtacttatctgtatcttctttagctacttcttggactcctaatatagatgtattatattcattatatactcttataagttgttttagacaaggctcctggctatctactatatcatcccctaataatacagcaaatggctcatttcccacaaagctctttgcacagtatatagcatctccaagtccttttggctctttctggcgtataaagtatatatctaccatgttagagatatcttgtaccatttttaacatttctatttttcccttttgttcaagttctaactctagttcaatagaacgatcaaagtgatcttctatactttttttacttcttcctgttactatcaatatctcttctatccctgattgtacagattcttctattatgtattgtagagttggtttatcaactatcggaagcatttcctttggttgagattttgttgctggcaagaatctagtacctagcccagctgctggtattatagcttttcttactatttttttcatgactcctccatatatattaaccttatgctctatttggtttctttttaaccatagctattgctatattaacttcttcaactttgaataagattattagtattccataaactaaagcccctattccaactgctccacctaatgctatagcttcttttataaagcctaatcctaaaatattagctaagaatttgtatgataataatgtaattccacccattactatagccgctattaaagattttcctaatgttttaattattttatcttgtccaaagtatccaattttcttctttaaactttcgaataataatactatacatataagagctgataaacttgtagctatagctaatcctgcgtatcctaaaaaatttataaatataagatttaatattatattcattatcattgctaatgctccatttaccataggggtcttcgtatcctttaatgagtaaaataccttgcttaatatatctctaagtccaaaacctatcattcctatagaataacatgctaaagctatagctgtcatatgagttgcttctgaattaaatgcacctctttcaaatactattctaaccacaggttctgcaagtactatagctcctactgatataggtattattaaaagaattacagagtttacactttgagcaactgattcagcaaatttttctttgttattttcacttgaaagtttagataacataggatatataactaccgcaattgtagttataaatatacctattacaaaaccatttaatctactagcactatttagtacagttataaccccatctcctaatgttgatgctaagcttttatctacaattgcatttatttggtttactccaactcctataaaaacaggaattattaaccacatcattttttttatatactcatctttaatatttatatatagtttatatttatattcatgttttacagcgaatggaaactgaaataaaaattgacttactaacccaattaacgtaacaatagccattatctcaatattacctttactacttaaaaatatgcctaatatgataaaaatattaaatgggagtcctatcattcctggtatagtaaagttaccttttatttgtaaccacgatgtcattatattacttaatcctataaatataactccaaatatcatgattcttgtaaatacaactgctaattctaatttttctcccgtaaaattcattgcaaatattttaactaatggttctacaaatataaatccaagtatacataataatccacttatcacaataactatgttaaatacattattagcaaagttcaaagatttttttcttccttcatttttttctacttcgtaaaataaaggtataaatgtcgttgcaagtgctgttcctaaagatgcaaatagtatattaggtatacttgatgatgttatatatacatcagcaatactactggctccatatacatatgtcaaagctatttctctcacaaaacctagtacctttgatagtatagttattatcataagtccaatggttgctttagctactttactcattaaatcctcctataataatgagagtaatatattaatgaatatattactctcattattctattattaatctctattaaataaatctctagtgtaaactttttcttgtacatcaaataattctttagctaatctatttgaaactataacatcacacatatttttaaattcatctaaatctctaattacttccgagttaaagaatttaccttcttttagagctggttcatataccactacttctattcctttagcttttatccttttcattataccttgaacagatgatgctctaaagttgtctgaatttgttttcattgttaatctatatattccaacagtttttggatttctttttataatttgatcagctatatgatcttttctagttctattagcgtcaactattgcgccaattatgttatttggaacatcttcataatttgctcttaattgttttgtatctttaggcaggcagtatcctccatatccaaatgatggattattatagtgatttcctattcttggatcaagccctactccatctattatttgcttagtatctaaccctctaagttctgcatatgtatctaattcattaaagtaagctactcttaatgctaaatatgtatttgaaaataatttaatagcttcagcttctgttgagtttgtaaaaagaactggtatatctttttttatagctccctctaataaaagattggcgaatttttcagctcttttagattgttctcctactataattcttgaaggatgtaaattgtcatatagtgccttaccctctcttaaaaattcaggtgaaaatattatattttctgtattaaacatttctttcaccttttttgtatatcctacaggaacagttgattttataaccataacagcatctggatttatagataatacatttgctataacagcttctactgttcttgtattgaaataatttttttctggatcatagtctgtaggagtagatattataacataatctgcatctttatatgctttatatgcatctgttgtagcaattaaattcaattctttagtttttaaatattcttctatttctagatctactattggagattttttattatttattatatctactttttcttgtattatatctaccgcaactacttcatttttttgtgctaataatatggcatttgatagccctacatatccggttcctactattgctatcttcatatttaatctctcccttccaagttataatttattaattagtactaattaataaattataactataaaacaattttaagtaacattctctctaataggctttatattgtaatttatattaatttaagacttttcattaatataattacaaggtttaactctataacatcttaaaaagtcaattttaatttaattattataaatctttaatcaaatctattcttagttatttttttataaattttgactcattttttaataaatactcttttttgcttatatagtttaatccattcgtatttaatgaattattttttattttattcttgtatgtatctatatcgcatataatttttgctggatttcctcctattactacattgccgtctgaaaaactttttgtaactacactaccagctgctacaatagtattttcaccaattgtaatacctggtaaaattatagatccatatcctataaaacaatcattttctatttttatttttccaaaaacatctgttgcatctgatatgacttttatagctgaattatcatgagttataaatttaactcctcctgaaacagttatattatctccaaattctaataagtatggctctgcagaaatcaaaggtgaaaaagctctcatatttttgccaaatttaactcctcttgaattataatatttaagatttaatttcataagttgttcttttttcccgctaagagtataggccatctgttttaatttatataaataataattcatcgtttaacacctctgttaatttttaatttcaaataagtttttatattttattttccagtcaaagttttcataggcataatctctcattgttttacttatattttctttgcaaattagactttcataaaatttaataatcttatatatatctatagggctatcattactcgtaaatgtaagaataaaatcctcatttcctttaaatccaggatcttttattgatgaaataaatggaattcctcttgcacaatattctcttgattttaatggtgctttacattttatgcctactctatgatcacctagtgctcctatagcaatatccgcgcattcaaaatatgcatctaattcttcatccgttttaactccttcaaaataaacataattgttaagattgtactcatcaaccatgtttttcaaattaacttcttcttctcctttacctatgaatctaagttttataattttatcagaattatttttattgtaatattcactcaatcccattattaatctgtcataaccattagaatatctaaaaaaagatactgctaataattctatactttcttttcctgtaaagtatttatgttctttatattttatattatctacatccacacaattgtctataaatattgattctatgttaaatactttatctactttactcgatgatataattaccttatccacatatttacacataaattgtctaaaaatcttatctataatcatttttttcttgcttatatctttataatatgctacttatacaaatatatattaataatatgatcaataatataaagctatatatagttatcttgcctcttttatttattctatatctactttttctcatatgcccccaccttttgtataattttaattttactccttagtttattatttaagtgttatatattaaattcttaatatataagatactactaattttgaattttccctctcaatttattttatataatgcaaaaaatgcaaaaaagaaatcgtaatagcattacctaattcgacttctttttaatataccttatattttttcaatatctgctccaagatttcttaatataaactcaaaatcttcatatcctctttctatataatttatactagaaacttcagttgtcccttctgctactaaacctgcaagcactaaagctgctcctcctctcaaatccattgcttttactttctctccagtaagaacatcaacgccttttaccatacaaatattctcagttatattaattatattagctcccatctttatgagttcatcacagtgcataaatctattttcaaaaatagtttcatgaaatacactagtcccttttcctaagcaaagcaatgtcattaactgggattgcatatctgttgggaatccaggatgtggagatgtttttacaatatctattggtattatctttttaggtggactcattattaatcctttatttttatactctataatacaacctgcttcttctaattttttaactataggatccatatgagcttttataactttgtctacctctaaattaccacctgttatagcactagctatcatataagttcctatagcaattctatcaggaattattgtatgatttactgagtgtagtttatctactccttcaatttgaatacagctagtaccagcaccattaacttttgctcccatagaatttagaaattcttgtaagtcttcaatctcaggctctttagcagcattatttattatagttgtgccttttgctttaacagctgcaagtattgcattttctgttgccccaacactaggaaattgtaagtttatagtacttccaattaaattatctctgtgacagtatatatatccattttcttctgtaatttttactcctagcgtttttaatgcatctaaatgtaaatctattggtctagcacctatagaacaccctcctgggtaacttatacttatatcattaaatcttccaatcatagctcccataacaattatagatgatcttaacatcttcatatattcttctttaacactagtaatatctatattagaactatctaaatataaagttgaatcttcatactttgctttacatcctatactttttaaaatatctatcattacatgaacatctgatatatttggaatattatttattatgctcttagattcatttaatatggctgcagccattataggcaatacagaatttttagctcctcttatagacagtctaccttctactttattgcccccattaattatatactttgacaaaattattcccccctagcagcaagtatttaaggcaaaatataacttcttatatttttaatactatgtcccaggggggaaatatgttactttttattttttattcctatagttttaacttctttaggttcatcttcttttttattatcattctttgtttgtaatttttcttcttttttattattcttattatttctgttgtaaacttccataacttctttatatattaaatctatagcctctggttttcctatttctctacttgcattagacatatcaattaataaatctctatctcctaataatttaaatactgtttcatttaatgattcaggagtaagatttttttctaatatagcaataccagcacctttactttctacactctttgcattatattcttggtgattttctgctgtatatgcttttggtattattatagaaggctttcctaaagctgttatttctgctaaagatatagctcctgcacttcctataactaaatcacacgctgctaatgcacttgccatatcttcaaggtaaggtacaactttttgatatggttttaaatctagatcgcttatatccttcataaatccttcatagaaatttttacctgttgcatatataaacgcagcatcttcattaacaaggtttcttattactagcttcattgaatcatttatttttcttgatcctccacttccaccataacataaaaccatttttttatcttcttgtattcctaactttcttcttgaattaccttttttggataccaatatttcttttctaactggattacctgtaagcactaacttatttctagtttcttcaggaaatctaccatgagaatcttcaaaacttgttaatactttagttaccatctttgccaaaattttattagttactccagggaaagagttttgctcatgaattattgtaggaacttttttcattgatgagttaaataatacaggaccactaacatatccacctgttcctataactatatccggtttaaatgttttaacaatttttcttgattgttctaatcctttaaataacttaaaaactctttttacattatcaaaatctatttttcttttaaatccttgtactgtaactgtctttaattcatacccatacttaggaactatttcagattctattcctttttcagttccaacaaaaactatctcagcatctggattttcttcttttattctatttgctatggctattgcaggataaacgtgacctcctgttcctccgccagataataaaactttcattatttcatctcctgtctaattcatttttacatgcttagagacattaagtactatccctactgctgccatgaatattataagagaggtgcctccataacttataaaaggtaatgcaactcccgtaacaggcattgatgatgtagcaacagcaatatttagtgctgcttgaataccaatttgccctcctatacccacagctagcatacatgaaaatacatcaggacatttaattgcaattcttatacatctataaactaaaaatacaaataacattataactatagcacatcctataagccctagttcttcacctattattgcaaatataaagtcattttgtggttctggtatgtaaaaatatttctgcctactctttccaagtccaagtccaaacaacccacctgatcctaatgcatataatccttgtataacttgatatccagctcctaatgggtctttgaatgggtctagaaaagacgtaacacgagcaagtctatatggtgctgctaaaaccattacaataaatagtgcaactcccgctccaaacatactatatacaatcttcatatccattccagctacaaatatcattacaaatgcaactaaaactactgtcccagcagtagatagatttggttgaagtattattaatgtaaagaaaatcccaggtattataagaagtggtataactccttttgttaatgacttaattttatcatattttaattctattaatttagctgttattattatagtagcaaacttagctaactccgctggttgaatagttaatcctccaaatcctaaccatctttgagctccgtttaaagatgttcctaatggagaaagcactaaaattaataatataataacaattatccctaactttttagcgtttttataccaaaatctatattctattttagatgtaaaaatcattgcaataaatcctagtgttgcataaattaaatttctttttaaaaaataataggaatcatctagtttaaatgtagattgtataaaactagcactaaacaccattatgattcctataaatactaataacatagttgtataaaacacaacattatcaaaatctgtctttatccccctactaacacgtttttttatctctttaggcattaattagacctacctccattcccttatatatctataatttatatatattttctttgaagtctaatcctcttgcctcgaagtttggatacatatcccaacttgcacaagctggtgataataaaactacatctcctgattcagctagtgcataagctttgttaacagcttctttcatatcactaaccttcactatattagtaataccttgttcttttgcacttaattctattttatctgcagtctctcctagtaatactaatgacttaacatttttagttgcgcatttcatcatttctgtaaaatcactttgtttatccatacctccagctattaaaactataggtctttcatatgaagttatagcttttatagtagaatctggattagttcctttagaatcatttacaaacattattccatttttatttgttacaaattctagtctgtgctctacgcctttaaaagtctttaatgtatcttttataacatttaaatctatatttgatacatatgacattaaaatagccgccatagcattttctaagttatgatttccaggtaaacttaattcatttttatttaaaagaactaatttttcaccatcaacctctataactatattatttttatcgtctaaatatgcaccttgttctactttttccttttgagagaaatataaaactttagcatttgtctttttagctaattctctaactatagaatcatcataatttaaaacacaaaaatcattattatcttgattttctaatattcttgcttttgcatttatataattttccatagtatgatgtctatttaaatgatcctctgttatgtttataatagtacttactttaggtttaaagtcttctatactttctaattgaaaactacttaactctgttacaagaaaagaattttcatctgcaaaatcaacagtatctataactgggtttcctatgtttccaactatgtatgtatctttatttgcctttttaaatatctctccaactaaactagttgttgtagtctttccattagttcctgttatccctataaatgtaggatttttagataatttatatgctaactctacttctccaattatcttgatattagcactttttagtttctctataaaaggtaaatcaagaggaactcctggagatactatagttaaatctatattatttatatcttcaggatgttttcctaaaatataatctacactctctaaattttctaattctttgattatatcttttaatttatcctctgacttaatatcatttactataatatttgcacctaatttatctaatttctttatagtagatactcctgtctttgctagtcctacaagtaagacatttttattttttaagtccatcgttgttacccccgtaaattagaatactgctattatacctatccaagctaatactatagatgttatccaaaatacaaatataactttagtttcaggccatccacattgttcaaagtgatgatgtattggtgccattttaaatattcttttctttcttaatttgtaagaccctacttgaagtataactgaaattgcctctgcaaaataaatccctccaacgataggtattataagaacattatttgtcagtactgcaaatgatataacagcacctcctaatgccatagaacctgtatctcccataaatactcttgctggataagagttaaatcctaaaaatcctatacaagctcctatagttgctgctgctaatatagctatatctgtatatccaaagctaactgcaactaacataaaaaacatagatactataacagttattcctgatgctaaaccatcaagtccatcagttaagttaactgcatttactgtaccaagtattataaataccataattggaacatataatggtcctaagttaaatgtaatatttgtaaaaggtattataaattgagtcgcacttggtgaattagtatattgataatatgctaataatgtagctaatgcaacttgtaataataatttttgatatgcttttaatcctaatgatcttttaaattttatttttaagaaatcgtctacaaatcctacaaatccaaatcctaatatacataaaagacccatagtcatgtctgaacttatttttgttctagtaagaactgtaactaatatagctactatcatcattattccacccatagtaggtgttccatttttttgtaaatgtgtttgcggaccgtcatctcttacagtttgaccgaatttaaatttagttaacattggtataaatatcggacctagtataagtactataagaaatgaaatcattgccgtatacgtaagttctgttattcctaacataatataactcctctcccttgttggctgtttcttagatgttatctaattgtttaaatattgtactatattttctagttgcatacctctagaagcttttactaaaactacatcaccatcgtttattatatcacttaattgctcaattgctgtttctttattacaaaaatggtatacattacctttatccacccctagctttatagattcatcacttatatatttagaatcttttcctatggtgattaagatgtctgcattattaattgtatattctcctacaagtctatgcccatattctgagtgttctcccatctcaaacatatctccaagtatagcaactcttctatttttatatcttcctaaaatatctaaagctgctttcattgaatcaggacttgcattatatgcatcatttattatggttatgttatctttttttattatatctaatctcattttacttgctttaaagtttcttaatccagtttttatatcttctagattcatgcctaaactaagtcctacaagtatagatgccatagcattataaatattgtgtttaccaactgtaggtataaatatttcttcttctttaccatctattacgcaattaaagttcaagctatcttcacttatgctgtaatcagtacaatatatatcattatttttatcaaatccaaatgtttttaaatcatactcaagatcatctttgcatattttttttaagtatttatcatctccatttacaattaatgtatttgatttatcaaaatttgaagtgatttctaatttagcttttaaaattccatcttgagatcctaaattttcaatatgagataatcctatgtttgatatgacaccaatttttggatttactatgtttgctagatactctatttcattaaaattagacatacccatctctattattgcacattcgtgtttagaatttaaattaaataatgtaagtggaactcctatgtgattattgaaattcccttcatttttaagagtattaaattcagtcgaaattgctgcatatatcatgtctttagttgtagtcttacctacacttcctgtgacacctatatatgggattttaaattttcctttataatacttagctatatctccaagtgcttttgtagtatcttctacttctattaaatttatatccgaacttataatttttatgccattacttttattttttataaaagttttacatccattttcaagtgcagattgcataaaattatgcccatctaaattttcacctattatagctataaaagcatctacttcagtagctttcctactatctataactatattttttattgtgtctaattcatttccttgcaccaatgtcccattagatgcctctactagttcttttatggataaagattccatactcaaacctccttctaaataagtctactaaaacattataaatctttttaatcagttattcatctatatttataatatttaagtatatagttttatagaatatcaaatattttacatttttgtaaaccttttaaaatcctaataaagagcaatatatataaaattatatacattgctcttttaaactattaactcattaattatatactatatattagtttttttgaagatttttattggcaataaagccttttaattctcagtatacaatactattccagaatctataggaacatctgctccaggttttggaaatatatctacaaccttggcacttccttttaattcagtatctacatcttgtataggctttaatttattttcttctaatacttttaatgcatcttctatacttaaatctattatattaggaactttgactttttctttttcaaattccttcttttcttcttcagtatatttaggttcaacccctaagtattttaacgaatcattcattatttcttttactataggacctgctgtactactaccaaatgccataactcctgtaggttcatctactatagctaaaactataatttgaggatcatctgttggagctatacctacaaatgaacatatatatttaccttgtgcatattttccatctattactttttgagctgttcctgttttaccacctattctatatccaggtatatatgccttattccctgatccctcactaacaacagattctgcgatttccatcatttttttggaagtttcctctgaaatcacctgtctaacaaccttaggctttatagtttcagttatattaccttgattatcaactaattctttaacaattcttggttgcataagtttaccgtcatttgcaatagctcctatagctgttattaattgcataggtgtaacagatatggattgaccaaacgatatagttgctaattctacaggaccaacatttttctcattatataatatacctttagcttctcctggtaaatctaatttagtagtttccataaatccaaaagattctatataatcataaagttttgaaactcctaaacgcttacctaattcaacaaatactgggttgcaagagttttggacaccttgtttaaattcttgctctccatgtggtctataatgtctccaacattttattttttgtcctcctattgtaacacttcctgtacatacaaatttttcaccttcttttattaccccttcttccaaagctgtagctgatgttataagtttaaatgtagatccaggctcatatgtatcacttactgctgggtttctccacattgagaaatatccttttattttatctttatctttatatttttcaagctcttcttcgtagtatgggtatataggagttctagattgattagggtcatagtctggcttagatgccatagataatacatctcctgtttttgggtctatagctatagctgtaactctttttgcattatttagttcatatgccttttgaactgctttttctgtatagtgttgtattacttcatctatagttaataccaatccatttccttgaactggttcataatacttttccattccatgaggtatttctcttccagatgcatcagtgctaacaataagtcttcctggctgtccttttaaatgcttatcatattccatttctataccagctattccagttgaatcatctgaagtatgtcctaacacataaggagcaaaatttccataaggataatacctttgattatcttcagcaacccatataccaggtagtttagcatctcttattttagctgctgtttcatcatctatccatcttttaattttaactaatgccatatcttttctttttaataattttaatgtatcttcatattcttcttttattaactcagaaattactttagcagatttttctttttcttttacttctactggttttgcccaaactgtatactttgtaacacttacagctaattctttcatatttctatcatatatagttcctctttttggttctataggtatatctcttgtttgttgatctagggccttttctgttaaccaatctccttttactatttgtagataccccgttctaaatactaaaacaaaaaatactatacatgctaaaattaaaacaactactaatctttttttacttagcttttttatattactcaattaactcccccctacttagacacttctatatacttaatttgattttcttttggataatccattcccaattcttcattggcttttttttctatatctttgcttctagtaagtaaatctacttcaacttgtatgttatctctttctatagtttttttatgtaatttagattctaattcccctatttcatatttgagcttagatacttcactgtaaccatacatacaccccaaaattgtaataaaaacaaatgatatacaacttattttgaaagtacactttagtaacttttttaatactatcctcttataattattctttttgttttttctatattcatttttatctttttttttcttttttcttttcataatatatctccttaaaaattttataaaaatagttatataatatttatatttaacttttaaatactgcttccttttaaggattaatacaaaattaattcaataaaaaacaaaaaagtctaagctctggcttagacttttatattctttcagcaaccctcaattttgcacttcttgatcttgggttttcttctatttctttatctgtaggtaatataggttttctagttataacttttactaaagcttctttatcacattgacatataggtaaatgtgatggacatatgcaatctgtagctaaatctctaaattcattttttacaattctatcttctaatgaatggaatgttattatgcatattctaccaccctcattcattattgatgctgcatcatctatcatatcagttataacacctaattcattatttacttcaattcttatagcttggaaagttcttttagctggatgaggtccatctattcttgctttttttggtatagctttttttattatatcaactaactcacctgtagtttctataggcttttcttttctttcatctactataaatttagctatgcgctttgcccagttatcttccccataatcttttattattttagataattcttcttcactatatgtatttactacatcataagctgaaaaattacatcttatatccattctcatatctaatggagcatcttgcatataagaaaatcctctatctgcttcatctaattgatgtgatgaaactcctaaatcagccaatactccatctattttgtatatacctaacttttctaattcttcttttaaattttgaaaattactatgaacaaattttactctatcactatattcacttaatctttctttagctgtatttattgcatttatatcttggtcaaatccaataaataatccatctttagataatctttttactatctccttagagtgtccagctccacccatcgtacaatctacatatacaccatctggttttatgtttaaattatcaatacactcgtttaagagtactgatacgtgatgaaattccatattttatcgctccttagtgtcacttatttctttttatttttatttgataaatacatatgaactactataccacctattattcctactaaacttataacttgagccattctaagtggtcctatcataaggctatcagttctaagcccctctataaaaaatcgacctagagagtatagtatagcatataaaactataacctgaccttcataagatttcttttttctaaatatccataaaaatacaaatataccaaaatcccatatagattcatataaaaaagttggatggacttttactccatttaccattattccccaaggtaaattagtaggccctccatgagcttcttgatttataaagtttccccatcttcctatcgattgagctaaaggcatacctagcattacagtatctgctaacttgaaaaaatctaactttttatatcttgagaatatatatccagctagtactccacctattaaggctccatgtatagccatccctccacctctgaagtttaatatctgtgatgggttattagaataatatccccaattaaataaaacataatacaatctcgcacatatcaatccagctggtatagcaattatagctaaatctaatatataatcttcttttatacctactcttttagcttcttttatagctattagagttcctaaaatcatacctgtggccataagtattccataccacattacatctattccaaatatagtaaatgcaactctatccatatttaattcctaccttttaaataatcttttaaataaactctttttctctacatactttttaggatttataaaatctaaatccttattgcttaaaatatattcttgattttctaaaaacagcttttgagaaatatcttctccatacaacttgcttatataatcataagtttcttttattaaaggtcttctctttgtactactatgtgcatctgtagctataaaatgaaccatatcattatctaaaagtattttagtagtttttttagcttcaactccatttttacctactacactagatgcattaatttgtattaaagcaccttcatttatacagtcataaattatattaggatcatcttgtattttaggatatctttctacatgagctaatataggtatatactttctcaatcttatctcatatactatatcaactaaattatttggaaaattatttggtgaaaactcaataagtatatatttactattgtttaaactataaaaatctaattgatcaaaattttcaatcaaatcatatgtataatacaattcattccctaatacaacttccacatctataccttgagtttttaatgtatcattaaaatttttaagaatttcaattaattctttaccctttttaaatttgaaatcaggatgatagtgagatgtgttaactatcttttttataccttcactttctgctattttagccatttctattgattcatctaagcttttagagccatcatcaacattcggcaatatatggcaatgtatatctatcatttagctattacctcctttattataaactaaataataccatattacccattaaccatcaatttactttgttttttatataaaaaaagtgctaaatttttagcactttttatctatttaggctccactatagatattacacaactttcttctcttaaatgattttttaatctttcttcaacttctttaaactcaatttcttttataacttctaaataatcaagtaaatttatatctttaaacttatatgctatgaagttatttgctataaagtttactgaatcaaagcactttaaaaattgtcctatttttttctttttaaccctattaaaatctaattttgataatccttctttttgatatttatttatatattttattattatatcctttacctctctaggattattagattcccctcctataattgtatatccataatcaatttgagatgtaaacccacatccaaagttatcattgattagacctttcatatataattcttcaaaggcttcactacctctttttaaaatcatatctaataatatttctgtaacaacttcttttctcaatagttctttaccttttatccctacattactatctttaaatcctatattaaacatagacatagatatcggaaactttgcaactatttctttttgattaacagtacttggttcttcaggataaaatctctttatatctgttttaagtttttctatatcataattattactttttcttgcaatttccataactttatctgcttcaacatctcctacaacaaataaagtcatatttcccgggttataaaaagtattataacatgtatataactcatcttttgtaattttatatatactttccacagttcctgctatatcaactttaactggataatttacatacatagctttcaagcagttaaaatatacattccaatctggatcatcattatacatttttatttcttgttcaattatccctttttctttttcaacattttcttcagtaaagtatggagtctgtacataatctattaaatgctctaaactttcataaaaattatcagtgcatgaaaataaataagcagtcatagtgaaatttgtgtatgcatttgcactagctcctaatttagaaaatttatcaaatgcatttcctccacctggttgttcaaacattttatgctctagaaaatgtgctattccttcatttactctaagtttctccttttcatttatagggataaattccaaatcattagatccataattagtagctaagactgcaaacttttttgtaaatccttttttaggcatgaaatatacatcaagcccattttgcaatttttcataataaacttcttcttttaatatatcattaactatcttttccatatagtcctcctagtttcttaagaagtaaatagtatctagttgtagatttttaaaactattaactatttcttctttagttactttgtctatataatttataatatcttctatatctaaatttgttttacttatatcttgagcaaatttaaaatcagataacccacctatactatctgttaaagccctcatagaacttataagtgatattttgctgttttcaagttcttcatcagttatatttccttctactatactttctatttgttttcttattaaatccgttgttttgtcatagttttgagtttctatacctgatgatatataaagtatacccttatatttttctacagatgaatatatataatagcataagctttctttttctcttatgttcataaacatcttagagtgaggccccccacctaatatgttacatcctactattaatgaatagtaatttttataatctgcaaaatctatatttgttctataacccataactagtttaccttgagttatatccatcttatcaactatagtctttactgagtcaacttgttttttatactcttctctaggtatagttaatatagtatctctttcaaatttgaatttatctttaataatgtctataacctttttttcatcaaattctccttctacaactatatctataggtgatgtttttaaaatatttttataatggtcatataactcttttccagttatagattctatgtcctctatatatccttgttcacttatactaaatctttcatctttgcacatttcttcaaaacatctttcaagtgcaaatcttcctttatcatttatttttgctttaattctttcagctaaattttgtttttctaacttaagatatttctcactaaatccaccatcttctattaatggattatttattatttcatttaaaaattctatagcatctgtaaatataggttcatctaaatattgttcattagttgttactaattttatattaagaacttgtcgctctcctcttttgcttgtatccgcaagaatagatgctccatataaatcctctaacttattagatatatctcttaaagttttatatttattacttgaatttgttatcatatttggtatcaatgcattttttgtaacttcatttttgtctaatattctttgtatgtacacactaactaaatttgttttaaattttttagactgtattaaagttaaatttatattatcatgcaaatttattttctttatgctatccatattatcctcctatttttttattaatgatatttgagtatatatttcttcaattaatattttgactttatcttttgggtctatataatgaaatttaacttcagaagtatctaattcttggagtatactttcaactaagtttttattatacatattgtcaattgtgcaggtaggaattactacatgtaatacatctattccaaattctagaagttgctccccagattttattatatcgtttttattattttctaaaagaggtaattttatttgaatttctgtatttttttctttctctatgtaatattttattttttctctaaaaataatatcttgttctaaattattttcatcttctaaccctattaataacacacctgcatctaagtctttattttctatatttcctaaaatttcatttttatacgattttgctaaattatttgatttataaaatacatctgttaactctacatttattccatatttactaagttccatcttttgcaacctacttttaaatacttcaaagtctttaccctctgttataaacatcggacacaatactatatctttatagcctaatgatataacttcttttaaagaattttcaaaatatggtttagtatacatatatgagttaactactttatatttattacctaacttttctcttaaacctactgatatttcatttgctgtatctttgaaatcacttgatcccaagttttcataataacctttatatttatataaattatataaaacatttatatatgatttatacttttgctcaaaataaatctcattagtcctttcgcttagattgtaatttctttcttctccatcatataaaagcataactaaagtttcttcttgagtatctcctatatctgtaatattagggtctatatcatcttttacaaataatactaaagatatattaacaataaaaaaagatatcaaaatcccaaataaaaatttcttataattatttttgtaatatacaaaataagtataaattacaattgtcgcagctataataaatatattttccatatacccatcaaatataatactcaatcctaataatataccaaagcacattggtattcccattaaatcatctccatcaaaagtatagtttgcatcaccaatatatatgatgtataattagaatgtatgtctaaattaaaataaatacgagacttaagaagagaggaagatataatatgaaattaggtatagttggtttaccaaatgtaggtaaaagtacactatttaatgcgataactcaagcaggtgcggagtctgctaactaccctttctgtacaatagaacctaacgtaggtgttgtagctgttccagatgaaagattagagcaattaagacaattatatgactctaaaaagattgtacctactgctatagaattttgtgatatagcaggtttagttagaggtgcttctaaaggtgagggtcttggaaataaattcttatctcatataagagaggttgatgcaatagtacatgttgttagatgctttgaagatcctaacgttgtacatgttgatggttctgtagatcctttaagagatatagaaactataaacttagaattaattttctctgatatagaaatattagaaagaagaatacaaaaaactcaaaaagctgctaaagctgataaaagtttagcttctgagcttgaattcttaaaagaaataatggctactttagaagatagcaaatgtgttagaactatggaatttactgaagaacaacaaacatttgttaattcattaaatttacttacttctaagccagtaatttatgctactaatgttagtgaagatgatttagctgatgaagctgaaaataatgaatatgttaataaagttagagaattcgctgcaactgaaaatgctgaagttgttgttgtatgtgctcaaatagaagctgaaatagctgaacttgacactgatgaagaaaagaaagaattcttagagacattaggacttgagcaatcaggacttgataaacttataaaatcttcatatgcattacttggattaatatcttacttaacagctggtcctcaagaagttagagcttggactataaaagttggaactaaagctcctcaagctggtggtaagatacactctgatatagaaagaggtttcataagagcggaaactatagcatttgatgatttagttaacgttggaactatgactgctgcaaaagataaaggattagttagacttgaaggtaaagaatatatagttaaagatggagatgttatattattcagatttaacgtttaatataataaaaaatcagtaaagtgaaaattcaccttactgatttttttattatttcatatttaaaaattcatttgctatttctttatcatcaaaatgatgtttaactttacctattatttgatagttttcatgacccttaccagctattaatattacatcatccttttctgcaatttctatagcagtttttatagcttcttttctatcttctacaattttataattttctttagatttatctaaaccttttaatatatcatctattataagtttaggatcttctgttctaggattatcagatgttactatacatatatctgaatacttttgagctatatctcccattaaaggtctttttgtagtatctctatctccaccacatccaaatactgttattattttgtttttagcaaattcttttgctgtttttattacattttctaacgcatctggagtatgagcataatcaactattacacttatacctgtatcatttgatatggcttcaaatctaccagctacaccacctgtgttttttaatccatttataacaacatctttatctattcctaatgcatagcaagttgctataactgctaatgtattgtaaactgtaaatttacctggtacaggcacaaacacatcttcttcatatgttggagttattagtttgtatgaaactcctctagcttctatttttatatcttttgccataaaatcagctttattttctattccatatgaataacattttacatctaaatcttttatatttttataaatatcttgtccacctttatcatcaatatttattatattagcatttgttgtcatataaaataatttttctttagcttttctatagtcttctaaatctttatggaaatctaagtgatctggtgttaagttagtaaatacccctactttatatttagtttgtgcaactctatttaatgctagtgcatgagatgaaacttccattgcacagtatttacatccattgtctatcatttgattaaagtaattttgtaaatcaacgctttctggagttgtagaatttgattcaacttcattatctccatcaaatattttaattgttcctattaatcctactttattattagcagatgttagtatttcatttaaaaatgttgttatactagtttttccgtttgttccagtaacccctataacatcaaatctttgacttggatgattgtaaaaattatctgctattttagccatgtcttctcttgtatttttaacttttataaaagttgcgtcatctctatttatatcttcttctactaagaatgctttagctccattttcaatagccttatctataaatttatgtccatcaacagtaaaacctttaacgcatataaataatccattatttgttacttttctcgaatcatattgaatgttatctatttgtatatctaaactacctttagtatctaatatttctaagccatctatcacttctcttagtaacataaaattttaccttctttcaataaaaaaatttatactcatactattatataataataataataaaatataaattgtcttgtgtgctattttttattgcaaaaaatgcaaaataaaaaatagagaggagtactcctctctatttttattaattagattaatattgagctaatctcttatagctttcatatctatcttttgaactttgttctgctgcttcgaataattcctcagctacatctgggaattgtttagctatagcagcatatcttacttgtttcattaagaagtctctgaagctttcagttggctctttagaatctaatgtaaatggattcttaccttcagcttttaaagttgggttgaatctgtataaatgccagtatccacacttaacagcttgctctatgttagcttgagctcttcccataccttcttttaatccatgagatatacatggtgagtaagctattattaatgatggtccatcatatttctcagcttctactacagccttgattaattgattcttatcagcacccataccaacttgtgctacgtatacatttccgtaagacatagccatcatacctaaatctttctttctagatctcttacctgctgctgcgaacttagccattgctgcaattggagtagatttagatgcttgaccacctgtattagaatatatctcagtatcgaatactaatacatttacattttcaccagaagcaagaacgtgatctaatccaccgtaaccgatgtcataagcccatccgtctcctccaagtatccattgagatctcttgattaagtaatcttttctagcttctatttcagcaactaatgcttttatttcagcattttctatattatgagcatttgctaatacttcaagtactttttcacttgctttaacagatgcttcactgtcttctttattttctaaccagttagtgaatgcttctctagctgcatcacatatatccatagatactaatgtttccatagtttcagctaatttagctctcatttgtttaacacctaagaacattccgtatccatactctgcattatcctcaaataatgagtttgcccaagatggacctttaccttcatggttaacagtgtatggagttgatggagctgatcctccccatatagaagaacatccagtagcatttgctatcatcattctatctccgaataattgagttactaacttgatgtatggagtttctccacatccagcacaagctcctgagaattccataagtggttgtctaaattgacttcctttaactgtagttggagccattatatctccttttacagaaactttcttagtatcaactgcaaatgcccagttttcaacttcagcttcttgagtatcaagaggcttcataactaaagctttttctttagctggacatatgtcagcacagtttccacatcctgtacagtccattggacttacttgcattctgtattgtaatccttcaaatcctttacctatagcttttttagtttcgaatttttcaggagcatttttcatttcttcttcgttaactaatactggtcttatacatgcatgaggacagatataagcacattggttacattgtatacagttatcaactatccattctggaacatttactgctactcctcttttttcgtatgcagctaatccacatgggaatgtaccatcttctactccattgaatgtacttactggtaaattgtcaccttcttgtgcattcataggtcttactatattttttacgaaatctggttcgtttatttctgttttgctttcttctttagcatctgcccattcagctggtacattaactttaactaaagagttcatacctgcttcaacagctttgtagttcatgttaactattttttcaccttttttaccgtaagctttctttatagaatcttttaagtattctacagcatcagcttctggtattatttgagctaacttgaagaatgcagattgcattatcatgtttattctgtttccaagtcctatttcttgtcctaacttagtaccatttactgtatagaattggatatcatttttagctatatagtttttcatagctgctggtaaatgttcatttaactcagcttcattccatatagtgttaagtacgaatactccacctttttttaatccttttaataaatcatattgatatacatatgattggttatgacaagcaatgtaatctgcttcgtctattaaataagttgatcttataggagcatctccaaatcttaagtgagacattgttataccaccagattttttagagtcatatgcaaagtaagcttgagcatacttctcagtgttatctcctattatttttatagcttgtttatttgctccaactgtaccatcagaacctaatccccagaatttacatcttacagttcctttttgagctatttttaactcatctgctaaatctaaagaagtattagtaacatcatcaactatacctaatgtaaattgatctttaggattttctgattttaagttttcataaactgtttttatatgtgtaggagtagtatcttttgatcctaatccgtatcttccacctattatcataggagcattttcatttccatagtatactgatttaacatctaggtataatggctctccagttgctcctggttctttagttctatctaatacacatattctttcaactgttgaaggcattgcatctacgaaatgcttcattgagaaaggtctgtataaatgaactttaactaaaccatatttttcgccttgagcatttaatgcatctatagtttcttctatagcttctgttacagatcccatagctactattacatacttagcatcttctgctccgtagtaatcaaataatccatgttttcttccagttaactcagacatttggttcatgtatttttcaactattcctactatatcattgtaatatttatttgaagcttctcttgtttggaagtatatatcagggttttgtgctgtaccacgagtaacagggtgatttggagataaagctctatttctgaactcttgaacagcttccatatttaataatttagcataatcttcattttctaataattcaactttttgtatttcgtgagatgttctaaatccatcaaagaaatgtataaatggtaatctaccttctattgcagctaagtgtgcaactggtgctatatcagcaacttcttgaactgatccagaagctaataatacacatcctgtttgtcttgcagacataacgtcttggtggtcaccaaatattgataatgcttgtgatgctaacgcacgagcacttacgtggaatactccaggtaataattctccagctactttatacatatttggtatcattaataatagaccttgagatgcagtgaatgtagttgttaatgctccagcttgtaatgaaccgtggaatgctccagcagcacctgcttctgattgcatttctacaacactaaccttttgtccaaatatattttttcttccttgtgcagcccattcgtccacaacttctgccatcgtagatgatggagttattgggtatattgcagctacatctgtaaatgcatatgcaacatgagcagcagcagtgttaccatctactgttttcataaattttgccatagtatgtatcctccttgtatattcctcccaaaatagctttataaaattactatattgagtaaatattttgaatagtaaagatttctaattaataccttcaatattaatttacaaaatccttctatacttaatttatatttttgttttttgtatacttaaaagttcaatattctagtatacgtactttatatgtatacccacttttgtatacttaaaacattttttaacaaattttttaatatccacttgtttgtgagtcttcacctttagtaattgcaacagatgcactagctccaattcttgagcatccagcttctataacagctttagcatcttcttggtttctaacccctcctgaagcttttactcctatattaggtcctacaacttctctcataagttttatatcttctggagttgaaccacctgttccaaatcctgttgatgtttttacaaaatcagctccagctttaactgataattcacaagctattttcttttcttcatcagttaaataacaagtttctattattacctttactaacgctttcttatcagctgcatctacaactgctttgatgtcatttaaaacatagtcataatttttatcttttagcgctcctatgtttataaccatatctacttcatctgcacccttttttatagcatcttttgtttcaaaagccttaacttctgatgtattagcccctaaagggaatcctataacagtacataccttaacatctgaaccttctaattctttttttgcaagttctatatttgctgggtttatacatactgaaaagaagttatactcttttgcttccttgcatagtacttttacatcttctttagttgcaaaagcctttaaaattgtgtgatcaatcatttttgctatattattcataaatctttctccttttttttataatgctatttaattatatcaaatgtgaatacgtttttgtatatacattattataataataatttataaataaatatatttttatttaattttttaaaggggctatttaatagatagcttattcatttaatggtataatagtatcagttataaaaatttataacaagtaggtactttttcgttttatagtatctaaaagtatactattatagatttaaggtggttataatgaaaattcaactagaagttcaagatcattctcagtgccatatgaatgagcgttgtaataagtatgaaacgtgtcctataaatttagtacataaaataatttcagggaaatggaagatattgattctttggtatttatctgctaatccacttagatttagtgatttaagaagaaagcttcctgacgttacacaaaaaatgttaacacagcaattaagaaaccttgaggctcataatattatatatagaaaagtatatcctgttgtacctccaagagtagaatacggtttaaccaagactggtgaaaagctaatacctatattagaatctatgtatagctttgggattgattatcttaaaaacaatgatttagatttttaaatacttattataaagctaataaataactaattttataaataaaaaaagtatgtgaaaagtcacatactttttttatttatattattcagctattaattctaccatttctccgtttttaacagctgctgcgtttccttcttcaacgtctacgtgcatttctaatgcaaagttagcattagctcttactaatacattttcgaatactacagctcttggtccagaagttctaacttttaccatttgcttatcttgtactccaaatttagctgcatcatcaaggctcatgtgtatatgtcttgaagcaactataacaccttctgttaattcaacttctcctgctggtccaactaattttactcctggagttccttctatgtcaccagattctcttattggagctttaactcctaaagcaaatccgtctgataaagatatttcaacttgtgtgctaggtctagctggtcctaaaactctaactccttttatagttcctttaggtcctactaaatcaactttttcttcacaagcgtattgtcctggttggcttaatggctttaactccactaattgatgccctgctccaaataatacttctatatcagcttgacttaaatgaacgtgtctatttgatagtgctattggtaatttcattttcaaagtcctcctaaatttttttaaatattgcaatacaattatacataatattcctaataaaatcaaattttattctaatttactttaataaagtatttaacaaattaaagtaaccaggaaaagatatatcgatacaagttgtattatctatatatgtttttcctttagatatcaatgatgcaacagaaaatgccatagctattctatgatcattaaatgcttttatttttgcaccttttaattcacattttccatttattaccatgccatcttccaattcttcgatatccgctcccatattttttaggttatctacaattgcttttattctattactttctttaacttttaattcttttgcatcttttattatagttgttccttctgcttgagttgctaaaactgctattacaggtatttcatctattaaccttggtattaaatctgaatctatagtagttgctattaaattgtcactatacctaattattaagtcccctactatttcgcctccaactaatcttttatctacaatttcaaagttaccattcattgattttaatacatctagtatgccagttcttgtttcatttaatcctacatttttaattataacttctgaacctttaactatacttgcagctactataataaatgcagctgaagaaatatctcctgccacatttatatttcctactgaataaagttcatcaataggacttacatctatttttagtccatcagtttttatgtttgctccaaaagaatttagcattatctcagtatgatttctactttttgacttttcaattatagtactagcctcatttgcatataaagaagctaatattatagatgattttacttgagcagatgcaactggcatattataattaattccatttaaattaccaccgtgtatttttatcggtatataatttgcatcatctttgccatctatactacatcccattaaccttaatggatctgtaaccctcttcataggtctttttcctattgattcatcacctattatagtagaattaaaatcatttcctgcaagtatacccatcataagtcttatcgtcgttcctgagttacctacatctaaaatgtctataggttttttaagacctctaagcccaactccttttactaaaacttctttactatttacagatatatctactcccatttttctaaaacaatcaactgtacttaaacaatcttgtcctataaggaaattacttattcttgtagttccctttgctattgaagaaaacattatagccctatgcgatatagatttatctcctattaattcaaaacttcctttaagcattcatgcacctctttattacatctaatatttcatcatcttttatatcatcaaataccttaacttttcctcttcctacagggatgactaaattgatgtttccaaagctattttttttatcacttttcattatttctaatatttcataaatatcagcattttcaaatttagtaggtaaatttaataatttagaaacactaataaactcttcataataatcttcttctataaatcctttatctaaagctatcataaaagccatattagtccctatattaacagcaaatccatgacttaaattacataacttttctattccatgtccaaacgtatgtcctaaatttaaaatttttctaagtccactttctttttcatctttatttactacttcccattttatgtccgtacatttttttataatgctaaataaaacttcctcatctttatttaaaatactttccgaattattttttatatatttaagaaagtcataatcatatataaatgcatattttaaagcttctcctaatccacctaaatattctttatcatttagagattttagagaatttacatttatatatgtaaatttaggttgataaaaggttcctattatattttttatatttcctatgtttataccagttttgccacctactgacgagtcaacttgagctaatagcgttgttggtacttgaactaaatctattcctctcatgtatgtagatgcaacaaatccagccaaatctcctacaactccaccacctaaagcaactaccagtgattttcttgttatatttgtttttatacaaaactttattattttttcatatatagataatgacttagattcttctccactttccactataaatacttctatacaactgtgatttatattttttataaaattagaaaattgatatttatgtacatttttatcagttagtattaatactttatcgtatttattttctaatttaaagttattgtaattgtaatcaattattatagatttttccatcctctatcacctaacctattcatatatgaagtataacttttctttatatcttctatattatctttaccgaatttttctaggaaaaattgtaatattacaaatgctactacattttcacatacaatactacatgctggcaccgcacaagtatctgacctttcaactgttgctttgtaattttcaagtgtattcatatttattgaatttagtggtctatataatgttggtataggtttcatggcacatcttattaatatctcatctccagtggtcattccaccttctataccacctaatctattagtttctctataaattcctttttctttattataaaatatttcgtccataacatcagagcctttattacttgcaacttcaaaaccaatacctatttctacaccctttatagcttgtatactcatgatattcatagctatatgtgcatcaatctttttgtcataatgaatgtatgatccaagtccaggaggaacatttttaactctaatttctataattccacccaaagtatctttattttcttttgcaaaatctatctctttaatcataagcttttctatattcttgtctacgcatcttacttcactagaatcaacattatcttttatataattaaaatcatatattttgtctatttcaacattacctatttttactatatgtgatgcaaattctatattaaattgtttaagtacttgtttacataaagctccaactgcaaccctacttgctgtttctctggcactagatctttccaatacatttcgtgcatcatcaaaatcatactttaatgcaccgactaaatcagcatgtcctggtcttacattattaacttttttagtttctttatctatatcatcaactgtattcatatacttagtccaattttcataatccttattcattatttgtatagctattggacttcctatagtaactttgcctctcattccacttagtatttctactttatcactttctattttcatacgtccaccacgtccatatcctgattgacgctttttcatttctagatttatttcatctatatctactaatacattagctggaattccttctactatagaagttaaacacttaccatgagattctccgctagttatatatctaagcataatttatactcctttccagtatattttatgttataaaaagagcttgtttttacccaagctcttttatactttctacgtaaagatttatatatttatctaccatgtttttggcataatcatttttattaaagcataacttatcactactatctatataacaattatataatagtttagtatttatgcttttaaagaaaaagtccattactatttgtccacctttaaattgcgacttatacggctcacttccccctactgcaatatacatacctactcgatttttatttctatctatagaaggctttttaagtatatatttacttgcatatatcgcttgagttctatcaacaacagttttaacttttgctgatatgcaatcaaaatgaactggacttacaactatagtcccactagctttatcaaacatgtcatacatcggactcatatcatctttaaatttacagtatcctgttttctcacaaaacccacaagcagtacagtactctatattcatattatatatgtcaaaaaccttgtaagttatatcattttcatttaattcttttattatattatttattatactaacacagtttttatttttccgtggacttccatttattattaaaatttcaggattaaccttattcatatgaatctccttatttttctctaagagtaataattaatatatcatcttcaaaattacttttcttagagaaatgccataacttagattttaaattggtaatcatatttgttttatctaagttactattttcttctaaaaattctttaagtctttctactccaaattcttctttatcactatcttttatttctaatacaccatcagtatataaggaaattgatttatatttagatatatctatttctttatctaaatatgatacttcatctaatataccaataggtattcctttattacattttataaaactcgcattattatctttatcgactccaattgggtaataatgccctgcattagataaaatcattttgtgttcatcattttttataatcccaattatacaagttgcaaagactcccattttatcaaattcatcgaataaaaattgatttatattttccattatttcacttggtttatcatattgttttgctaaaactttaaatgcaccttttatcatagctaccatatagtttgatactataccatgccccattacatctgctaaaatcgctacaattgtattgtcatctttttttatagtatgatagaaatctccacctacaactttagcaggtttgtgaaaataaaataattctctattatttcctaattctttatttcctttattcattataagtttttgttgttgatttaaaactttaagttcattttctaaaacatgatgctttacttcacttttactatattcatataactgcattgctactgatacttgctttgcaagtatacttaatatatttaaatcatcttttgtatagtttttactattaatgcaagctatatatccaataaccttatttttattcatcaatttatgatatatatatgaatttaccattcctgaatactcatcactttttacttcattggaatatgcacctatagttttatcatctattactttatttaaaattgaatatacatctatagcctcatcttcatctaaactgtaaaaactaaatatctgatttttctttttattgttatctataatgataattgattctctactattagttatattacaagcttgtctgcttaaatgatttaagaagctttttatatctttatttaaataaagctttttagtagcttcatttatagatgatatagcacctcttaatttatttattagtatttggatatcattatttttactagttacttctatagataaacttataagcgatgctactgatgaaataaagttcatatcatcatcacttatcttgtcttgttctgttaaaaagcaagtcataaatcctgttactttttcatttactataagaggaaaaactattcttcctatataaccttcttttattgctaaatctctttcatcaagagctctttcatcactgaatacattttctatatacacaactttttgttcttttactgcttcgtgtatgtatttaggatattcattgaagtttatttttacccctataggcttatcaataggaaaaacttttgatatatgatctaaagtttgtgaacatactaaataagcatgctcataattatttttataaaataagtttacacatgcttttgctggatgaactacatctaacattttttctataattttatcttttatctcaaagaagttgttagactcagttactaaagtagatatctctacaacgcacttaagtctttcattttcattatagtatctcatataagtatttcatctcccctctttatattaagtctatttattaatattactatatatatcttttatagtaaacataaaaactcatacaaatcaagctcaagtattaattagaattaattttatttaatagctttttaaggctatctataaaaactatagttaaacaaattattataatataattaaattcagataccaatcctataataaatatagttaatgctgaaattatatttactttgatgttagtataatttattttatttcctaaagaatttatattagtagagttaaaatgggaatataaagaccataaaaatgaaaagaaagtttattcaatatcattaattgaagatatagtagatattgatgattatataaatataaataaaataagattaggaaataagcaaaaagaaattatagaatttttaaaagaaaaaaaagaagttgatttaaatgaagtactagaaaatttaaaaataacaagacaaagtataaataagctaaaagaaaaaaatcttattagaatagaagaagttgatttttatagaagtccagaacaaatatactctatagagcaaaaagaaataaatttaaatgaagaacaaagtaaagtagtaagtacaataaatagtgaaatgtttgatgaaaataaaaaaccatatatgattcatggagtgacaggaagtggtaaaacagaagtatatatggctataattgaaaatgcattaactcaaggattagatggtttagttttagttcctgaaatttctttgactcctcaaactatatcaagatttaaaaacaaatttggagacattgtaggagtttttcacagtcaactatcagaaggtgaaaaacatgatgtgtataaacaagtaaaagaggggaaaataagaatattaattggtgctagatcggctttatttacaccatttacaagtttgggtgttataattatcgatgaatttcatgaaagtgcatacaaatcagataaaaatcctaaatttagtgctatagaagtagctaagtttatagcaaagaaaagagatatttctttagttttaggatctgcaacaccatctatagaagaatattataaagctgttaatggtgaatataagttacttgaaataaataaaagagcaaataaaaagcctatgccaaaaattgaagttgctgatatgaaagaagaacttatgataggtaacaaaagcatatttagtactaaactaaagtcagaaatagaacttgctataaaaaataatagtcaagtgatgctatttttaaatcgaagagggtattcaaattttgtatcttgcagaaaatgtggttatgtatttacttgtgagaattgtgatatatcacttacatatcataaaaaaagtaatacaggaaaatgccactattgtggatatgaaaaggaaattcctagcgagtgcccagaatgtaaaagcaaatacataaaaccatttggaataggtactcaaaaaatcgaagaagaaataaaaactatatttcctaacttaagagttttaaggcttgataaggacacgacttctaggaaaggctcatttgatagaatcttaaatagttttaaaaataaagaagccgatattcttataggaacacaaatgcttagcaaaggattagattttgataatgtaacattagtaggaatattatcagcagatatgatacttaaatttccagattttaggagttcggaaatgacttttcaactaattactcaagttgcaggtagagcaggaagagctgaaaaagatggaaaagtaattttacaaacttatgatactgatcactatgcaattaaacgtgctataaattatgactttaaaggattttatgaagatgaaataaaaataagaaaattatttgattatgctccatttaataatatggttagtgttgtattaagtggaaaagataataagttagtagaaagtaattctaaaaaaatgtatgattcattagcttatttattaagagagcgtggtataaatgatttatcttttatattagggcctaaccaatgttctataggaaaaataaatcaaaattataggtggcaaatattatttaaagatgaggatattgaaataaatctattaaagggtataataaaatatatatgtataactaagcgcgagatagtttttgataaggatataaatatatctatagatataaatccttatagtgtattataaaaattaggaggaatataaaatggcgttaagacaaatagttcaaataggagaacctgtattaagaaaaaagtgtaaagttgtagaaaaaatagatgaaaaaataatacaattattagatgatatggctgatactatgtatgaagctgacggtgtaggacttgcagctccacaagttggaatattaaaaagaatagcagtaatagatgttggagatggaataatagaacttataaatccagagataatagagacttcaggagaacaaactgatgatgaaggatgcttaagtgttatgaatgaatcaggaccagttacaagaccttattatgttaaagtaagagctatgaatagaaaaggacaaatgtttgaaatggaaggagaagaacttttagctagagcattttgtcatgaaatagaccacttagatggaatattatttgtagataaaattgaaaagtagtaggagttgatatatatgaaaatagtatttatgggtacgccagaatttgcagttccatgtttacaaaaaataatagatgaaggacatgaagtactagcagttgttactcaaccagataaacctaaaggtagaggaaaaaaactagctatgcctccagttaaagaattagctttaaaatataatattgatgtatatcaaccagttaaggctagagaagaatcttttgtagaaaaattaaaagaaattaatcctgaattaattgtagttgtggcatttggtcagatattaccaaagagtatattagatatacctaagtttggatgtgttaatgtacatgcatcattattaccaaaatacagaggagcagcacctttaaattgggttataataaatggagaagaaaaaacaggtgtaactacaatgtatatggatgttggtctagatacaggagatatgattttaaagagtgaaatacctttagatgatgaaataacagcaggtgaacttcatgataaaatgatgatagatggagcaaatgtattaaaagaaacaatagaccttattgcacaaggaaaagctccaagagaaaagcaaaatgacgatgaaacttgttattcacctataatggataaaacattaggaaatatagattggaataaatctgctaaagatatacataatcttgtaagaggtgtaaatccatggcctagtgcatatacgacttatgagaatcaaactatgaaaatatggaaaactaaagttgtagataaaaatagtgataaagctccagggactatattaaaagttgataaagagggtatagaagtaaatacaggaaatggagttattcaaataagtgagatacaaatgtctggaaagaaaagaatggtagtatctgaatatataaaaggaaatactataagtactgatattgtattaggaatataagatgataaactttaaaaagtatatgacaacaataggctttttcatattaatattagtcggattatttttaggaatgaatatttttatgaaaagcctagaaaatctgttttctataacgataaatgcattaataatattattattaattataactatattttcaagtgtagttacttatagtgtattgaaaggtaaaaaagtaaataaagacataatgaaaattaactttaaaatagttaatttactatatccaatacttatagcattaggcaatactttaaatatacctaaagatgaaataagaaaagtttatgttaaattaaacaatgattatatatatagtaataggtataaaataaaaccagaagacatacttattcttataccccattgtattcaaaaaagtaagtgtaaactaaaaattacaacagacgtaagaaattgcaaaagttgtggtctttgtaatgtagctgacttattaaaattacaaaataagtatggtgttaatgtatttatagctacaggtggtacattagcaagaaaaaaaataaaagaatttagacctaaagctgtagtggctgtagcttgtgaaagagatttaacagctggagttcaagatataaatcaaattccagtattaggcgtatttaacaaaagacctaatggtccttgtgtagatactgaaattgatgccaaagaagttgaaaatgcaataaaattctttataggagagtgttagatatgatgccattttatggtggttatggatatcatttagatcctacgttaattattttaataccagctatactttttactatgtatgctcaatttaaagttaataacacaactagtaggtattttaaagttagtagtagattaggttatacaggagaacaaacagctagaagaatattagatgcaaatggactttataatgtcagaattgaaatggtcccaggaagattaagtgatcattacgatccgagaagtaatgtagttagattatctgaggatatatactatggaacatctattacagctacttctgttgcagcgcatgagtgtgggcatgctattcaacatgctaaagggtatgctcctcttcagataagaagtagtttagttcctgtagtaaactttgcatctaatatttcatggtttttaatatttgcaggactttttatgtcaggtcctttactaaaaataggtatactattattttcagcatctgtattatttcaaataataacattaccagtagaatttaatgcatctagtagagctttagttcaacttggaaatgagggtatattagaaggaaaagagataaagcaagggagagaagtattaactgcagcagcattaacatatgtagcagcagcattaacatcagtacttcaattactaagattaattgcaatagcacaaagacatgatgattaatagagattgtcctaggggtttctaggactttttctatttagagatggaggtatttaatgaacgcaagaagattggcatttaaaacgttatatgatattgaaagaaataaaaattattcaaatatatctataaataagaattttaaagatatagatattagtgatcaagaaaaaggtcttgctactgaacttatttatggagttatagaaaataaatattatttaaactatataatagacaagctatctaagataaaatcgaaaaaaatgtctacctatgttaaaatatcattatggttaggaatttatcaaatactatttttagatagtataaaagatcacgcagcagtaaatgaaagtgtagcacttataaaaaaatatgacaaaaagtcatcagggtttgtaaatgccatattaagaaatgtaataagaaacaaagaaaatataatggaaattgataaaaaagatatagttgaatatttatctataaaatattcatataatcaatggttaattagaaagtggatagaagaatttggacaagaatttacagaagatttattagaggcaaactcagaaaaaccaaatttatatataagatcaaacacacttaaaataaatagagatgagcttataaataaattaagagaacaaggaatagactgtagtaaagtaaacggaatagatgaagctataatggttaagaatctaaaaaatatagaaaataataagttatttaaagaaggatattttacagttcaagacataagttctatgcttgttggaaaagttgcaaatccaaaagaagagaaattagttttagatgtatgtagtgcacctggaggtaaaactactcatttaggaactataatgaaaaatactggtcaagtaatttcaagagatatatttgatcataaattaaaacttattaataatactgtaaaaagactaggtcttaaaaatataaaagttgaaaattttgatgctcttaatatagatgaaaatagtatagataaatttgactacgttatttgtgatgtaccatgttctggtatgggaataataaaaagaaagccagaaataaagtttaaaaaagaagaagaaataaaagacttacctataatacaaaaaaagattttaaataatgcttcaaagtatgttaaactaggtggaaatttaatatatagcacttgtactatacatgatgaagaaaatataaatgtagttaaagaatttttaaatgttaatgataattttgaactagtacctattgatgaagttaatgtggatttagataatcaagataaaggatatataaaaatataccctaatatacacggaatggatggatttttcatagctaaactaaaaagagtaaggtaggaatcaatatgaataatgacaataaagtgtgtttaaaaaatttaactgaagaagaattaaaagaatttataaaaagtataggagaaaaagcttttagaggaactcaaatttatgggtggatttataaaggtgcaaagactttcgatgatatgaataatataccaaagtctttacgagaaaagttagaaaaggtctcgtatattgggaatttagatacagagcttaaattagaatccaagatagatggaacgagaaaatatttatttttattaaatgatggaaacataattgaaagtgtaatgatggaatatgaacatggtgtaacagtatgtatatctaatcaagttgggtgtagaatgggatgtaagttctgtgcatctacaatagatggactgttaagaaatttagaaccatgggaaatattagaccaaataataaaaatacaagaggatataggcaaaagagtgtcaaatattgtattaatgggaagtggagagcctcttgataattttgataatactaagaaattcttacaattagtaaatgaaaaaaatggacttaatataggatatagacatataactttatctacttgtggagtagttcctaaaatgtatgaattagcagatttaaaaatacctataaacttagcattatcgctacattcgccttatgatgaatcaagaaaagaaataatgcctatagctaatgcttattcaataaaagaagttatagatgcatgtgaaaattatataaaaattaccaatagaagggttacatttgaatattcactaataaaaggagttaatgactccaaagaggatgcaaaggaattatcaaagattttaaaagggttattatgccatgtaaatttaatacctataaataaagtagaagaaagagattatgaaaaaccagataaaacgtatgtatataagtttagagatatgttattaaaagaaaatatacctgctactataagaagagaaatgggagcagatataaatggtgcttgtggtcaattaagaagaaaacataaataaaatagagggggaaaaattatgatatataactgtgtttcccatattggaaaagttagaaaaaataatgaagactgttgtaagggagaaattatcccgacaaaatctggtgatataggtatatttgctatagctgatggaatgggtggccataataaaggtgaagtagcaagtgaactagcagtagataatatagtacgttttttaaaaaataacctaatacaaaatgaacacgttaaaataaattatatagatgatattcttaagcaagcttataatgacgtaaactctataatatataaaaaatctaaaatagatgaagaatgtagtggtatgggaactacattaactacagtaataatatataaagataaagcatatattgcaaatgtcggtgatagtagatgttatatattaagaggcaatgaatttaataaaattacaagagatcattctttagtagaagaacttattgctcaaaatgctataactgaagaggaagcaaaaacacatccaagaagaaatgttataactagagcattaggaacagagcagatgataatagttgacatttataaagaagacataaataaggatgataagatattattagctacagacggattaactggttttgtcgatcaaagagatatatatgacattatatgtaaagatgagaatatagatgaaataactgatagtttgataaataaggctaatgaagtttcaggtaaagataatgtatcagttatattaattaagtataattaggatggtgataaagtgggagagacagttttaggaaatagatatgaaataattaaaaaaattggcgatgggggtatggcttttgtctatgaagctagggacagactgttaaacagaactgtagctataaaggttttaagacctgaatttgtagatgatcaagagtttttaactaagtttaaaagagaagctgaagcggttgcaagtctttcacatcctaatatagtaaatgtatatgatgttggtgaagatggaaaagtacattatatagttatggagcttatagaaggacaaaacttaaaggatatcataaaaaatgaaggtactttagatgaatatacagctttagatataactaagcaaatagcaagagcattaggagctgcacacaaaaaggggattatacatagggatataaaacctcataatatacttatatctaatgaaggtaggattgtaaaggtagctgattttgggatagctaaagctgtttcaagttccactatgactagcactggaagtgtaataggatctgttcattatttttcaccagaacaagctaaaggtaaatttgtaggtaatactacggatttatattctttggggatagttttatatgaaatgataataggtagagtaccatttagaggagatagtcctatatctatagcacttcagcatataaatgatgagatagagtttactcaagaagaaaaggtagctatacctcaaagtgttagaaatataataaaaaagttaacttctaaatctagtgcagatagatatcaaggagcagatgagcttatagaggatattgaatatatagaaaaaaatatagatttagactttataaaagaatatgacaactatgctacacaaaagatagatgaaaatgaactaaataaagcaataaaaatgggaaatactaatccaagaattgattacaatgaagaagacttagaagaagaggatgagaaaacacctccgataaagaattctaagaggaaaaagaataaaaaagaagacaatccaaaaagtaaaaaaaggtggaaaatagcagctgtagttttatctataatacttataatacaagtactagttgtaggaaaaattgcatcatcaatgtttggtaaaaataaaacagaagaaggaaaagcaccagactttattaatatggaattaagtgaagctcaaaaggttgcaggtgacatgggaatcaatataagtgttagaatagaagaatacagtagcaaagttagtaaaaatcatataattgaccaagcaccaaaggcaggtacacaaataaatcctggggatactataagtgtagttgtaagtaaaggtgaaaaacaaacttcaataccaaacttagtaggacttactcttggagaagctcaaagtataataagtgaaaataagttgagtttaggaactgtaaattatgaatataatgattcacatgaaaaagatgtggtattacatcaatctcctagttcgggaagtatacaggcaggagataaaataaacttagtagttagtaatggtccaaaaccagtggaaacaccaaaagagccagaaacaccaaaacaaccagaaacaccaaaagaaccagaaaaaccaatagttccagataaagatgaaactaatcaaggtaataatggtaatggagaacaaacagaaaatggttcaggaagtggaaacggaggacaactagaaaatggtagtggcagtaccagtggtagtggtcaacatggatcaggacaaggaagtaataatagcggacagcatggtaataatggaaatggagaaacaacaacaccagaaacaggtgatgctacagtccaatagcataaaagttttaattatataatattaattgttatataattagtttatgtttacaaagtataataaataattatattaaagtccaatgattaataattattggacttttttgtaatatttatgtaaagttatataaataatagtatttagtaattttattaatctataaggaggatttaaatgatagaaggaattattacaaaaggtattggagggttttattacatagatacaaaccaaggaatatatgaatgtagagctagaggtatatttagaaaaaataagataactcctttagttggagataatgtaaaaataagtatagttgatgaagaaaataaaaaaggcgtattagaagaaataaaagaaagagaaacagaattagtaagaccaccaatatctaatgtaaataaagctataattgtatttgcaataaaaaacccaaatcctaatttatctttattagatagatttattgttttagcagaaagagaatgtttagatatagttatagttttaactaaagctgatttagctacagatgaagaactagaaaatttaaaaagaatatatgaaatgagcggatataaagtaataccagttagcaataatgaaaacttaaacatagataaagtaaaagaagagttaaaaggaaatatagttgtctttgcaggaccatctggagtaggaaaatctacactattaaatcatatagatagtaaatttcaactgcaaacaggtgaagttagtgataaaataaaaagaggaaagcatacaacaagacatgcagaacttttaaaattagaatgtgggggtatggtagctgatacacctggatttagttcattgactttagatgacattgaagaaactgagcttaaagaatactttatagagtttgacgagttttctgatgagtgtaagtttggtggtagatgtatgcatgaaaatgaaccatcatgtggtataaaagaagcagtaaaggataataaaatatcaaaagaaagatatgaaagttacctacaattactaaatgaaaagagacaagggaagaggaggtactaagcatgataaaaatagcaccatcaattttatcagcagattttgcaagattattagaggatgtaaagaaagtagaaaatgcaggatgtgagtatttacacattgatgttatggatggacattttgttcctaatataacattaggtccaaatgttgttaaatcattaagaaaagatgtaaaaatggtatttgatgcacatctaatgatagagaatccagataattatataaaggatttcgtagatgcaggttgtgatataatcgttgtccatgaagaagcatgtactcatttacatagaactatacaaaatataaaatcgcataatgtaaaagctggggtagcattaaatccagcaactccaatagaaaatataaaatatgtattaaaagacttagatatggttcttataatgactgtaaatccaggatttggaggtcagtcatttatagatagtatggtagataaaataaaagaagtaaaatctttaatagatgagcaaggtctaaatgtagatatacaagttgatggaggtataaaaccttcaaatgtagataaagtagtaaaagcaggagctaatgttatcgtagcaggatcagctatatttaacagtgatgatatagaggttacagttaaagaatttagactaaatgcatctaaataaggggtaattatgaaagcttgtattttattaaatggagaagtagataatcttgattatataaaagatattatagataacaatgattatagatacataatatgtgcagatggaggagcaaaacatttatataaattaaatatagtacctaattatataataggcgatttagactcattagaagagtcgataattaattattataaaaataaaggtgtcgattttaaaaaatttcctaaaagaaaagatgagacagatgctcagttatgtatacacttagcaaaagatttaaatgcatcagaaattcaacttctaggagctctaggcggtcgtattgatcatactattgcaaatgtaaatcttatgtattatataaaagagttaggaataaatcccataattaagagtaaagttgaagatatatatatggctgacagtgaagttataaatataatgggacaaaaaggggatattatatctataattccagcaaaaggtgatgtaagtggagttacacttaaaaatttagagtatcctcttgaaaatgcaactataaaatatggtaatccaataggtatatctaatgtaatgaaaagtaatcaatgtagtataaaagttaaaaatggatgtttaataatagttagaaataaaataccaaagtagcatatgctattttggtatttttatttttataaaaataatcataatagcttggcctatttttgttaaattgtattaaagggatataaatatgaatattatattttatgaaggtatttataggagggaataatttgagaaatcaatatagaaatttacttggagtgctatgtttagctacaggtataactgttattttgggattgatacttcctaattggttatggatgatgctattatctattgtacttatagggtgtggggtaatgttatttatgtaaaatatatattagaaatttaagggggataaatttatgaaaataataactgttaaatgtcctaaatttttatctaagataataatgttttttatgagaaaaaaataaaagcctacaggttgtaggcttttttattaaaactaagctctttcaacttttccagaacgtaaacatctagtacaaacttttattctctttggagtaccatctattatcgctctaacgtttcttaagttagcagaccaagttcttctgctatgtttatttgagtggctcacttggtttcctgaaactttacctttaccacatacgttacatacctttgccatttttcgtacacctccttaaatgataactataacactgaaaacacagtttatgttaacataaatctctaaaaaatgcaatagaaatatatatttgtcttacatatattgaagaaattcttgttatcatataaaattatatatataattctatataaagtaaatattaaagttaaaaataaaactaaaaataattttagggggtcaaatcatgagcgctaaaataaacaatgaatttggaactatagaaatagacaagcaagtaatagcacaaatagcatataaagctgctatggaaagttatggactagttggtttagcacacaaaagtaaaggtattgttgaattactaaaaggtgaaaatgcaactaagggtgttagtgtacaggaattagaagatgaaacgatagctatagagctttacgttataatgcaatatggaacaaatatatcaactgttgcaaataacataatagataaagtaaaatatacacttgagaaaatgacagcaataaaagtaagtagaatagacgttaatgttcaaggaataagagttaagtaatttaggaggaaaaatatgattcaatatattgatgggaaaaatctaagagatatgatgatctctggagctaataatctccaaaataataaagatttagtagacaagctaaatgtattcccagttccagatggagatacaggtactaatatgtcccttactatatcttatgctatgaaggaattatcaaaagttaatgatgatgatataactaatataggtaaatctttagctaagggatctttaatgggagcaagaggtaactctggagttatattatctcaaattataagaggatttacaaagtctatagaaggaaaagaaaaattaagttctatggatttagctaatgcattaaaaggtggatcagatacagcatacaaagctgttataaaaccaatagaaggaactatactaactgtagttagagaaagtggagaatatgctgtaaaagctgctaagaaagaacaagacatattaaagtttctagagttagttataaaagaagctaatgcctctttagaaagaactccagatttacttaaaaatttaaaagatgctggagttgtagattctggaggtaaaggattagttcttatatatgaaggaatgtatgaagccttaagaggaaatatgataaaagcggacggaaatagcaaggttgatacatcttcatcacaatcagctcaaagtgaaataaacactgaagatataaaatttgcttactgtacagagtttatattagaaagtgataaaataacttatgataaaatcagagatataatgctaggttatggagatagtttagctgttgttggagatgaaggagtaataaaagtccatgtacatacaaatgaacctggttcagtacttcaagaagctttaaaatatggtcaattaataactataaaaatagaaaatatgaaagtacaacatgaaaatatattaattgaaaatcaaacagctgtatcacaagaaccaatgaaggaatatggatttatagctacatcaatgggaagtggattagctgatatatttaaggattttggagttgactacattatagaaggcggtcaaacaatgaatcctagtactgaagattttatgaaagcaatagattctataaatgcagaaaatattattatattaccaaataacagcaatataataatggctgcaaaccaagctaaagctttaagtgataaaaatataatagttataccaagtaaaactgttcctcaaggatttacatctcttgtaagctttaatgcagatgcatctattgaagaaaatgaagctactatgttagaagctttatcaatagttaaatcaggacaagtaacttatgctgttagagatacaattatgaatgatatagaagtaaaagaaggaaatttcataggtataggtgaaggtaaattattatcagcaggagaaagtaaggacgatataactttaggactaatagaaaagcttgttgatgaagatagtgctataataactttattttatggtgaagatgtaagtgaacatgaagctaataaatttaaagacatgctagaagaaaagtatgaagatatagatgtagaactttactacggaggacaaccaatttattattatttaatatctgttgaataatatttttaaaatcctgtataatcttactattaggtaagttaaattatacaggattttttattttaaggtgataaatatgagtgatttaaataaagagattaaatatgtaaaaggtatagggccaaaaagagctaacaaattaaacaaattaggaatatttactgtatccgatttagtatattactttcctagacaatacgaagatagaaataacttaaaaaagatatttgaactagaagatgaagaaaaagtaactataagagtgattgtaaatagtatagaaacttctaatattagaaaagggttagttataactaaaataggagtaagagatgaaactggatttgcaagattagtattttttaatcaagaatatataagtagtactttaaaaaaaggaaatactatattagtttttgggaaggttaaaaaaaattctcatggagtagaattaagctcgtgtgaaatagaacaaatgactaataatcctaaaaacacatgtggcataatgccaatatattcattgacttatggattaacaaataaagaacttacaaatataataaagacagtgtttaataatgaacaaattaaaataaaagagtatttaccaaagcgaattatagaaaaatacaaattatgtagtattgattatgcagttaaaaatttgcatgcaccttcaagtaaagatagtttaaaaatagcactttatagattggtctttgaagagtttttaatgcttcaattaggcttatttttgtttaaaaatggagtaactgaaaagtcaggaatattttttgaaaaaaaacaaaatttaaaacaagtattaaattctctaccatttaatttaactaatgctcaaaatagagcattaaatgagatattaaatgatatgaactctaataaagttatgaataggctagttcaaggtgatgttggtagtggcaaaactgtagtagcacttttatcattagcaaattgtgttttaaatggatatcaaggagctttaatggcacctactgagatattagcagaacaacactacttatctttaaatgaaacgctatcacagtttgggattaaaataggtttattagttggtagtttaacaaaaaagcaaaaagaagttacactagaaaaagttaagaataatgaaatagatatattaataggaacacatgcactaatagaagataaggtagagtttaacaacttagggattgtaataacagatgaacaacatagatttggagttagacaaagaaataagttatcagaaaaaggatataatccagatatattagtaatgacagcaactccaatacctaggacactagcattgattttatatggggatttagacatatctataattgatgaattaccaccaggaagacaaccaatagagactttagctgtatataaagacaaaagagatagggcttataatagtttagttcgatctgaagttgaaaaaggtagacaagtatatatagtatgtcctttggttgaagaaagtgaatctatagaagcaaaagctgccgtagatttagtagaggaattaaagagtgaatattttgctgacttgagattaggtcttttgcatggtaaaatgaaacctggtgaaaaagacgatataatgaaaaaatttaaaaatagagagttggatatattggtttcaacgaccgttatagaagttggagttaatgttccaaatgcaacacttatgataattgaaaatgcagaaagatttggattggcccaacttcatcagttaagaggaagggttggaagaggtagtcataagtcttattgtatattgatttactcatcaaaatcagaagtttgttctcaaagaatgggtataatggaagaaactacagatggatttaaaatttctgaaaaggatcttgagataagaggtccaggagagttttttggaacaagacaacatggattacctgaacttaaagtagctaatatatttaagcatatgaaaatattaaaagtagctcaacaagaagctaggtatatagtaggggaagacccaaaactagtaaattatgagaataaggatttaaagaaagaagtgttaaaaaagtttgaaaatagattaaaagaaatatcattaaattagatgtaatttatggtaaaataaagtggaaggagcagttatattgagagtaatttcaggaaaagctagaggattaaaattaaatacacctaaaaatgaagatgtgagacctactactgatagagttaaggaatcgctatttaatataataaatggatacataatagatggagaaatcttggatttatttgcagggacaggctcattaggtatagagtgtttatctagaggagctaacaaatgtgtatttgtagatgtaagtaaaactagcatagatatagtaaaaagtaatataaaaaaagctagagtagaagataatgctgaaattttaaatatagattataaatctgcaatagacaaagttaagaacaaaacctataaatttgacataatatttatggaccctccatattatgaaaatatgtttatggatgcattaaaaaaaatagatgaatctgatatattaaaagatgatggaattatagttgtggaacatgatacaaagcaggaattccctgaaagtatagggaagctaataaaagatagaagcaaaaagtacggaaatactacgcttacattctattgtatggaggattaataatggaaagtacagttagaaaagctatatttgcaggaagttttgatcctataactaatggacatctggatataatagaaagagctgcaaaattatttgatgaattacaaataggagtattatataatcctaacaaaaaaggactttttacatttgaagaaagaatagatttaataaaagtatgtacaagccatattaaaaatataaaaatagttagttttgatggattattagttaattattgcgagaaacatggtattcaaactttagtaagagggataagaagcggagctgacgtagagtatgaacttcagatggctcatatgaataaagaattaaacccgaatatagaaactgtaatactacctacaactacaaagtattcatatataagttcatcgcttataaaagaagtattacattttgatgttaatatagagaatttagttcctaaggtaataatagatgaattaaaaagaaaaactaatagggggagataatatgaatatagacttagaaataatggaattattagaggagttagaaagcactataaataatgctagttcaattcctttttctcataaatcagggatagataaagaagaagtattaaatataatagctgatataaaagcgatacttcctgaagaagtaaaacaagcagtttggataaataaagaaagacaaaaaatattaaataatgctaatcaagatgcagaaattttaatagaacaagctactaaagaagctgagcaaattatagaaaaagctatgaaagaaactgaagatatgaagaaaaattcagaagatataataaaatcatatattgattcagatgggttagtagtagaagctgaagaaaaagctaaagctataatagaaaaagctgattatacagcaagagaaataaagttaggctctataagatatgcagatgatgtattagaaggattacaatataatcttcaaaatataatggacgaaatttcaacaaatagaagagaattaagtgaataataaaaatagctatctataaacttatagatagctatttttattattctttacttagcgtgagtatttagtcgttttaataaaaaaaaggtaaatattatatatattagtactaatacaggtaatattaaatagtaattgtttatataataattccaaatgaaattgttatataatatactagatatacttgttaatttctcaaatagtggaattaaatctattaatggataaaatatgaaagtaaagataaatgcaaatacaccatgcaaaaatttagaaaatatatatgtacttatacttatatcagtttgggctaaaaagctagaacattgggctaatatagataaaccactaaaagctattataaaactacacaaagaaattctaatgatttcagggatatttgtaatactagagacttgattacaacctatagttatttcaaatagcccacttataaaagctgagcataattctttagaaaatccaaaaaaagataaaggtaagtaaataatagcagatactaagtctataaaattaaatattgataatactttaaatacaactgaaaatactattacaaatcctcctaccataagaattgtgtttataccattaaatactgcatctccaaacaaaacaaaaaaacctttattttctttttttctattagctacaataagattaacttctgatttaaagtctatattttcgcgtttaacacattccttaccataatttttaaataatattcctactgttaaagaagctaaataatggcatataagaattaggtatcctaaagcagtattattaaacattccaattgcaacagctccaactataaataatggaccagaagtagagcaaaatgataccaacctttgagcttcatatttagaaatttcattattttgtctaagttcagaagctaattttgctccaacagggtatccagatactgtagatatagcaaaaactaaagagctttttcctgatacattaaaaagttttctagttaatggatttactactaatcctaatatgtctacaaattttaattttactattaagttagctgctataatgaatggaagtaatgaaggtattaaggtatctacccatattgaaaaaccatttttagcagcatttatagagtcagttggaaataatattatacctataattattatcattacgactaaagatggaattaaaaattttataaatttgctttttttcacttcaccacctacttttaatataatctacaataattatattaaattaaattataaactatgataaaaaacctaccatgtaattggtaggttttactttatatatacaggggaaaggtaataatccataggacctttaagtaaattcatgttgtttttatagtacgggatattatacatatttgtagcttttatatcatatttaattaaagtttcaaatactttatcatcttcaaagttaacgttagaaaatttattaatgatttttatttttcatattactaatatcctatcataaaacactataccctcttttacaaatctaagtattaaatacttagattgtatatcttaaattgtttatatgaattttaataattaaaaaagctgatttctataaaatatagaaatcagctttaatctctttaccgtttagtttttgaaaatttttcttcatgttgtaaaagccatagctttctatccaatcctccaccatagccagtaaggcttttattagatcctataaccctatgacaaggtacaactatatttataacatttctaccgttggtatttccaactgctcttacagctttttcatttcctatttttgttgctatatacttataagatacagtttctccgtaaggaatatgtgttaaggcattccaaactttttcttgaaactcagttcctttaagtttaaattttatatcaaattcttttctctctccattaaaatactcttgtatctgttttattacttcttttaaaatttttggttgttctgtattttctcttttttcatctacatataaaattgatattaattcctcttctgttgtgcttatttctagtattcctataggtgaatcgtagtagtagtaatatctttgtgtcattcaaattcctccttagacataaataaattattaaaaccaagtaatttgagaattttcatatctacttttatagtcttttataatgtctttcatatcatataataaattgtatttttcgcactcttctttaaatactttccataaatgctctgattttaatgaagaattttcatattgttctccataagtttttatatatttttcatctaacatttgatttggaaatatttttcttagttgctcaaaataatattctctttgattgcttcttaaagtaactcctattccataactaaaaataaatttagctccacattcataagccctttttataatatttctgatattttcctcagtatcatttataaatggtagtattggcattaataatacacctgaatatatattattatctgataacttttttaaagccttaaatctatcagatgttgtagatacatttggttcaatttttttgcaaagttcatcatcaaaagtagttattgtgatttttactaaattaggagaatgcttttgtattctctttaatatatctatatctctaactattaagtcacttttagtagttattgctattccgaatctatgttcatctaatagttttagagcttgtcttgttaaaaggtatttttcttcaaaaggattatatggatcactcatggctccagttcctactacacctttttttctctttgatgttaaatctttttttattatttcaattgaattttctttaattctaactctgtcaaaatctataatttgataacaattgcttctagaatcgcaatatatacatccatggcaacatcctttatatatgttcatattgtagtttattccaaaccagtgtgggttgtctttatagttagatacaattgttttggttggtatgtattccatgtatatatcaatcctttctactgtgatttcaaactttagatttaatttatatattaactttaattacattgttatcaatgtagtttaaaaatttattaaaatcatcaccagatatattaaatgtctctgtgtttatagcaggatgaaagttaagattttgaccatctaataaatcactgtctattaatacttctacttcactatttacatcatttataatactgaatggatttacacttccaggtgttaccttcatcagttcatataatttttcgggcgagtcaaatgaaagcctgctacttcctatttgtgctcttatatcttttaaatctactgatttatcatgttttactactactaaatagttttggcttttgttagagttttttagaaacaagtttttacagtgatgtcctggcatgtctttagttacgctataaaattcatctgccgtaaagacttcatcatgttctagtactttgtattttatttgtagttcatctagtttttcatatatttcttttttcattcttttccccccctgctgtattgatataagtctattattacatatatttgattttgattaaagttataaataagctcaataaaaaactcatatatattggatatgagttttttatatttatatacatcaaataacattactaattatattatcccgtataagaaacaataaccccgcaagcccatctagaacctgaatttcctgcaggttgtgtagtaaaatcatcatactcactatgaagtataaaagattttcctataacgtcatttacagtaaatctattagtaaatgtagaaagaactcctattccatcagcagataaaattggtggtaaatctcctgcatgcattggatgatctactttagttagattataatgagattttgcagcagtaaatggatcgctttcatttcctacagtacaatctccaacctcatgaatatggaatccatggaaggaactagtctgattatttatattaggaattcctgttatataagcttttacatatactccatcttctagttggtataagtatactattccccttatacacggagccaaaggtcctccttttattttagcatatgcatttggcttagatgggttataactagaaaatattttattgatatcatatttcttacaagaattatccatgatgtacccccttatgatgttaaaattatagtgctatatatattatgattttaaattcaaaaatgttatcatttgcaatattttgtaatttaaaaagtacactaacaaaattgctaatgtacttttttactttcggtaaccctaattaaaagtatgtaaaaaaatagattaaacatatatgtttaatctatttctctatgtgaatttatataatcttaatcattttcatctaaccatttagttaaaacttctatatatttatcattttcttcaacaaatggcatatgtcttgaatattcaaatagttcccatttactattaggaattctgtcatacatagtttttgcaatatatggtgaacataaatctattgctccactagttattaaacaaggttcttttatttcatttaatctatctgtaaactcatatccagaaagagttcctgtaggagaaaattcattttgtccccatcctacaatgtatgcttcagaccctgattttttaggtcttcttaaacattctggagaaccttcagttaccttacctgcacagtacatttccataaacttatctaatgcatcactatattctttactggaataatctccagtatttactgcatcaagtaaagccttttggtcagcttcatccatatatgaaattcttcttttttgctctttttcccaaagttttgctgaagaaagagtagatgaaagaatatatgacttaatcccctttggtttatgctcaatagcataccaaatagcttgcatacctccccaagattgccctaataaatgaatttcttcaagtcctagatgttttcttagttcaataagttcttttatccaagtgtcagcattaaataattcagggtgaccttctacaaatgagttcccacaaccaatttggtcatacattattacttgtctaccactttttgctactttgtctaatacctcaaagtagttatgtgtagaacctggtcctccgtgaagcagtactaatggtttctttccttctgttgcttcacctactatacggtaataggttttaaaaccttcaaaaggcatgtatccttcagtaattttcatgtttccccctccaatttgacattaggaacattagctccttaataagactattcaaaacttctattccatttcaatatatgctttgatttttatacttccttttataaatagtataccataaaagtaacaaatctccataacaatccaaccattaaattccattaactatctaattttatttttctgatgtccttgaaggttatatatacaaatatgcaatggtttcataatttaaaacttgatttatccacatataatttcataaattttaggtaaaataaaaacacttattaaataagtgtttaatcttcattattatactaaatactttctttattaaatactatccttcaggtgttttttctaagaaactcattttcccaataaattctaagttaaattcattgggaaaataaattcatctttaataactaactctttagcaaaattcattagatttattttttattgttttcaacttcattaaactttgaattcataattaatatatctactcttctgttagttgacttaccttctgctgtactattgtcagcttttggtctatattcgccataacctattgctgataatttttctggttttatatctgcttttttaattaaaatttgtgcgacattactagctctcattactgataaatcccagttagatttatatacttcattatgaacaggaacagagtcggtatgaccttcaacccttatataactgccacttcccatagcttgatttataattttacttatcttaataagtttatcaatttgttctggtcttacttctgccctaccactatcaaagaataaagaatctttaaaactaacaactaatcctcttttttctatagtagtactaacgctattagaaagattattctcttttaaatatttatctaaattttcttttactttttttaattttgcatcttcagataatccgttgcctatttctccacccattttacttccagtgtctgcaatagcactaccatcacccattgcttgatttagcgctgttgtaagcttttcatactttgctttatctatagtactcattgcatacattattataaagaaaatcattaacagcgttataaagtctgcataagaaagtaaccaacgttcatgattttcatgttcttcttcttcttccacatactttttttctttatgcactctttgtaacctccttatttccatctccaaaatatcttgattctaatttaacttgatcttttttatctagaaaacctttaagtgtatctcttaaagtagttggacttacattttcttgaattaatgatatagcttctattataatatctttttctaattgttcagccttagctaaatttttaagtctagttcctattggaagaaatattaagtttgcactaccaagcccataaagtgtagctaagaatgcagctgatatactaccacctaatgcattcatatctgctttagctagtcctccaagaacatgtactaaacctaatacagtaccaacgatacccatagtaggtgctgttcctccagcagagtcaaacatagctgcaccaattttatgtcttttaaaactcattgctgcctcgatttctaacatgtttctaatatcttcaggcttcacaccatcaactgctgattgaagccctttttttataaaaggattcatgttttcatcttcctgtaattcctcttcaagacctaaaaaaccatcttttcttactttacttagcacatgatcaaaataaaaaattagctctactaaatctgttgactttctagtgaaagctacacgtaaaattctccctatattttttatttgtttcatagtgaaagatgtacctaaagaaccaatcgttcctccaaaaacaattacaaacgaagtccatgaaattagtgctgtcgtatgacctccttcacctacaaaacctagtattaaaaaaccgaaacctagtattaaaaaaattaaaccagacataatttattgttcctccttttatttttatatctttttaaagctttgcttttttaatggattaattatactttcggtttttactctcatatattaagtgtttttttaaaatataattgtaaaataaatttaacattacatatcttatatatttaatcttataaattaacatattgtcctactttttttatttaaaaattcatctacagctacggttttaaagtgtagtttaaatgtctcagatttataattcaacgtaataaaacttaaaattacaaaatacaaaatacaatatacatacttaaaaaggtattttcagaatttctgataatttaaaagctcctgtacttaaagatatatgagcttcatattaattaccactaatgataaaattgtgtaattttgatataataatattaaattaaacttaggagatttataaaatgaaagatgaatttaacaataaatatacttctagtaagtatgcatgggatgatgccatgattttagataaagtacaagaaattttagaaggtaaaaacatagatgatttagaatttactgaagaaatgattgaaaatttaaaaactaaattaagtgaaagtgtttcttcggaagaaataaaccaatctgcatatatagttgctcaaaatattgaaaagttaaaagtcttacctcaagaagatataaaagactatatattaagattgaaaaattatttaaataatactactttaaattgtattaaatctgagtttaaaggtattaaatttgaggtttatcgagattcttatgtagaagatgtgtttaaggagtattattctaaatatgatgagatttatggaatatctcagatgctttcagatttagggttaaaataactctatatattatagtatttttaatctcaatcataaaaattcccctctcatttctgaaaggggatatttttattaatatgctgctttaaatatatttattatatcttgtttgttaccttttcttggattactaaatgcatttccatctttaagagccatttcagccatatattcgaaatcttcttcttttattcccatttcttttaatgaagttggtattcctatatctttagataatctaaacattgcatctattgctttttcagctgcttcatgaactgataacccaactatgttttctcccataaattcagctatatctgcaaacttttgtgggttagatattatattgtacttacaaacatgaggtaataacattgcattagcaacaccgtgtggcatatcgtataatccacctaattggtgagccatagcatgaacataacctaagttagcattgttaaacgccataccagctaatagtgatgcgtaagccatatttgttctagcttctaaattctcacccatagcaactgcttgtcttaagttattagatattaattttattgattgtatagcagatgcatctgttacagggttagcatctttagaaacataagcttctactgcatgagttaatgcatccattcctgtagctgcagtaagtcctgctggttttccaatcattaattctggatcattaaaagatactaatggtaagtttctccaacttactataacatatttaaccttagtttttgtattagttataacacagtgtctagtaacttcacttccagttcctgctgttgtatttactgctaatattggaggtaatgcattagttaatgtttctatacctgcatattcatataaatcaccttcatgagttgcagctatacctatacctttaccacagtcatgagaagaacctccacctactgtaactatcatatcacagttttcatctttgaatatttttaaaccatcagctacatttgtatcttttggatttggttcagttccatcgtatataacaacttcaataccttcttgtgttaaatattttatagtttgttcaactgctccattttcttgagttcttaaaaatttatctgtaactattaaaactttctttccacctaacattttagctctttcaccaataacttttaaacatcctggtcccataaagttaacacttggtactaaataatcatacattctgcccattttatattcctccaatttatatatatcaatctaaacatttagctaaagcttcaaatctattgagtctcaattttgtgtgattccttgatttaaggttttcgttttcctcgatataattttaatataattttaactttttttcttatcaaatacatcttaatattttaactttttatgtaaaattttagtctattttaactttaaaaataggatttttttgcagcaaaagtagaaaagaacaaaaaaatcctatttttaaattgcactagtttttttatacatatccctaaatttttttggagttgttccctctaactttttaaatatccttataaaataaccacagtcttcaaatcctaaatctaaagaaatattatttattgctttatcagtatttattaacaattgctttgcttttgctatctttttcatatttaaatattcaataaaattaattcctgtttcctttttaaataatttactaaaatagcattgacttaaattacatataaaagatattttttttaaagttatactttcataaatgttattatcaatatattcaatagctttcataattggagatttctcatcatcttcgttaatcattaaattaacatttttacttacatctactgcttttatatctatacatttactactatctttattttccttttgttcattatcatgttcgtagttaatttcatttaaggacatcttaagtaatgcttcttctactatataattgcttatatgaaacatcatctgtgctatggattttatcttgtcaaaatttaaaataggtagtttactatattctatctcaagttctttttttaatcttttatccaaatttttgaaagtattgtctacttttacaacttcttctaattcaagattataattctccttcactaaaatctgccctgccatcatagctcctaaatattgctccctaactattataggtacagcaaaatctactaaccctttatgacatttatatatatatgcttctttaattctagcagattctactcctcctctagaatcacacttttcacataaagccgaatattcatttatttctctaaccatacagcaaaattttgtacagttgctatgtcttgttattggtttacccttataatctaccattattatagctacatctgtagctttagctatatcatcttgtattttttgaaatgactctatatttattatttcttctaataatattgtatccctcaatataacacgtccttttttaatttttatgttatgttgcattttcattatattgtgatgtatatattttttcaatacataaaactacaaatatctacaataaaattcatactaaacttctatcttcaatagttctatcccgcctaccataaaatcaactatatcttatgttaatttattataattattaaaaataaaaaatgtattgttttttgcaatacattttttgtgtatttcaatgttatatatgattcgcaataatcatacacccaatttatactaaaaatttaaaattagctacatctatagatttaagtaatgatgatatatttaaagaatttttatataagcatataagtaatttttgtataaaaaaagaacttaatataaataataaaagtattatagcaaatgatataaaaatgaagtatccactagcatttgatttagcaaatatagctaaaaccactttagaaaaagaattaaatttagaaatagatgaaaatgaaactgcaaatatagcaatacatataggtggagcactacaaagaacaaattataaagaaaataaaaaaatatcaaaagctataatagtatgtgcatcaggtgttggaacttctatgcttataaaagcaaaacttgaagcaaaatttgataaaagattagaaatactaaaagttataccatcatatttaatagattatattggattattagacgtagattttataatagctactgtacctataaaagttgataatgttcctgtaataaatgtatcaccatttttagatgataaagaaataaagataatagaaaagtttttagatacaggaaaaatatattacaacataaatttatctgaaatatttgatagagatttattttttactgacctagattttgataataaatacgatgtaatagaatatatgtcagaaaagttaattgaaaaaaagtatatagataaagagatgaaaaaatcttatatagaaagagaaaatatagctacaacagaaatcggaaatatggtagcaattcctcatggagcaactggacaagtttataaaaatgctatagcaataggtatacttaaaaaaagcataccatgggaaattggagatgtaagattagttataatgctttgtcttcaaaaggaaagtattataaattatgaagatttattttcaaatatatataaaagaatagattcaatagcaaaagtaataagcatatgtgaatctaaaaaatacgataagtttatagctatgtttaaataactaaataaatataatcgataaatttctcttttaactaagagaaattttttgacttttaggaaaatgtattcaaaggtattataagaatataagataacactaacgaggtgataacatgatttacacagtaacacttaacccatctatagattatgtaataaagttagataatctaaaaaatggtgaagttaatagaacaaaagaggaatacgtatacccagggggtaaaggaataaacgtatcattaatattaaaagaattaggatataaaagtagggcactaggttttgttagtggatttacaggtttatatataaaagacactttaaaaaataaaggattagaagaagattttataaatctagaaaatggatttactagaataaacgttaaagttaaaagtaatgaagaaacagaaataaatggtcaaggaccaaatatagacgatgaatctttaaataaattatatgaaaaacttgatagtctaaaagaaaacgatatattagttttagcaggaagtatacctaaaactctagattcttctctttatgaaaacataatgaaaaggttagaaaataaaaatgtaaaaatagtagtagatgctactaaagatttattaatgaatgtgttaaagcataagccatttttaataaagcctaataatcatgaattagaagaactatttaatgttaagctaaatggaattgatgacataataacttatgctaaaaagcttaaagaaatgggtgctaaaaatgtattagtatctatgggtaaagatggggcattactaataaatgaagatggagaagtttttacaagtaacgtagcaaaaggagaagttaaaaactcagtaggtgcaggagattctatggtagcaggatttatagcaggatacctaaattcaaataattatgaagaagctctaaacttaggagcagctagtggaggagcaacagcattttcaaatgatttagcaacaaaagaagatatatataagttaatcgatgaaataaaaatagaaaggagataaattatgagaatagttgatttaatagataaaagatctataagtcttgacttaaaagcaaaagataaaatggacgctatagataaattagtagatttagtaaataatagtgggaatttaaatgatagattagaatacaaagaagctataatagctcgtgaaaatcaaagtacaacaggtataggggaaggtatagctatacctcatgctaaaactaaagcagttaaaaatgcttgtttaggtgcagcagtttcaaaaaaaggtgtagattatgaatcttttgatggaggtctatcacatttattttttatgatagcagcaccagaaggagctaacaatactcatcttgaagtattatcaagattatcgacaatacttatggacgaagaatttagagaaaaattaatgaatgctaaaaatgtagatgaattcttaaacttaatagattacaaagaaaaagaaaagtttccagaagaagaaaaagaagaggttgtagaagttaaagaaagtagttcttcaaaatatccaacagtactagctgttacagcttgtccaacaggaatagcacatacttttatggcagcagaaagtttaaataaacaagctgaaaaaatgggagttagcataaaggtagaaactaatggttcatctggtgctaaaaatgttttaactaaagaagaaatagaaaatgcaacatgtataatagtagcagctgataaaaaagttgatatggctagatttaacggaaaaaaagttataataactaaagttgctaacggaatacacaaagcagaagagttgataactaaagcacaaaatggagatgcagcaatatacaatcatagtggaaacacagaatcaagtgaagaatcaaatgatgaaacagtacttagaaaagtatacaaacacttaatgaacggtgtatcaaatatgctaccattcgttgtaagtggagggatattaatagcactagcatttttactagataattactctataaacccagcaaactttggttcaaatacaccaatagcagcattttttaagtctataggagacgttgcttttggatttatgttaccagtacttgcaggatacattgcatatagtatagctgatagaccagctttagtagtaggttttgtaggtggtgctatggcaaatgcaagtggttcaggatttttaggagcattacttgcaggtttcttagcaggatatttagtagttggacttaaaaaagtatttagtgtattaccagcttcactagacggtataaaaccagttttattatatcctttatttggtacacttttaataggtattataatgaactttgtgataatacctccagtagcagcaataaacctaggtataactagtttcttaaatggacttggaacgagttctaaattaatacttgggttaatattaggtggtatgatggcaatagacatgggtggaccaataaataaggcagcttatgtatttggggttgcatcacttcagtcaggacaatatgaaataatggcagcagttatggcaggtggtatggtacctcctttagctatagcacttgctacaactttctttaaaaatagatttactaaagaagaacaagaatcaggtaaagttaactatgtaatgggattatcatttattacagaaggtgctataccatttgcagcagcagatcctataaaagttataccagcttgtgttgtaggttcagcagtagcaggagcactaagtatgatgtttaatgtaactttaagagcaccacatggaggaatatttgttgttccagttgttggtcatcctatagcatacttaggagcaatattagtaggttctgtaattggaatgatacttttagcagtacttaaaaaaccaataaatgaataatcatatattaaaaaagaatgtctcgtgaggggcgctcggaataggatataagcaatgcttcatacaagcgataaagctgcttgtaaatgtcgctacagcttatatccaattccttcgctaaaatatgtaggcattcttttttatttttaaaaattattttttaggtaaattttatagtctttttagatttttattatattttctaaaataataaattatcataagtattgcactactaaaagcataaagcatatcttgcatagtatctttaagtccaccagattgagttcccattttaaagaatacatcaagtaagtattcagctatttcacaaactcctgaaactcccattgcaaagaaaaatataacagtaaaaaataataatttgtcaactatacttcttggcattgcaaccattataactttaaatatattccaacatattttaaccgttataaaaccagataaaaagtgaaggcaactatcataaggtttaaaaaaatcatacattctataacaagagcctactaaaaaagatgcaacaataaataaattaccaaatatatataaaggcttatctataactaaaaagtttttaaagtataatttacttaaaataaaagctataactaagctaataaaacttataaaagctttacctttttcacctgtaaataaaaaataaattatagaagctatatatgtaatataaagtaaccacttaaatatattaacttttttattatccataaaaaatacctaccttttaagatttattaagtattatgtgtaaattatgaaaatatattccaatttagaaattagttagaaatgttaaatataagttaaatgaattaaaaaagtgttgcaaaaatcaattaaaagtatataataattgtataaataaataagtgctccttgaaggggagtagctttcgcttttaagcgataatcaatcgtcaatttcggatattaaatcccggttgattagcgagataaaaccttgttagcaagaccttcaagcaaattttacttataataaagtttgcttggaggtctattttatttaaataaaattttatcggaggttaagtatgttttataaaaaaagtatcgatgaaacgctaaatcaattaaagactagtttagatggtttaagctcagacacagcaaaagacttactaacaagacatggatacaatgaactaaaagaaaaggataaaactccaacttggaaattatttttagaaacttttaaagatccactagtaattattttattaatagcagcgttagttcaagcatttttaggagaaggtacagaaagtttaataatatttgcagttataacactaaactctgtattatcagtagttcaaactaaaaaagcagaaggatcacttgaaagtcttaaaaaattatcagttccaaatgcaaaaattataagagatggcataaaggttacaatcccttcaagagatatagttcctggtgatatagtaatattagaagcaggagattatgtaccggcagatggtagagtaatagaatcgcaaaatcttaaagtagtagaaggtatgcttactggagaagcagaaccagtattaaaacatgaagatgtaataaatgaagaagtagcacttggcgatcaaaagaacttagtatttagtggttcaatggtagtttacggaagagctgtatatgtagtaacaaaaactgctatggatacagagatgggtaaaatagcaaatttactagaaaatgcagaaagtaaacaaacaccacttcaagttaaattagacgaatttagtaaaaagctaggtatatggatagtaatattagcggcattaatatttggtgtagaagttattagaggtggagatttagtaaattcatttatgtttgcaatagcaatagcagttgcagcaataccagaagctctatcttcaatagttacaatagttttagcagttggaacaaactctatggctaaaaaacaagctataataagaaagttaccagcagttgaaacactaggttctacaagtgttatatgtacagataaaactggaacattaactcaaaataaaatgactgttgtagatacttatatatacaacccaaaaacagctttagcaaataatgaatatgaagaagttgcagcagcaaaagcaatatcacttcaagaaagttatttaatattaggttgttcactttgtaatgactcagatttgacaaatgaaggtattgaaataggagatcctacagaagtagcacttatgcactacactaacaaaaaaggatttgattacaaagaaataagagaaataaatcctagattaaacgaattaccatttgatagtgatagaaaattaatgtcaactgttaacaaagtagaaaatgaagtagtaatgtttactaaaggagcaccagatgtaatatttagtagatgtaaatatgcattagttggtgatgaagtagttaaagtaaatgatgaaataataaatgaatacaagaaaatgaacgaagatttttcaaataaagctttaagagttttagcatttgcaactaaaaaagttaaggatgaaaactttgtaccttcaattgaagatgaagataatttaacattaatcggacttactgcaatgatagacccaccaagagaagaggtttatgaagcggttgaaaatgcaaaaaaatctggtattaaaactgttatgataacaggagatcataaaacaacagcaaaagcaatagcagcagatataggtatatttgaagaaggcgatatggcacttacaggtagcgaattagatgctttaagtgaagaagaactagataaaaatctagaacacatatcagtatatgcaagagtttcaccagaaaacaaaataagaatagtaaaagcttggcaaaataaaggtaaagtttgtgctatgacaggtgatggagttaatgatgcaccagcactaaaacaagcagatatcggtataggtatgggaagtggaacagaagttgcaaaagatgcatcagatatggtattagtagatgataactttgcaacaatagtaaaagcagtagaagtaggtagaacagtttatacaaatattaaaaaatcaataatgtatttattctcaggaaacttaggaggaataatagctatattatttgcagtatttgcaggacttcctaatccatttacaacaatacaattattatttataaacttagtaacagactcactaccagcaatagcacttggccttgaaaaacctgaaaaaggtgttatgaaaaatcctccaagagataaagatgaaaatatattctcaaaagatgctataagatttgttacaactagaggatttataataggtttagttacaatagctgcacaactaatcggtatgaaacactcagcagaacttggtgtatcaatggcatttgctacacttacattatctaggatacttcaaacatttgcagcaagatcaaattcagaaacagtgtttgaattaggatttaagagcaacaagtatgtattaggtgcagtaatagtatgtttaggaatgttttcattaacattactaccatttatgagagaagtatttacaatgccagatagctttaactttacaaatttaatgatatcacttggtttagcagtaacttctactttattaatggaagctagcaaacttataaaaagaaactaattaaataaattttaataagagtgtagacataatctacactcttaaaatatatataatataaagaaaaaaatttaaggaggaaaatatggataatttagattcagaccccgggggtatactctcgaaattaattctaatagctatactaacagctataaatgctttttttgcatcggcagaaatggcaatagtatcagttaataagtcaaaggtaaaggctttaagtgaggaaggtaataaaaatgcaaaattattatataagcttattaaagagccaagtaatttcttatcaactatacaaataggtataacactagctggatttttctcaagtgcatctgcagctactggtttatcaacttatatagcaaatattttaaggccactaaatataccatatactaatgaaatatcaatggtagttataactataatactttcatatttcacactagtatttggtgagttagttccaaagcgaatagcacttaaaaaatcagaaagtatagcactacattctgtaaaaccaatatattttatatctataatagctaaaccatttataaaaatactttcactatcaacaggacttgtattgaagttaactggaaataatgattctgatatagaagatactgtatcagaagaggaaataaaagcattaatacacaggtctacagaagatggtttaatagatgacgatgaaaaagaaatgttatgtaaggtatttgaatttaatgatagactagcaaaggaaattatgacttcaagaagtgatactttcttaatagatatagatgatgattttaaagatgtattagataaaatactagaattaaattattcaagaataccagtctataaagacgatatagataatattatcggtatattatacgtaagagatttattagcaaaagctagagaagtaggctttgataatataaacatagaaagcatacttcacaaaccatatttcgttccagaaaccaaaagaactaatgatttatttaaggttttaaaagaagctaaaattcatctagcagtattatttgatgagtatggcggattttctggtatagttactatggaagatttagtagaagaaataatgggagacattgaagatgagtatgatatagatgaagatataagtcaaatagatgaagaaaactatatagttaaaggttatttaagtgtaaatgactttaacgatagatttaacatggatatagaacctggagattatgacacattaaatggatatttaataacaactttaggaaagataccaaatgaaaatgaggtagtaatattagaagatgttaaattcacagtagccaaaattgaaaatagaagagttgaagaaattaaagtaagcttattaaattttagtgaaaatttataaacaagttaaatatttagattaaagttttcatataatttataaacatataatttggaggctatatatgtatgaggttatagtaaattcaatatctacacttatactgctttcaccaccgatgtttataaagtatttgataaacaatatgataaatatagttaagtactacatttgtatgacgcatttagtcaaacttcaattggatatacaataaaagagtattgattaaatcaatactctttttacttaaattaataaaatagtatttaaaataaataggaagtgataaaatgctaaaaaatggagctgttatatttttttcaggaacaggaaacacaaagtatgtagctaagctttttaaagaaagattcaacaaagaaaatataaatatagaaattatagatatacaaaagacagaaaagctcaataaagaatatgatttttacatatttggaggaccaattcacgctgaaatggtacctaaaatacttacagattgggtaataaaaaatattccaaatgaacctaaaaaatgtatagtatatcacacattagcaggggataagcatagtccaagtagaatatacttagctaaattacttaagaaaaaaggcttagatgtagttataaatacatctataaaaatgccaaataattattaccatagattttttaaaagggaaaaagatgaagaaattttaaatgtattaaaattagctccaaatagagtagatgaaatagtaaaagattttataaatgacaaaagaagcgatataaattataaaaaaagcacaattgcctttaaaatggtatatgatggatttttaatttatgctagaaaatatgcaaagagaaacttttcagtagatgaaaaaaaatgcataaactgtaagatatgtgaaaatgaatgtccaactaaaaacatatatatgaataataaaaaaatagagttttttaataaatgtatagggtgtgaaaaatgtattcacagatgtcctacaaatgcaattttatatggtaaaaaaccttttattccatataagatagaacaatatataaaaagataaatttataaatgaaatgaaatataaagatataccacacataacaataaatttgttaattatggtatatctttttttatatggtaatatattgctaaatgtctgaaactgtcgaaatttaaatgacaattgtgctaaaatatatatatatattttgtaaaaatataatcactaaaaaaggagggtaatatattgatagttaacagaagagaacttaaatatccaataggtgaaatggattattataaagtaaacgaattgttcaaaaacgtattgacccctgaccctaacaataaagaatacggatatagaataagaagcttatattttgatagtattgataatgatgattattttgcgaagatgaacggagaagaaataagaaagaaaattcgtctaaggatatatgatactaaaacaaattcagtaaaacttgaaataaaaagaaaaatgaatataaatcaaagaaaagaaactactacaataactaaagaagatgctatagcacttataaacaaagattacagcgtattgcttaaatatgataatgatacagctaaatcagcttataatattatgactataggccaatatcagccagtagtacttgtagattacacaagaagagcttatatacacaatgaaaacaatataagagttactttagatagtgatataaaatctaatgaatttgattttgatatgtttagtgaagatgtagtaatgagtccaatagttgattactacaatgcactacttgaggttaaatttgatggagagctattttgttggatatcacaagctttaactggacttgatacaactaatcaatctcttagtaagtattgtagttcaagacgattctttgaaaattatatgttataaggaagtgacagaatgaaagaaacattatataaatatttaacatcccaaagtgggactataactgcaagtagtgcagtagaaacaatgtttatagcactaatactatctatggtagtattttggacatataaaataacttttagtggagtaatgtataacagaaaatttaacgtatcattagttatgataacactagtaactacaatggttatgatagttataggtagtgatatagcactatctttaggtatggttggggctttatccatagttcgttttagaacagctataaaagacccaagggatactggatatatattttggtgtatagtaatagggcttagtgtaggtagtgcaaactatatgatagcaatagttggttcgctatttttattcttcgtacttcttatgtttagctttagtggatttggaaaagaagatagatatattcttattataaggggattaagagataaagaagaagagataatgagatgtgtatttagctcttttaaaggaagtcaattaagagctaaaaactctgtaggaaataatatggaaataatttatcaaataaaaataaaaaacaatcaagataaaaatataataaatgacttatacaacatagaaggtgtaaatacggtaaacatagtagcacaaaacggagaaactataggttaggtgatactttatgataaaagatatatttagaagtcttgtagcagttatgtttttatttttagcattagtagttgtagcgtattcaagcaaccaaaaagaattattaaaaaaagaacataaaaaagtaaatccacttacaaattactacgaaggcaacttactaaataaaaattataatcttccaatagtagttatagatacaaataaaaatactattaaaaaaggtgaagaaactactggaaagattcaaatatatgataataaaaatgggttaaataatttaaaaatggaacctcaaactgtaagttatgctagctttaaagtaaggggaaacagtactagtaagtatcctaaaaagcagtttagtataaaacttttaaataaaaaaggcaaagaaaaagaagaaagtattttaggaatgccaaaagatgctagttgggttttaaatgcaccttttgcagataaatcgcttatgagaaattatataaccttaaatgcttcaagtcatataatgggatatgcccctaaggtaagattttgtgaagtatttgtattagatgatggtagtaataatataaaaaaagaagactaccaaggtgtttatatgatgattgaaaaaatcaacaggggagaagatagagtagatataactaaaacattagaaaatagagatgaaacaagctttatacttgcaaaagatagacaaaaacctggagatataccaatagacacatatggaaaagaaacatatatctacaataatggtattaatatagaatatcctaaaaaggatttaacacctaaaaaatatgaatatattcaaaactatataaatgaatttgaaagaatgctttactcagataagtttaatgacccacttgtaggatatgaaaaatatattgatacaaattcattcgtagacttttacattataaatgagtttttcaaaaatacagatgcaggaatatatagtacttatttttataaggattacaatgacaaaatgaaagcaggaccagtatgggactttaaccaatcactaggaaaccatacagaagatattggtgatccatttgaatacgaaggcttttttatgaatcaaagaccttggtttgataaattaatggaagataaaaagtttgctgacaaagtagttagaagatataaggaattaagaaaaacttacttaagtgataaatacttaatagaagaaatagataaagctacaaatatattaggagattcagttgatagaaactttagtaaatggcctataagcctagctaatcaagcttcggtatttgaagaaaatgagtcgatatcaagagaatattcttctgatagtagtaaatacaaagacttccttgaaaaaaataaacacttaataaaatctacccacggtaaagctaaatcttatgataaagaaatagatttaatgaaaaaatttattataaatagaggcaagtggatggatcaaaatatagatagtcttagtaaatgggcaagttaataggagtgaaatgatatgaagagatttttagctatttgtatagtaatatttatattaattataaattcaataggaaatagtatttcaaataaatctacaccagatgataacacctactttactaagacccaaggaaaagatatctatatagttaaaaataatgagtgggaaaagttagaaatagtaggagtagatttaaactcaactaaacccggagcgtttccaaatgaaaataaagtagctgaagaagaatataaaagatggataaaagatatctatgatatgggagcaaactgtataaaggttccaaatttaatgaatgaaaacttttatagtgctttagaagagtttaacaaagataaagaaactcctatatatttaatgcaaggtatatactttaatgaaactttactaaaaaacggacaagaccctcaaggtaaaaaaataaaagtatcttttaaagataatataaagactgttatagattctgtacatggaaatccatataaccttaataaacaagatatatttcaaggatatacaactgatgtttcaaagtatgtaataggatataccttaggtatagagtttgcaaagcatgacttaatatacacagaacttatgaataagaaggttccatataacggtaaatatttatatacaaatgataaggcatcctcatttgaatcttatatggcaaaaatgggagattatgcagtaagctatgaatttaaaacttataaaaagcaaagtttaataagttttataggatcagctgcccattatatatcaagtagtagtacaaatagtattaataaaagtatattatcaactaaagacactacagatcatggtataaaagattattttaatgttgagaatataaaatctaaaagatcattaaaaactggtgtaatagctacttacaatatatatccatcatacacagatgtaaaagaatatcaagataatattggtgagtattttaaaaagataagagattatcataaaatacctgtaataataggcgaatttggaataccttctagtagatctggaggagattttaataaggatataaataaaggctatataactgaaaaggaacaaggggaagctttggtagaagtatataaagctataaaatcatcagggatagcgggttgttttatatttgagtttcaagatagttggtacgcatcatcatggaacacaagagattctaagatattagatagatcagcttactggagtgatgcacaaacttatagccaaaactttgggcttatgacatttgaaccagggaagttaaaaactacaccttatccagatgatagtttaaatgattgggaagaaaaagatgttgtaagtaaaaacaatgatttaagcttatctttaaaaagtgatgaaaaatatttatatttcatgattaaatcaaaaaataaaatagacttaaaaaaagatgatatatatatagacttagatacaacacctaaatcaggatcaactaaaagtacacagtataacttaaactttaataatcctgtagattttattataagaataaatgatttaaataattccatggtggcagttcatgaatattataatggatttaatttttatgaaaataaaactttatatgagcaaagaccggacttaatggatcatacgccaaatatggattatttttcacctatatttatagcaacaagacctaaaatgtatgttgagtctttaaaacaaacacaagaaaaattaacttatgaaactggaaaactagttaaaggaaacgcaaatccaaatagcaaagactttaactcggttgcggattattatataggagataactatgtagaagttcgtataccatgggggcttttaaattttatggatccttcaactaaacaaatagaagatgatttttacaaagaatttaaaaccaagcctttaaagatagatgatataaaggttggagttacactaaaagaagaagagaaaacattaagtagattaaatagtgtaacttataatttagatggatggatgatgcctaaataccatgagagattaaaacaatcttactatatagtaaaagatgagttaaataaaaaataaagagggaaatattatgaaaaatatagctaatatatatataatattaagctttttcatgtatataagtttctgttctattatgtatatgatagtgaaaaataggattaatctcagatttaataaaaagttagaaaaaataagaccagcatttaaagctgaggttttaaaacaactaaattatgtaaaatctaatgaagctatatctaaaatggatatagcttatattagagaaaaattaaacaaaaaatcttacaatagagtttttaatgataccttagaggaatttaataaagataaagaaaatcataaatacacaaaaatatacatggaaaactttgaagatattattataaaaagtatcaaaaagtacaaaagaaaagataaaacactaaaagcttatttagctaaacttcttggagagtatagaattagtaattatgaaataagtgaatttttacttagttgcttaaatactaattctatgtatttaagagttttgtccttagaatcaatagctaaaataggaaatataaagacctttggaagtgcaattgagtatatttctaaggaaggcaaatatacaaataataaagtttttacagatatattaaatcaatttggggatgaaaagttttccttagacaaatatttaatatctaagtttgaaacatttaatgaagatgtacaaaaggtaatcgtggatcattttaaaaataataaaaccgagtttgctaaatacaaattactaaattatttagataaagatataagcaaagaagtaaatataagcataataagatatttttctagtataaagtatgaaaaagctaaagataaaataatagaacttttaaacagtaaagactgggaatatagagccgtttgtgcaactgctcttaaaaattacaaatgcgaagaaagtaaaaatgcattagtaaaaagtataaaggataaagactggtacgtaagatataattcagcgatgactatacttaggtttgctgattacaacttaatatatgatttattattagaaagtgatgaatatgtaaaagacatacttttttatgccatgtttgtaaacaataagatatcttatgatgaatatctaagaagatcaggaaaggcagaggtacaatatcaatgttaaaattaataatagactatatgaatatgttttttatgtactatgtattgatatatgccatattgtttttcatatctactatatttgctgtattagaattaaatgaagaaaaacgtagaaaacaatacttaaatgagctatctctaaaaagtgatgacaactatatacctgtatctatattagtacctgcatacaatgaagaaaagatgatcattgactgtataaaatcactgtcatatttagattacccggaatatgaaataatagtaatagatgatggttctaaggataatacatctaaagttgtaatagaggattttaatttaaaaagagtcccaagacctataaggactctagtaaaatgtaaaaaagaagagtatatatatgaaggtacaataaacgataaaataaagcttacattagtaagaaaagaaaatggagggaaagctgatgcactaaacatgggcatcaatatatctaaatatccattatttacatcactagatgcagactccattcttcaaaccgattcgttaagtaatattgtaatgccatttatggaagatgatacgacaattgctgttggaggaaatataaaggttgctaatcaagttgttttagataaaggtaagataataaaagtattacctccaaaaaaatttattacaatatttcaaactattgaatactatagagtatttttgactactagagtttggttcaatagttttaatggaaatttaataatatctggagcttttggactttttaagaaaaattcagttttaaatataggaggatacgatacagatacagttggagaagatatggaccttgtagtaaaactacattctttttatagaaaaaatcgaataccttacaatataaaatacgaacatgaagctatatgttggtcacaagtaccagaaaccttaaaggatttaagcggacaaagaaggcgttggcatataggacttattacaagtttgaaaaatcataaatatatatttttaaatcctaagtatgggatagtcggtatattttcctttttatactttgtagtgtatgaactattctcttgtattatagatgtatttgggttgattttaatacttgtatcttattttgcgggacttcttaatatggagtttttagttgttttcttaatagtatacattttttatagtgttataatatctataacatcaataattctagaaaattatatttttaaacatataccaagtttagctacattactaaaattaatgctttttgcagtacttgaaagctttggatacaggcagttatgttcttggtatagaataactggttttataggctataaaaaaagaaagaatcaatggagcaaaataagtagaaaaaaacaaaatagagttaactatataaataaagataagaaaaaataaaagtcaataaatataaatgaaataaaattaccatattcagaaaatttatttggtaaaattatgaaataaattttctgaatatcattaaatctcaaattaaacacaccaaaataaggacaaatcattctttttttctataaaaaatccataaaaataaaaaatatattaaaataaaatgaaaatttattgcaatggataacgttttcgtgtattataaaaatataaacaaagaaaataaatttcaaaaagggtgggagaaaataaatgctagatattataaaagataaattaatagtatcttgtcaagctctagaagatgaaccactacatagttctttcataatgggtaaaatggcaaatgcggctaaaatagggggtgcagttgctataagagcacaaggagtagaagatattatagaaataaaaaaagtaacgagtttaccagtaataggaattataaaaagaaattatgaggattcaccaatatatataacaccaacaaaaaaagaaatagatgaactattaaatacaaaatgtgaaatgatagcaatagatgctacaaatagaaatagaccaaataatgaaaatctaaaagaacttataaattacataaaatcaaataatgtattagttatggcagatatatcaaattatgaagaagcaattaaagcttatgaatatggagtagactgtatatcgactactttatcaggatacacaccatatacaaaaaaattagaaggaccagattttgatttaatagaaaaattagtaaaagaactagatatacctataatagcagaaggaagaataaatactcctgaagaattggctaaagcatttagtataggggcatattcagcagtagtaggttcagctattacaagaccgcaacttataacagaaaagtttacaaaagcaatagctaaaaattaaaaatattaaaaatcaaaataaaatatgggaggataagaacatgaaagggatttactcagctttattagtatcatttgatgaaaatggaaacataaacgaaaagggattaagacaaatagtaagacacaatatagacgtttgtaaggtagatggtctatatgtaggtggttcaacaggtgaaaactttatgttatcaactgatgaaaagaaaagaatatttgaaatagctaaagatgaagctaaaaacgatattaaattaatagcacaagtaggatcagttaacttaaaagaagcagttgaacttgctaaatttgctacagaattaggatatgattcattaagtgctgttacacctttttattataaatttgattttgaggagatcaaacactactatgaaacaatagtaaattcagtagataataaaatgataatatattctataccatttttaactggtgtaaatatgagtttagatcagtttgctgagttatttgaaaatgaaaaaataataggggttaaatttacagcagcagatttttatttactagaaagaatgagaaagagattccctgataagttaatatatgcaggatttgatgaaatgatgttaccagcagttgttttaggagtagatggtgctataggttcaacatttaacgtaaatggtgttagagctaagcaaatatttgaactagctaaaaataataaaatagaggaagctagagaaatacaacacataacaaatgatttaataactgatatattaggaaatggattatatcaaactataaaattaatacttgaagaacaaggggtagaagcaggatattgtagacaacctatgaaagaagcaactgaagaaatgaaacaaaaagctaaagaaatgtataataaatattttgtaaaagaattagataaagtaaatgcttagtgtttaacaatattaataatgggctatcaattaaattttgatagtcctaaatataagggggacatgaatatggtaggatttacaggcatcgattttgcagtactagcaatttatctattagcagtgttactagctggactattcttctcaaagaaggaaatgaagggaaaagagttcttcaaaggtgatggaactattccttggtgggtaacttcagtatccatatttgctacattactaagtccaatatcttttttatcacttgcaggtaactcatatggtggaacttggatattatggtttgcacaacttggaatgtttatagcaatacctttaacaataagatatttcttaccattatatgcaagacttgatttagatacagcatatcaatacttagaaataagatataaaagtaaaggtcttagggttttaggagctttaatgtttataatataccaaataggccgtatgtcaatcatcatgtacttgccatcagtagttttagcagatcttacaggaatttcagtaaatgtacttataatagtaatgggagtaattgcaataatttattcatatacaggtggtttaaaatcagttttatggacagattttatacaaggagttgtacttatagtaggggttacaggaacattattcttcttaattagtaatattaatggaggatttggggaagttatgtcaactcttacaaacggagaaaaattcttagctaataatgaagtgatgtttaatccaaatatattatcaacaagtgcctttataatatttgtaggtgctggatttaatacattctcatcatatatatcaagtcaagatatagttcaaagatttacaactacaacagatataaaacaattaaagaaaatgacttatggaaacggaatactatctatgggacttgcaacagtattttatttaataggaacttgtttatttgtattttacactcaaaacccagaattagcacaaacagttaaacaagaccaaatatttgcttcatatatagcataccaattaccagtaggtattacaggtatattattagcagcaatatatgcagcaagtcaatcaacattatcaacaggattaaactcagttgcaacaagttggacattagatatccaaacaatgatatctaaagatatgagctttgaaagacaaactaaaatagctcaatatatatctttaggagtaggtattgtagctataggagtttctataatacttgcaaatggggaaataaagtcagcatatgaatggtttaatagttttatgggattagtacttggagttttagctggaatatttgttcttggagcatttagtaaaaaagctactaaattaggtgcatatgtaggatttatagtatcagctatacttgtagtatatttaaagtacaatgtaccagaggtaacttcttgggcatactcactaataacaataactacatctgtggttgttggtcaaatagttagtttagttcaaataaaagtaagcaatgtaaaagaacaggttacagaagaagcaacagtacactatgaagcttaggaggaaataatatgatatttggaaatataaatcatgtaaaaacctattcaaatttgaataaagatataatgaaatgttttgaatatgcaaaagataacaaccttttagattatgataaaggaagctatgaaattgatggtaaggatatatttgtaaatatagtagaatacgaaacttgtaaaagagaagatagattttgggaagctcataaaaagtatatagatattcatcttatgttagatggatgtgaaagaatagatttaaactttatagagaacttaaatcaaaaggaatatgaagaagaaagagattttctacctcttgaaggtaaaaataattcatacgttgatttagacaaaggagattttcttatttgttttccagaagatgctcatatgacagcaatagaagttgataaaccacaaaatataaagaaagctatctttaaagtaataattagataggtaaaaaaggagaatagttttctattctccttaattttttaggaggatatatgcaaaatatagatgtatttttattaataggtcaaagtaatgcaaggggagttggagataaagatgatagtgaaatcccaaatgaaaactgctttgagtatttaggtaataatgaaattataaaaatgagatgtgaacttgaaaaatctgaaggatgtggaactatagcacctgctttttctaatagatggaatgaagttacaaaaaataaagtgtgctttattcatgaagctaaagatggatcaagaataaaaaattggaatcatgatgcaaataagtttttagatgatgctataattaaatttaacaaaggtgttaagttaataagtgaaaaatatgaaataaaaaacaaatatgtaatatggatacaaggagaaagtgatgcaaaatacggaagtgacccaatatattacaaagaaaatttaaaagatattgccaatagattaaaagatgaatgtaatattgataaaatgtttgtaagtttaacaggttattggctaggtcacaaagattactttactagaacaaaaaaaatagcagcagctcaatttatagcatgtaaagagtgtgatattttaagcttaggaagtaatagagcaatgacttttcatgatgaaaatctaactatagatgatgttcattactctcaaataggtttaaatatattaggaagagatttaagtgataatattttaaaatacaatgataataaaaaagatatagaattaaaagatactatagacttagaaaaatacagagaatatatatataaattagaaaaattacaaaatgattacatataaatttaacgacaattgggggaattaacatgaaaaactttatttgcatagatgtaggaggaacatctataaaatattcagttataaaagaagatggaaatataataactaaaaatagtatgcctacagaagctattcaaaaaggtggaactggaatacttaaaaagataaaatcaataataagagaatataaaaaagaatatgagataagtggaattgcaatatctacggcaggaatagtagattcaaaagaaggtaaaatattatatgcacttgaggatttaataccaaattatactggaattgaaataaaaaaagaagttgaaagagaatttaatatattgtgtgaagttgaaaatgatgtaaattgtgcaggacttggagagatgtggctaggagctggaaaaggatctaactcttcagtgtgcttaactattggaactggaattggaggttgtataataatagataacaaactaataccaggttttagcaatagtgcaggagaagttggatatataaatataaatggaaaaagttttcaagatagagcatctactagtagcttaattaagaggatagcaaagaaaaagaacatgaactatatggatttaaatggtaaaatagtatttgaattagcaaaagaaaatgacaaagattgtttagaagaaatagataacatggtaaaagatttagcaattggaatatcaaatatatgttatataataaatcctcaagtagtaatactaggtggaggaataatggcacaagaagaatttttaaagcctaaaatagaaaaagaacttaaaaatacattaatagaaagtatatataaaaatacgaaattagagtttgcaaaacaaaaaaatgatgcaggtatgttaggtgcattatacaactttttacaaaaaagggataaggtagaatgatattatgaatatattagaaaaattagaaacaccagattttaaagccacaaaatcggataaactacttatagattatataaaaaataatttagataacttttcttataagcctatttcacaaatagcaaaagaaagtaacctaggagaatcaactataacaaggtttgcaagaaagatgggattttcaagtcttcaagattttaaagtaactcttactaaagaagtatctacaattagtaataaaaaagaaaatattataaataataatatagagaatgatgaaccagtttctgaaacagctaagaagttattaagttcaaatataaatatactaagtaaaactgtagatataatacaaaatgaagatatatgtaaatgtgcagatttaataattaatgctagaagaatatattttataggaattggatattcaggaataatagcacaggattctaattacaaatttatgagaataggtttaaattgtagtagttttgatagtagccatactatgataatgatggcatctattatggaaaaaggtgatttagtaatagctatatctcactcaggtgagacgaaagaaattataaaagctgttaatatggctaaagaaaataatgtagatgtaatttctataacagaaaataaagaatcaaatttaaaaagtatatcagatgtcaatttaggttatatatctcaagaaactttacttgaaactggatctatatcatctaagttagctcagttttttataatagatcttgtatatacacaagtagttaaacaaaaattcaaagaatcactagaaagaaaagtaaagacaactaaagctataaaacttctttaattagagaattttaaagtaaaatgtaacaaatttgtgtcaaaattatctacagtatgtatttatatagaaaattatgctaatatatacacttagtacaaaaatatgaccgttttcgacaaaaaaataaaatactaggtggtgacaatttgaaaaataaaaacattaaaataatttttagcatacttttaattttggttgtaggaattacaattaagactttaaacactcaaaatactcaaagtgaaaaaacattacgcaaaagatttaaagatcatgttgtattttaccctcaacatcaagatgatgaaattttatggggtgtgagtgctatttcagacgcagtaaaacaatgtggtgctaataatgtatatgttgtactagtttcagatggatcaggcgttaatgtttttaatcaaatacctagatttaaaggtataactagaaaagaaaaagaaattcttagaaacaatgaatttaaagctgctttacatgaattaggtgttaaagacagtaatatagtaatacttgcagatgaagctgaaaaaccaggtactcattatgaccttatggaaaaaactatattaaaatttgaaaaagaactaggagatgttactcaagtagcccatcactatagatatgataatcatataatgcatagaaaaaatggtcaagttctaaaaaagcttagtgatgaacataaagtagcagatgctagatattttatcaaacctgaatatttagaatatatacctaaagacaaaagagatatttacaaatcagagactaaagaagaaaaagataagtctaaaaaagctattgatcaatacaaaattgtaaatgaaaaagagcaaagatttggaataggatatacttcaactcacagatactttgatcatttatacagtgatcctaattatacatctgtactaagcttttattaataaaatttaataaaaataaaaaatatttaaaaagctatcttaaaaatagtaaaaataaactaaaaggtagaatgtatacattgatatcatctgcttttgaatacctttttactattaaaaaataagatagctttttttattgttttaagtaaaaaatctttaatttagaggagataaataaggacttcgatttgcaaaagaaacaactctatgttacaatcaagttgcttcaagaaaaaacttaatgcattaacaaagttgttactttgatttgaaaatataaataataaaataggaggaataatatgaaaaataatatcgtatttaaaatatcattagtactgaccagtatggtggtgatatttggattaatatcaccagacatgtttaaagaagtatcaaataaaggatttaatttaatagtaagcaattttaactgggtatacttattagtaatgcttgcattagtaatatttgcagtatttttagcttttagtaaatatggaaacataagacttggtaaagatacagatagaccggaatttagtaatttatcatggttttcaatgttatttggagcaggaatgggaataggattagtattttttggtgcagtagagccattaaaacatatggtatcacctataggattaacgcctggaagtcaagagtctataaattttgcaatgcaacaatcatttatgcactggggattaactccatgggcagcatatgcaataatgggattatcacttgcgtattttcagtttagaaaagatgcaccagggcttataagtagtgtgtttttatctatattaggagaagaaggagtaaaaggtaaaataggtaagacaatagatatattagcggtatttacaactgtaacaggaatagcaacatctctaggtatggggacaatgcaaatagcaggtgggcttgagtatatgtttggtataaaaaatactatatatgtacaaatgcttataatagctatagcaacaatactatacatcaaaagttcaactagtggtttagataaaggaataaaactactatctaatataaacttaactttagcattttcacttttattaggagccataataataggaccaactatggatatggtatcaaacttatcaaacggaataggattatacttagaaaattttatatctcaaagtttatatattgaccaatcaggtaaatgggtagcacagtggagagtattttactgggcaatgtggatagcatggataccatttgttggaatatttatagcgagaatatcaaaaggtagaacaataagagaatttataataggagtaacactagctccagcattagcttgtataatatggtttgctgtatttggaacattaggaatgaatttaggattagactttgcaaaagatgcaacaatggtaacggaaacagcattatttaaagtctttttaaattatccatttggtaaaatactatcagtagtagctatgattttactatgtacattcttcgtatcatctgcagattcagcaacatatgtacttggaatgtttacctctgatggagatttaaacccaagcaataaaaagaaaataatatggggagttatacaagctctattagcagtagtgttattaatatcaggagggttagaaacattacaaacagtatctatagtatcagcttttccttttgcaataataatgctaataagtatagtttctataacaaaagcattaaaagaagaagttaaattagaagaagaaaaagctaaaataattaaaaaagcaatagataaagaatatagagttgaaaaaaaatataaacaacctataataccaagaaaaaaagaagtttattaatataaaaagagtatcttaaatttaagatactctttttgtttattaaatttataaaaatattattttttaacttttttctcaaagactaagtcaaattcatttatctttccattaagttcaaaatcacttggaatagcactaacaaatctccaaccttctctactatacttatctattaattctctatggtcagagattctaaaaactgaactagcctttgacttaacataaatgtatgtatacataaaaaatatcccccccttttttcttatatattttgaaattaagtagttattaaagtaactttttaatcaatctttatattcttcatctccatataaaaacattggaacagaagtatgtatattaacatctccaataaccataagaacatcattttctataaactcaatataaggtccaggagaaagtataagttcaccattacgtttaactgcaactatagtaccaccagtattttgccaaaaattagtttgcccagcagtcataccaatatacttacaattagattttatttcaaattcaaaaggaactagtggattgatggtagataatctacttgaataatctactatcttgttcatagtttctaatatttgagcttctaacttagctctactgttaagaagaaaagataaatcagacctgtaagaagatatattagttatattttggtatttttttaaaaaagactcagcattactagaagataaaacaattataccttttcctttaatgctttgaacaacttgaatatcctcaagaagttttacagaacgtctaatagtttcaggtgaaacattatatttagcagcaagagctgaacgaccacgaagtgtagtgccttcagctatattcccaacatatatattattagctatatcaagagcaattttttgatatataggcatagtatgtgatttttccataattcctccaaaaaatttcaataaatatattaaaatatttaaatattttatttttactttaaataggtgtttacactaatttaacaaatattatctaatgaatattatatcactaaaaaaggaaatataaataagattatgatatataaaggaggtttttgtatggaaaataaaaaacattttttagatggaagtttagaagagtacaatgataatgttgtacctaaaataccagtatttgaaggtgaagatataacatctgaagtttacttttttaaaccttttcaagtattaaaagctcatagacatccacatggagagcaaatatttttcttttttaaaggcagtggaaaaatgactgtggaagatgatgttactgatgttactgtaggaaatagcgtatttgtaaaggctgggcaatggcatgaaataactaatggagatagtgaaatgattgcagttcaagtaactaaagtaggtgctggagcagagtataaagaaaattaaaaattaaaataaaaactacttaaaaccaaaattttaagtagtttttatttatataaattgcatcttctatgttcaagtaaaggaagttcctttcttaaattatttatatattcaaagtctatataacaaacaaaataaccttcatcaccatttaacttattaataatgtctccccaaggtgaaacagctatagaatttccataggatatatacgtatcattgtagtttgtagaaggagcacagcctatagtataaacctgattatcaacagccctacatctaaataataattcccaatgagaaggacctgttttcatattaaaagcagcaggaaccatgatagctttagcaccactgtctaccatcatacgaaatatttcaggaaatcttaaatcatagcaaatacataaaccaaatcttccaaattcagtatcaaatacagttatattttcacctggactaacagtattagattcatttacataagtatctcctatttgcatatcaaatagatgtatttttctatgctttccaatcaagtctccatttctatcaaatacataagaagtattataaatttttccatctaaatcaatctcaggcatagatccagcaactaaatatatgttattaacttttgctaaattagataagtatctataagtatttccaccttcaggttcagcatataaaggaaatttacttgtaacataaggacagcaaaacatttcaggtaataaaaccatatctacatcttcttttaaggcattatgtaaaatactatttaaagttttgatatttgtagattttttatcttctatatgcatttgtataacagctaatttacatttactcatataaatcccccttaaaataatcattaatataatattaatataacttaataattaaaactataataatgatataatataaattaaattctatgtagaaagaaggaaaaaatttgagtgaattattaataaatctaaattcagatataaaaagatgtgaagaagtcttaagaatgaacaattacttagaaatagttgtagtaaattagcaaaaactacaaaaagaagattagaaggatgtgacccttcttttaaaaatgattgtggatgcaaaaaagaaaaaaacaaaaaatatacaaatcaatttaagtaaaacatttagatacaataatttaaatctatataaaatactacttatagcttaataccttaagtagtattttatttttctaaattttctttttattaattgataattttttcatgtattgttatactcataatataaataatatttattactgaaaatttttatctttataaaaaatatattgttaataatatatctttatcttaaaattttaactaataattgacctatcttattttgctataataaagttctttaagtttatccttattatttttaattatatattgggaggaattttatatggttttaagaaaaaaacttgctttattatttactttgtcttcagttggagctttgtctttagttggatgctctagcactgattcatctcaaggaaagacaaactcttctaactctatagacccttatactctacttgcaaatgaaaatgcaagaaaagctattgttatgtctgtagacacatctcaaattgcagatattatatttaataatggatctaaagcaatttctttcgtaaccccagaaaatttagcttttactaaaaatggtaaggactatagagaaatagctggcgatatgggttataaaccaaatgataatgaagctaaaaaagcttgggaaaaagcaaaagaagaattaaactttgatactgttacacttgaattattgacttatgaacatgagcttgatcgaaaacttgctgaatttatacaagcagaacttaaagataatttagagggattagaccttaagataaaacaacaacctttaaaacaaaaattagagttagctataaagggtgattaccatataaacttagatggatgggctgcagattatcctgacccgttaactttccttgaactatttactacagatggaatgtatgctaaaagattatcttactcaaattctgattatgataaattaataaatgaagctaagttagctactactcctgaagaaagtttttctaagtttggagaagctgaaaaattatttttaaatagcgctcatgtatcaccactttatcaagtgggtggttctttccttcaaaaatctaatgttaaagatatagttagatatacttacggttctccagcttcatataaatgggcagatatcgataaggctaataaagaattaaatctagttttaggtggtgacattcctacacttaatgtcagtaaagcatctgatatggattctttctacatgctaacaaataccatggaaggtcttacaagagttgatgcaaaaggtgtagctactcctgctatggctgaaagctgggaacaatcagaagatggtaagacttggactttcaaaataagaaaagatgctaaatggtctaacggagatccagttactgcacacgactttgaatattcttggaagagaactttaaatcctgaaacagcttctcaatatggatacgttatgtatgatatagaaggtgctagtgattataatagtggaaaaactgataatgctgataatgttggtgtaaaagccttagatgacaatacattagaagttaaattaaatagacgtattaattactttgaccaacttatgtcattttgtgtgttcttccctcaaaatcaaaaatttgtagaatctcaaggagataaaattggtactacagctgaaaatacaatttataatggtccatttacaatgactgattggaaaatggatgatcttgttgttttaagtaaaaatgataattattgggataaagataatgttaagttaaataaaatcaactttaaagttgttaaagatccaaatgctgcaattaacttatatgaatctaatgaaatagacgtagttggattatcatctgaaaatgttgataaatataaagattccaaagaatttatgactactaaaaaagcggaaacttatttcttaatgcttaataataaaggttctaaataaaatttttatgtaaatttgtaaaatttgtttagaaatctaatttttagggtattataattacgatagcttgtcttaaataaaaattttaattcttgcctatgagatttttatttgaaataaaaaaggagcttcttagtcgatcgaaatatctaagaaattgctccttttttattttatgctcaaattttttttaattaaaatttttttgtaataattatacattttcaacgttatattcaatgtctaatttctctttatatccatttacaagtgaatctaatgcttgttttatttcatattcgctaggtaatattacatatcgtctggcatctaatataaatttactttctttattaactatattgacactagaaattttcttatttacactacccttcatatctaaaagtagttgtgaaaattctcccttagttatattttttaatattatataaatttccttttctgtaagcaagttctcataagaaactctttctacttcctcattaaacatttgcattacttctttatttgtattttttatgtacttattaagtataactctagatcctttataagctcctaatgctcctaatgctatacaaactatatttagtataagatatataactgaattatttattagcttaccatattgagtaattacacataatataaaaaatgctaaagctccacctaaaaatcctaaagctaatttaacattgtttattttatcataattttttttatcttctaagtaaaactcttcatctatagcatgatctctatatttatataaatctatattaatcgaactatttgttgagtgtagattatttgcaaatctaatgtattcacttttatctactgtattatctaaatctaagctatgaataaattcttctccaaaaacttttatacttcttgttatagatttttttagtgcatcttctttagaatcaccattccatatagaaagagcatattctatacttccagacattcctaagatatgttctgtttctacgcttccatctatctcaaaaaaatctattccttttactttcccttcattagctataattttagcttgattatatgtaaatctacctcttttaaatattttttttggctctaatgttgattgagtcataccttcttttattcgatcttcaaaatcccctatagcctcatcgtatttatctattggaatttcaatattaataggacttccatctccatttataaaccttaattcaccataatttaagcaagaatctacacatcgttctccactactgttatatttactttttagtatctttgtcatatataattttcacccttcgcaaatgaactttgatttttctatggttttcactaatttactatatcaaaatctactaattattttaactaaaaaattttttatataatatttaaactttttaattattaatctttatttcaaatatatctattataattagtgccatttcgttaaatcaaatatatctattaaaatcatttttgttttattaaaaactcctgtaattttaagaggtatagctaaaactcttgaaaagtttgataacatagatttctagcttttctatttataaatttattatttgcattttttattattacttgttattgtcaattatctattctataacaagccctcttttactttttataagtccaattttaaacttaaattttttattgtatctctactaaatttaataagttttttagctttaaacactcaaactatatatatacaatataaatccttttaataaaggatttatattgtattcaatttgttaagagtttggacttattatattcataaattcttgaaagctagattactctattttcctaacttttcaagttgtattctctatttttagttcatagtttatgtatatagtaattacaaaaatcttcagatataacagataaaaatatcatattctcagtaaattacctttgagacttttaaaatcataatctcttataaatttttcccataatatttgcctcttatttttaattatctactttgaagattatttgctattgaccacatttcatctactgcttgcatacccttactattatattgaaatgctctttgagccagtatcaaatctaccatttcactttgcatatttacatttgacatttctacataaccctgtaaaatctttttattttgtacagtttcaacttgtgattggtctgctgtaaataaactatctcctatagatgtaaagtcagcatcacctttagatgtatataattgtatatcccctactttatttttatctaaatatacttccccaaatttatttatactcaaatttccattttttaaatcaagattttttaaatttccgttaatagtttgtatatctagtacatttccattatcatctactaattttcctgcagcatctaaattaaactcaccatttctagtatacgcataacttccatcacttcttataactctaaaaaatccttctccatctatagcaagattagtatttattttagtttcttttattgctccttgagaataatttctagttacttgagatgctctagagcctgtacctgttattgcatctttagagtttgttggataagatcttttgtttaatgattctttatataaatctaaaaaacttacctctaattttttatatccaacagtttgtacatttgttatattattagatattgtatctatattagattgacttgataacatacccgacttactattatgcattatattatacatttttttacctaccttacatttcctatttcactggcaatttgtctaagtgtagaatctatagtttgtataactctttggtttgcttcaaactcttttatagtttccatagactctgccatagtacttatataatctacatttgacccttctacaaacccttgttttacagaataattattagtatttattggattagctcctgaatataaattatctccaacctttttaagacttttatagtcattaaaatccataatattaaagttataactatttccaccatctataattaattcatttgaaggtgttaatgtcattttgcctcttccaacatatataggttcaatattttgattcgatttatttatacccatgacattatgtccaccatttgttactaaatatccttgagaattaactttaaaagatccatctctagaataaaatatatttccaccagaatctcttacttggaaaaaaccacttccatttaaagcaaaatctgaattattttctgttgagataaaagtaccttgtttaaaattagtacttacttcatctattttagttccaaagcttacgcctcctaaagtttgtttagttgcgattccatttttatagttatcattatttgataaaatcatctcatcaaaacttttagatataagtttatcttccttatatccattagtttttaagttagctatattactcgttaaaacactttgtctttcttgtaagtttagcattgatgaaacagatgtatataatcctcttagcatatttcctcctaatctaggtaatttaattttttcatcatacctcttaaatttaagatagcttttttatttaattgcgatactctagattcagaaactcctaatacctcaccaatttcttttagtgttagttcttcataataatatagtgatagtactaacctatctctttcacttaacatatctaatgctttcgttactgtttctattaattcatctttttctatagagtcttctatatttacagattcatctttaattatatcgataagttttaaatcattttcactatctaaaacaatattatcaagagagcttgtgtttaaattcaaagtactttttttaatcttataaacttcattttttgatatatccatataatctgatatttcttctacagttggttgtctaagatatttatgttgtagatgctctacacaatttttatatgattttactttgcttaagcaccctctagatacaggtgattgctttcttatctcatctattatataagatgttattcttattgaggcatatgtagaaaatttgacacctttttcttcatcaaacttatcacttgcatctaaaagtcccataacaccataacttactagatcttcaaattccatacctatcttatttgtataatatttagacgcaatgcttttaacaataggcatattttgatttatcagttcttctttactaatcataactataacaactccaatcgctatatattaactacaccttgagattttatttgaacatcactaggtatttcatttaatgacaatatagttaaattaggaaagaccatttctactaattttctaaatggcgctcttatttttggagaaactaataatattggtctattgttattaaagtttatagactctatagtactttgtattcctttaaatattttattagtagtatctggatctatagctggatatgttccatttacagatctttgtaaactattagctactaagttttcaatttccatagataatgttgttactgtaattgagttattatcatctattagctcaaagcatatacttctactcatcgccattcttacatattcggtaagtagttctaaatctttagtatttcttgcattatctgctaaagtttctagtatagttactctatcttttatagatactttttcttttaataagttttggaatatcttttgaacttctcctaatgtcattaaatctggtattaattcatctacaaccgcactatatctttctcttgtagcatctataatagctttaacctcttgtcttcccataagctcatgtgatctagcttttatagtttcaagtaagtgcgttactaatattgttgtaggatctacaactgtaaatccatataattctgcttcttcagctttatctttttctatccataaagcatctaatccgaaagtaggctccttagtggatataccttccatatctatatccattcccataggattcatgcatagtaacatatttggcataagctcatatgttgtaactggtattccttttattttgatactatattgatttggttctaattgtaaattatctcttattcttattggatgtacaattatacccatatctattgcacactgtcttctaacagatactattctttgtagtaaatctccgccattactttcatctgctagtggaattattccatatcctatttctacttctataggttctacatttataagagttgacacgtcttctgcattttctaaactttcttccggagtcggtgtctcttctatttcatgtaatacatcattttcttcagacttttcttccttattaagcgtatatcctataaatattgctccagctcctaaagtgaaaaatgataatttaggaagtcctggtaaaagtcctagtaatattaatactattcctgccataagaactgctcttggaatagatattaactgctttcctaattgattactaaagttctcatcactattgactttagttactaatatacctgctgaagtggatataattaatgctggtatctgacttactagtccatctcctattgtaagtcttgtatatgtctgtatagattccataaaatccatatcaagcattacaactccaattactatacctgcaagtatatttattgtagttattatgattcctgcaatggcatcaccttttacaaacttagatgcaccatccatagatccataaaactcagcttcttgttgaagctcttttcttctttttctcgccattttttcatttatcatacctgcatttaaatctgcatctatactcatttgcttacctggtaatgcatctagtgtaaatcttgcagatacttcagacactctacttgaaccatttgttataacaacaaattgaattattattattatcaagaatataattatacctactacataatttcctccaacgacaaaactaccaaaagactcaattacattacctgcatatccttgacctaatataagtcttgtagaggatatgttaagtcctaatctaaacaaagtagtcactaaaagtatggtaggaaatatggataattctaatatactagttgaaaaaatagtcataagtaatatcagcacagaaaatcctatattcatagctaacattatatctagtaagaatggtggtagtggaattattatcataagtataattccaattatcccaaatccaactaatatatcagctctttttttaagatttaatttttccatttaaaacctcttttacatttttttatatctattttttatcttataaactgccactaatacctctgctacttcttgatataccttttcaggtatctcttgttcaatttctacctctttatacataagcctagctaaaggcttattttctataattggtatatcatgttctttagctatttctcttattttaaaggctactaagtcagctccttttgcaactacaattggtgcttggtcttttcccttttcatattttatagctatggatatatgagtgggatttgttacaattacattagctgacggtacagcttccatcatccttcttgatgacatttctctttgcttttgttttatttttcctttaatttctggattaccttccatttgtttatattcttcttttacctcttgcttagtcatttttaagccttttttatgcgtatacttctgataagcaaagtcaaggactgaaattactaacaatgccagtagtatactttgtattaagctttttataagagtaataattgtactcattaaataaggaagatatatatcaccagttttaagtattcccatgaaatttttctccataaaagagtatccaaccttaaataatatagttacaagaattatacttttaattaaatttccaagggctttttttgaaaacatgtttttaaatccacttattggatttagctttgataacttaggttttaatggttctcctgtcatcaaaaatccactttgcattaagtttcctatcactgaaaataaaataataattacaccaataggaattattattttcataaaacctgttagcatcatcataagtaaacttccaacaatgttaaatgaaaattcatttgaaaatccaatatttaaatattttactattgattcttttagttctgaaatagcaaagtcagacatagagtaaattatcataagtacacctaataaggttactgttgttactacttctttactcttggctacatttccgctttttcttgcatcttttatcttttttgaagatggttcctctgtcttatcatcagttgataaaattgcacctaatggtgccatagctgacaaatatgagctatgacttataaaagttccatttaatatatcagtcatatgaactaataaattatgtaattcagttaatataaatggtaatgatattacaaagaacattattccaactaatatttttaatggcattcctataatcattacatttaactgaggaacacttcttgatattagccccattataaaatcagttattataagggctaatattattggtactgcaattttaaatccgatgacaaaacattggataaatacattaactatatatccatagttattagttagtataggacttcctacttttacaagtttaaaactctggcttatacctgttataagtttgtgatgtccattcatactaaaaaacaccattattccaatccaataaaccatattttctattaaagtattattttcatgactgttaggatcataaatatttatcatagataatcctaactgttgatctattaaactacctgctattttcaagctatttatacatacacttgttatatagcctaaaaccaatcctgttatagtttctattactgcaatatgaataaaatcatatatactacttacttctaaatgtacattaacagtaaaagatattattactgacataaataaagtaaaagtaactttaaatgcatttggcgttccactcggaaatattatatttatacatgaaaaaaacgcaatcaatctaataaatacaaatatcaatttatagattatccttttattgctgctatcatattcataattttgttagtaaactgtataagttcatttagcatccaagctcctccaactaccaaagttaatgctataactattaacttaggtataaaagataaagtttgttcttggatttgagtggttgcttgaaatatacttactaataaccctactaataaagatagtattagtattggtcctcctactaacattgctgtatataaagtttcttttactatactaattactacactttcattcataatgaatactctcctcaattattgaaaacttaacagtaaagattttattaataaattccatccatctaccattatgaataacaataatttaaatggtaatgaaatcataacaggtggaagcataaacattcccatagacataagtacacttgataccactaagtctattaataaaaatggtaaatatattaaaaatccaatttgaaatgctgttttaagctcactaatagcaaaagctggaactaatatatataaaggaatattgtctctagtcatcttttttttatctacatctgaattatcaacaaataactttatatcttcttgtctagtttgctttaataaaaactttcttacaggtttctcagctttttctacagcttgttcaaatttaatttcatgattcatatatggttttaatgcttgttcatttatctgttttacggttggtgccataacaaacatggtcaagcaaattgccaatcctactaatacttgattaggtattgattgttgagctcctaatgctgattttataaacgaaaaagttattataattcttacaaagctagtcatcataaacactatagcgcttaaaaacattagcattgtaagaactaaaaataatttcattaaaggagtgtattcacctaagtacggcgttatatcatttaatgtttgcatcttcattctcctttagtttgtttattacatccattgtgttgtacatattcttattaaatttaattttattaaatttaacttttttaaatttagaagaattaaattttaatttattactactctttttatttttttcaatttcttctaaatctgctttgtttaagtctcttactctttctacattattaggtgagattagtaatacacacccttcatctccagtttttaaaactattaaaaaagtatctttactaatgctcaccttttctattacttttgcatatctgtatatgcccatattttgtaaactaagtccattcatcttgtgtgctattaaaattattaaaaacattaaaattataaatgcgcttaaatttactaaatatcgtaacatttcatccataataagttacttttgctccttttttctattgagattatttgctttgatttttagtgtcttgtgtttgtttattttgttgtgattgatcatctttttgatctacaattaagatatcaactcttctatttatagctctattttctggtgtagaattatctactaaaggtttaaattctccatatccttttactgcaaatcttgttggttttataccttttttctcaacaaagtaactaacaacacttacagctcttgctgttgataagtcccagtttgatgcaaatcttgaattatgtataggaacattatcagtatgaccttctactaaaatatcattatccattccatttactaaagtagttatagtatctagagcttgtatactagttggttttaattcatctctaccagaatcaaataatatagtttcatctaattgtaatattatacctctgtcttcttgtcttacttttataacattattaagattattgttttgtattgcgttatttacttttttctctaaatcatctttaacttctttgacatcttttttggctttatcaatgtcaacttttatatcatttatatccattacttttgtcacagctgtagatccttttaaagatttttgtaatgcttcagataattgttttaacttttgactgtctacagcagacattgaatatagcaatataaagaaagtaagaagtaaggttatagtatctgcataggtgtccatccaagaactttcacccatatcatcattttttcctcgtcttctatctctacgcggcatttgctgatccaccctctaacttattatagtaagccttcttctcttttgttgttaaaaagtttactagcttctcttctataactctagagctatctccattttggatactcattattccacaaatcatcatatccatacgttcacactctttttcaccttttatttgaatattagctcctaatggacttaatactgcatttgccattaatgctccataaaaggtagttattaatgctgctgccataccttttgctatagtatctggagttcccatatctgatagcatttgtataagtcctataagtgtaccaaccataccaaatgctggtgcatatgctccccaaactttataaattttagcacctttattaaagttattctctgcctctgctacttctatttctagaatttcttttacatcttccatatcaattccatctattgctaattctagaccttttcttaagaagtcatcttctatttcagatacttcttgttctactgcaagaggtccatcttttctaacttttctagctaattctttaaattgatcaactaaatccactttgttaatatttcctgatcttaaagtttcttttgttgctttaaatcctgcttttacatcatccatagagaatgttataagtactgctgcaaatgaaccacctactgttatggctaaagagggtgcatctacaaatgcacctatccctgtacttcctaaagatattcctaatgcaacgaatccaaaaaccagtacaagccctatgggagttaatatatcactctttttcatattatcctcctaaattatctctttaaatttattatttcttgaagtaattcatcactagttgttataactttacttgctgcttggaatgctcttgttgttactatcatttctgtaaactcttcagaaagatctatatttgacatctctattgcaccttgatttacaagtccatgcttagtattaaacattggctctccagagtttgcagtttgtccataaagatttccacttaaagactctaatccttctgggttatgaaatatagctatttttaaagtttgagcattttcaactttagttccatctgctaaaagatatgatatcttaccttctttagatatattaaatgataaaactttttgcatttttccatctgggtttctttcttcttttgggatttgtatcggcttgttatttcctcccttatcaactcccataaccttgtatccatcagaagttactaagtttccatttgcatctagtgtaaatgacccatctcttgtatatgcattttgatttggcccaactcctacaacaaagaatccatctccatccattgctaaatctgtaggtcttcctgttggttgtatagctccttgagccatatttctaaagattccacttacctttgcacctataccaacttgtcctgggtttacccctcctattacattaggatcatctgcttttccaccaggaacacttgaatatataactgtttgatttaaagcatctgaaaatcttgtagttgattttttaaatcctgttgttcctacatttgcaacgttattacctacaacgtccatcttagtttgatttgacttcattccacttattcctgaatacattgactttaacataaattttatctcccttttttataaatttatatctatgttttacttatcttcacttgcttttataagagatccatactctatggattttaactcacttgttttatcaactcttacatccatatatacaattccattttttacttctatactttcaacaacaccagttatagtttttttattttcttcttcagtatcttttgtttttcttatttcgttaatattaatttcatctgggtcataagcttcaatatgctttcctatcattgaagatgctgtacccatagctagatttgtcaaaactccatttgttaacccttcaatattacccatgctattgtttaaattttgcatctgctctaaagtattaaactgagctaattgagttatatactgagttggatcttgaggattcatcggatcttgatgactcatctgcgctactaataattttaaaaataagtttttatcggtttcttttccagccatcactatagctgttccattttcagttttatttgaagatttagtgttgtttgtttttacattagtttgttttatatttttttgagttacattcataaaattattcatactctaacctctaagctaatatattaaaattctcttgcgagttagctacttcttctatatcttctatagaacttacttgcttatgattgtttcttttttgttttctaggttcttctctttttccaaactgttggcttaaattatctgaaaagaaattttctgaatttgacttcatagttacaactacatctttagcttttatacctaaatcaaataagtgcttatttatatcacttatatttttatttaacattttaaaagtatcttctttacttacgtttataaataccttagttgcttcactatctttcataagctttatagtcatatcccctaattctttaggctttatatttacttttatttcttctatattattattttttaaatacttaaccatctttataaaatcatctgccatattatttgctcttatagttacaactggcaaatttttattggcaactgaatcttggataaaagctttattagatactgtagaaaaaacactgacatttttatctagtatgttttctaaaatatttaaatccttgtcatcttttttaggtttcatatctatgacattgcttttatttgtatttgtagatacatttaattcttcataagactttaaattttttatctcatcatctaacttttcaatcatatttaaggtacttaaattatctaactcaactagatttgttgttttttctccagtttttttcgacatttgtttgatatttatttcatggttaggttttaatacattagatgtttcttttaataaattaacttctggtttaatatctttatcatttttctctaaattcacattgttatccatattgaaaattttattaaaatcaaaatcattaccaaattcatctttaattaaatatattaacttatcttcatttatatcgcttaaacctaattgaagattttggttatttaatttattaattataaaatctatttctttttttatatcattatctgtgctacctatttctttaaatagtttcatattagaaataagattttgtaataatgacataatatccatactattatcattactagtgctgtctttctctaaatctaaagaagaaattatatcttcaaaatcaacactatttgataaaaaactatttaaactagtcttttcagatggccttttactcagttctgtagaaatatttaaattaaaatccatatacaaccatcctttatgatatcttctttttatttcttatatatgcatataaagcaaattcatcattttctatttgctcttttctttcttcttcttttcttaattttgtaagtttattttcttttaaagtctctaaagattttctatttatctgtttttcaataaaattatcttttgcttcagatacctttttttctttttctactagcatattgttacattcttcaattgtttgggtaataaaatataagtagttagatctaattttttggctaatagtatcttcagattcattaaagtttgagtatcttttataatcagaatttaacgatttaatattttcttctaatatttttttatcattctgagcctttgtatactctaatttacttgcttcttcttcttttatttttatatctaataacttttgtaacttaaacttatattttgtcacttaaaacgctccttgttatttaaatatactttttaattcaattatacttttttcaaattcagttttttcatttacaccttgttttaaaaatgaattaactttatctatatattcaatagccatatctatgtttttattagaaccattttcatatgctcctatattgattaggtcttcagcttctttataagttgctaatatatctctagccaatgatgcggcatcttgatgttcttgttcacatatttctttcataagtctgcttacactgtttaatatatctatagctggataatgattcttatgagctaaatctctggataagactatatgtccatctaatatacctcttacagtatctgcaataggttcattaaaatcatctccatctactaatacagtataaaatgcagttatagatccatgttctgacattccacttctctccataagttttggaagtagtgcaaatactgaaggtgtatatcctttttgtgcaggtggttctcctatagcaagtcccacttctctttgagccatagcaaatcttgtcacagagtccatcatcaatatgacctttttaccttgatctctaaaatattcagcaattgcagttgcagttaatgctccttttagtctcattagtggtgatttatctgaagttgcacaaacaactacagattttttcataccttcttcacctaaatctctctctataaagtcaagtacttctctacctctttctcctataagtgcaataacatttacatctgcttgtgcagttcttgctatcattcctagtgtagtactttttcctactccacttcctgcaaatattcctattctttgtccttctccacaagttaaaaatccatcaatggctctaattccagttggcataatatttttaattcttggtcttttcataggatctggaggttcatttgaaaggctatatctttctccacctaaaatttcaatatcatctattggatttcctattccatcaagaacttttcctaaaaggtcttcactacacttaacactaagaggaattcctctagcaactactctacacccaggtgctactcctgctaactcacctagtggcataagaattacattgttatttttaaaccctacaacttcacaatttataggttcatctgcataattgtaaacagtacataactctccaacgaaggattttataccttcaacttctaccgtcaatcctattattttagtaaccttaccttctgctattacaccttttatatctaaaactttatgttttaatctttcaaaatctaaatttatcataatagctcctcttttactttttctattacacagtcaatacctacaattaatcttcctttattagtttcaattattgcatttcctgcttctatagaattatctgctagtacaaaagcttgaccctttatagatttttcattttttagaacattaattttttcatttatactttctacataaactgaatttgctttaataacaaaattttcgctaatttcatattcacttataacagactctagtatgttattcatcgaatctatttctttgaatttttctttaagtactttttccgctattgttatacttaaatctattatttgttttttattttcctttaaatattcaacaacttgatttttagagtctattaaaatactacttgcttcttgaataattttttctgactctgactttgctttttcgatatgttcttcataagcttctttatagccatcctcatatccattttgtagtccttgtgaatgaccttcttcataagcttcttgctttatttcacaggctttttcctgagcttcttcaacaatctttgaactatctaattctgtttgttttaaaatttcttcatatttttctttagcttttaatatctgtttttctaattcttctttagtttgttctaattcagctttaatttcttcatctttttcaacttgttcttttaaatttgtattatctaagtgagtagtttttaaaggtttaaaacctttaaaaactatcccatctgattttataatatttgtacttttaaatgaattcatcttctgaacctctagataatgttatttctccagcatcttcaagtcttctaacaatatttacaatagattgttgagcttcttctacttgagatatttttacttttcctagtaagtctatttcttctcttaaagcttgagatgctctttgagattggtttttaaatatagcacctgaaacatctgaagatgcacctttaagagcaaatgcaagatctttaacattaacttctttaagaattctttgtatagccatattatcaagtctaacaatatcatcaaatataaacatgttagatttaatttcttcagccaactcttcatttttagactcaatgaatttgattatgctcttttctgtttttctatcaacgttacttaatatatctactaaactattaactcctccagaactttccatatctaacttgcctagactagttaactttgcttctatagctttgtctatagattttattacagctggtgctatgttagatgttgttcctatttttaaggaaatctcaagttttaattcatctggtaattcagacaatacaagtgcagctttatcaggttgaatatgagatagtaatatagctatagcttgtggactttcaccttgtatacatgcaagtatttgttctggttcagcttttctagccgaaacaaaaagttttgtgtatgcatcatactttataccttctagcagcttagttgccctttgacttcctaatgcaccattaagtaatgatttagcacaatctataccaccttctataacaaattctttacctttatttaactctataaattcttgtaaaacttctcttctctctcttggtttaacagtatttatattagctatttcaacacctattttttgaatttttctatcagataaattttttattacacttgcagctacttctggtcctaaagtcataagtagtatagctgcttttcttgcacccgtaactcttctaaacttaggtatgtctcctaagtcaaacgcattacctttaacgccttctttttgcaaataaaatcaccctttactcatttaaccaactattaactaaatctgtaacttgatctgggttatcagctgcaaactgtttaacctcatcttctaagcttatacttacttcgtctacttcttcgttactattcaatctattttgctccaattcttctagttttttgttgattagttctaattcatcttcttcttctacattttctaactctgtaggcttacgtttattttttataaccatataaactaccgtacctataagtaatcctaaaataattaagattattattcctgtaactattaacattgttgataatgacttatctttgcttatagcgtttttgataactccaaatgtactagtatcttgtttttccgtttcaaatcccatagaaactacttttacattgtctcctcttttaggatccattcctatagtatttgctaccatatcttgaacatttcttactacatcatcacttaaatttccatttatagctactgatgctgtaattttgtttatttcaccttttgcttttattgttttagtttcagtttttcctgtttgatactgaatattttgttcgttattttcaatacttcccgttccactttcgttaacgtcactcatattgttatctactgctccacctgtattttgtttttcagtagatttactgcttgattttgattcattagtaattactttgttaggatctattacgatctcagttttttcacttgcatcaaagtttagatccgtatttacagttgctcttactttaccttgtccaaatattggttctaaaagacctgttatcgatctttcaagttctttacttaagtctttttcagccttcatagcttgatcaacatcacttaagttagaagtatttatatttccgttttcatcaattaatccttctgatagtagtttcatattttgatctattacttctacattttgtttaggtacattatctgtacttgcagaaactaaacacataatagatcttacttgagctggttttagagtttcacctggatttaaatttaaataaactgcagcttttcctggtactgtttcatttgcaaaaactgatttttcaccttcagttatatgtactctagcactttctacttgtggaaaaacttttatagttttttcaatttcaccttgaatcatacgttgtttctttatctcaaactcttcatctgtcataccaaatgatgacccttcatccattatttcaaatccttttgaaccatttgatacattagaagataattccatccttaatttatctacatctttttttggaactaatatactatttccttctatcttggtatcaactttttttgattcaagttctttagttactgctgctgcatcactagattctagtcctgaaaataaaactccatacttattagctcttgaataacttatcccaaatactattgctagaattaaagatataattgcaactactattgctatttttttctttttagataaggtaccaaactgttcttttttaaccaacacaaaatcttttattttttgtggcaattcctttatattcatctaaaattctccttgctataaagttataattgaactctatttagctcttgataagcttcatataccttatttctaacttcaatcattaactgcattgacatctgagcttcttgagcagatatcattacatcatgcatagaaacgtcgcctccttttaaaaggctctcaactttcttatttgcatctacctgcttgtcattaactttatctagtgcatcttttattacattagaaaagttactttctttttctacacttttactttttgtagtttttaacaaatcattatttgttaagatgttgtttactccgcttatagctcctattccagtcataaatccactcctttttatctgcctatttctaaagccttagatatcatatttttttgtgcatttaatgtatctatattagactcgtaagctcttgaagcagtcattaaatctgccatttctactaatatatctacattaggatattctacatagccttgtttatctgcgtcaggatgatttggttcatatagttttctaagtggcgccttatctttttctatagaaactgcctttacaccaagcatacctaactttttatcataattttcctcaaatacaggaaccttacgtctataagctccaccttctttagttctcgtagtcttcatattagcaatatttgatgaaactatatccatccttaaacgttctgctgataaagcactttggctaattctcattcctccaaaaatactcatctaattacctccctgttataacacttctagccattcctaattttatattagttaaagttataagtgcattgtattcaagagttgtagctgcttggttaactttctcattttctaaatcaacattgttaccatctactctcatctttgagttttcatctgttttgacttctattttaggttttttatttatagagtctttcaatgtttcttcaaaggttacatattttcttttataatttggagtattgatatttgcaatattgttagcaataactctacttctaagttctgttgcatctaaccccatcttgattaaactatatgtttccattattacctcctttttcaaataaaaaaaactactcttaaagagtagtttgatcacttttataatatatcaatgatttctaatcgtattatataaattaaaattaaaatcagaaaataaaatatacctacttaatgtctaagtcaaaatcaaataaatatttttcagctttaatatatctaataaattacgattcaatatttaatatttaaatgttttttgtatacttgtaaacccattttaaggtatattaaaaatttcaataaatgtttatgtacatttgcagatgtctcctgattttatttgtaaattatataattatccataattcacgatcttcattatatcaatgataacaaaaagtttattaaccctttggcagctggctggcgtagtttagataaacattagcccctatagttttgcgtcactagatttctctagatttgcctttgaatatcatcattcgacttatatatctattttataccattattcgactttattcaagcatttactttaatttctacgtcttccatttaatactaatataaaatataattttaaaaaaagaccaattcccattgatttaacaatatttttacctttttttaccatttttttaattatttattatattttatattttaagtgatatattacatttaatttatgtactttttttatttatttgtacttttaatcctttaattttacatttaaattaacaatcttttttagcaattattctaattactactggatttaaatctttataaatagcccagttactactttcttttgctgaaataattttaaatccttcttcttttaatgtctggactaattcatctataataataaatcgtctatagtgttcattataaatatatgcatttcgacctacattttttcccaatccatataattcatcttttacactacgaacctctataaaaaacattcccccactttttaaagaattataaactcgtttaacaagtattgtttcttcttcttctgtaattgagtgtatcgtaaatctactatacgcataatcaaatttattttgatcaagtaagtttgaattaacaaaatcatcacatataaatttaagattatcttgtttgttactatcatttaattttaatattactgcttcagattgatcaattgcagtaatatttatattatatcttgaaaaaaatttagcatccctaccatttccgcatcctaattcaactaatgatttgtccgtttctaaaaactcaataatatcgttggcaaatttagatgcttccttcggggctatatctttattataaaaatcattccaatatttattatccattagcttttttcctttcagcaatgtattttaaaattatctctctaatttcacttctgttccatctaaaaacttaatatacgatgcaggtgatgtactacctcttttatcttcaggaggcaatttcatgtagtctccataagttgtagttaaaatttcatcatatgcttctggtacaaaaaattcatatccttcaaattccattgtaattgactttttataccactcttttttaagtacttgtctttcatttcttaaataatctaagttataatatgcaaaaagatcagtttctttattttgatagaattttgcaaaaaattcaaatacacgtatagttaatttacgtggaataaagcataataatttaaaaaataacctactataaaaatgttctttaactacacatcctacaggagcccaaaatatttttctacacatcttacacataacctcaaaataatactgtgtaaatttgttatctgaaatattatctaatgggaaaatatccataaatattcctgaatcttgttttaaatgttcttgtccaactctcatataagtagtgttttttaatctcaatttcccataaacccagttataatgcttatcagtttcttgattttgaaagaaaaatttactttcatctaattcttctttacaaacttcacaaaacctttcatactcgcttctagacatttgaacatctatatcatcatcccatggtacaaagcctttatgtctaactgcaccaagtaaagtaccatcagataagtaatattttatattatgctttctacatatcctgtcaaactcttttaataatagcaataaattactatgtaatttttccaattcttctttatttaatttcaaacattcattttttttactcataatttctctcccaatttaaatgtcaactaatattatatagttctttcttatcatttttactaatatagtttaatattctttcatagtcatcaaaataatcaatttccgaccaaaactttccattaacatctatagtatcaattgctctatcttctattaaagaatataaaatattctcccaccataattgatgttgttgactacttactaggcaatttagcttatctttgaattctttaataaatgattttcttattttccctatacctacatactcacaacttctctcttctataggtagttctttaccgtacttaattatatatccattttctgtttttaaaaagaaatcacctattttggttctacttttatctaccatcagagaaacctcttttttttccgatataatggtatctaaaatttcatttgtaaaatacacatctgcatttaaaataatagtatcttctgttaattcctttctagcaaaccataaagaagctatactatttgttacatcataaaaaggattataataatattcaacatctaaaccttctaatgcttcataaattttttctttacaatatccgacacacactattggtttaatatttctatccagcaacatagttacactccttctaattaatggagttccatcaaccggtaacgtggacttaggtatttcttttattattctagaaattctagttcctcttcctgctgctaataaaatagctttcatatttgtctcacacctttacatatctttataataaatctacttttttaaattcattccaaaacttctccatagtatcaatacttcccgtagtaattctaatccatttttctaaaataggattagaatatgtcttaattaagatgtttcttctctttagctctttaaataattccattggaggctttttactttttatcaagatataattagctccattattataaaattcatatccatttatttttaacttagataataaatattctcttccctgtctttctacgtttattaaatcttttgttatttctggatatttcaataagttttctgcaattttaatagcaaaacaattaactgaataggttgaactagcatttttaatcatatttattatattgttattagaaacaatgtaccctatcctacatccagcaatggagaataatttcgaaaaagtacgaaatataattacattatcatattctttacaaatatttataaaactcttaggataaaaatagtgatatgcttcatcaataattacaattgctttattatctcttgctttttctataatcattctcacttcattccctgtccagttccttccaatagggctattaggatttaatattacaactattgatgtatcctcatctattaatcccaacatatcttcaactttaacttcaaaattttcatcgtaaaaaactttacaatgttccataccatacatatttgcatatactgaatacatttcgaaactaggactgactgaaaccactttttttcctgattgtccaaatacttcaaaagaaaggcgcatagcatcatcagatccattagttaaacaaatattgtcagtattaaagtttaacagttttgacaatctatcaactaaagtattagtttctggatacatagctaaatattcaggtgtaatttcatttaatacttttttaaaaaaatctgatggtaatccttctggattttcattcatatctaatcttaaaaaactttcacgactttctttataactagttctatataaattttttatattaggattaatataatacataagttttgtcctttctatctaatttaaaatactttctatagcttccttttttatagtttcatggactctttttccacattccccatcaagatttgttatgcttgcttttaatctctttatacgttcttcttttttaggatcttcgccatttattaccatatttataaatttttctacattcatatccttattgacaaagtaatttcctaagtaatctattgcatatattctattttcttcaattaaactttcttcgatcattcctaacacaggtttttcagttgccatatactgaaacataacagaactataatcactaatcaacgcatcagatacagatatagcaggataaacatcactatttaaatctataataacattttctacatttgaaattttctctaaaaaattgttaaataatcctattaatccttgtctcatagtcttaatagttcttactgtaagtggatgtggtctccaaatcaaacaacatgaatcatacattataaatgtattcaagatcttattcatatctttcatccacttttctccatcttctagtaaattagttattcctgtatttaacagaaatacttttttattatttattatttcctgccatttttttgcatctttaaatgattttttcattgatgaaatagttgcatcaaatttaggagaccctaaatttaaaactttattaaaatcattaccacttgctacatacaaatccttttcaacatcagattgaacgataacctttgtagcatttataactccaggtaattcactaaagtggcgcttatccattaaatctaaataactacctgctacaaaatacggtatatataccaacatatttgtatgttttaataaatttttagaaaaatgcctagaatcaactcttgttaatcgatttgcctcatcatatggattatgtatatatataacatctggttttctattttccaaatcatataagctgtaatgtgtaacttctatatcatcagaaaattcatttccttcataacagaattcattgatatatccttcactatccaattcatagtagggtattgggacaacataacaattacaatttggatcatttttagcttctttccacacactttccatacaatcccacatagatactttataaggcataaatacaacttcaatttgagtctctatatcatttttaatactatagttcaatttataaatcatattttcaattaaatctaaacacattttaaactctttgcatttattcgttaaagtcattgcatagtttgctttatttattatttcatttaagatattttttgtattatcattttcaccttcaacttgcccatatatgtatctcattgcttctaagcaatcacctatcattgcttgagcttcaattccacctttattttttgcataatcaaaaccttcatttatagtttgaatcagttgtaatatattttgctttttatttaacctcatattttagtacctcttgttttaaaattgatttaagttagttaactacatattcataattttttcttttgcttctaaaacaatttcatcattatcacaataatttataatatagttaaaaaacttaacagattcttcatattcttcaagcatttgttttacatatgctatattaaaaatcacatcataattgtatttatctattatgtatgcatctttaagtaatttatcagcacttctaaaatctccatttaagatttttattatagctttaaaatttaaaatatctatttcagccccaaatatactttcatattcatctattttattttgagcattaattatatcccctttatttacgtcattttttattaactctttatattgttatcgagttggcaattattaaactcttatcatttatgtaatagaacttatatttttatagcatatttctcttataaacattgtatcttccataataaagtatattatatatccttcataattttcttctttatgtatatacatatgtccattttcacactttatttctttgaataaattttcatagtaatttttatctctaacaacgtatccatttgtatttaataaaaattcattatatatatccatcatatagtttatatgattattagttattttctcaaaatcgccaactattttaaattgttttaactcttctatatttaacttatattctatttgatcataacaatgttcatatccatactttttatataatctataatctataggcataagtaaagaaactaactgatcttttttataaagttcatttaatgcaaagtccatcatatctttcatgtaacctttgcctctagcatttggatatgttgatactcccactacgtaagacgtgtcataaattttattatttaaatttattttatattgatttaattgaagagatgacattaattcatcattctcctcaattaatatagtattttccggtttatatttattgtcaaaataataattaacaaatccttcttcatccccaaaacaataattccatatatccttaatattttctaaatccttttctatagcatatcttatattcatattatgcctccataactgtgtacttttcaacaaacttgcatggatgatatgaaagtttagcttttctaagtccttcaattcctaaatcttcttctctattaacaaattcaacatctttaaattcatgaactaagaattgttgatttatatatgggtataatcctcttatttcaggattagctttttctatatgaattacagccatattttcatttatgttttctcctattgtaaatgcttccaatttagaatctatatatatacccgctatctttacatcttgttttaatacatcataattatcaaatattttttttacccctataaactcatcatctattccatcatcagtatccccatgctcagctttattattagcccaagcttttaaaagatctatacactgatcaaaatctttttcttcaagctttttatattcaaatcttccttcatattcttttaagaaataatttatgtgatttcttttcttttgattttttctacctgctaaagttcttaaactttccgcatcatatacataatcaaaataatctctttcttctatatatttaaatttacctggataatccttttgtaaaagctctacgacctctttagttacagctcttagatatatttgatgatcttctgttttaaaataattaatcataaaatctagtgctttatgaattttatcctttttagcaagtggtaatacagagaatctatctccttcatattcaccaactattattgcaaactcatcccctatataataactagttttatatgtgtgcctccacatatacaaggtggtaaaacaatactcacaagcttcgtagtctactgaattaaagtaaggtctcaattcctcatatgcatttatgtcaatctctttaaaaatcataattaattctccttttgatactttttatatatttaatttttcactctaaataattaccaaatatatgaattaagtttcttttaatagtcaaaactattaaacaattgctttattaattaatattgactttatacatacaatataaacaggtaatgattggagtaaaaaatgaaaaaaattacagttttaatatttattataataacacttttcgttggttgtagcaaagccccatcactatccatacatataatagatgttggacaaggtgatagtatattaatacaaacacctaataattctaatatattggttgatggtggtaatgaagacagttcacttattataaaaaattttcttaaaagtaaaaaagtaaaaaacatagatttcataatagcaacgcaccctgatacagatcatatcggaagtttagatgatataatagataaatttgatgtttcaaaagtttacctaccaaacaaagaaactaaaagtgactcctattataatttaatacaatcttgcaataagaaaagtataaatcctcaatacttgtctagaggagatataataagtctggatagtaatataaaattaactgttctaaatccttcttatacccatacagataacaattcaaactctatagtttttaaattagactataataacaaatcatttttatttacaggagattgtacatatgaaaatgaaatagatattataaataattttaatcttgaagatgtagactttttaaaaatatctcaccatgggagtaaaaattcttctagtcaagaatttttatatgcagtatctcctgatgtagctgccatatcgtgtggatatgataatcaatatggtcatcctcataaagatacacttttaagattaactcaaaccaatacaaaagtctatagaactgacaaacaaggtcatatatctttttacagtgacggggaaactataactactacttctcctcctaaataatcttaattaaaataaaaaaggtaacagtatagcttagcttcatgttacccttttaaatcaaattattttattaaatcatttattactacagaagctattgtaagtcctgctacagatggcacaaatgatatacttcctggagttatttttttgccattcattattctctcttttaactctattggtttttctgttgaataaacaacttttaatttttttatctttctatctcttaattcttttctaaccactttagcaagtggacacatttgagttttgtgtatatcagtaacaacaattttagtaggatctaatttattacccattcccatagaactaattatagttaaattctttttaacacaactttctattaaatgtatttttgagcttaccatatctatagcatcaactacataatcataatctccacttaataactcatcactattttctgctgtatacatagactttatagcttttatatctatgtctggatttatatctaatattctctccttcataacatctactttatcttttcctacagttgaatgaagtgccggaagctgtctatttatattagttatatcaacatcatcaaaatctactatagtcatttttccaactccagctcttgctatagcttcagctgcaaaacttcctaccccacctactccaaaaattaaaacattggaattttttaatttttctactccttcatttccaactataagagctgttctagttctaaaattcttatccatatttattatgtctccttgatgtaattttttctatatataagaatataatttaatatctattaattaacccactatccctataataatagcaaattttcgatttacagaggtgatgctttgaagaaattaataacttttttactgtacgtattaattgtaaatatattggtttcattgttactaattataaatattaattctaataaatgttctataaaagaatctgctataacaaaagcaatgtctaataacgataattataatttaattgttcaaatattaaaagacactcataaagaagattttataaaacatatagattatatgcaacttaatatttttaaaaatatagaaaacgatacaaataattttaccgcttttaatataacattacctcaaaataaatcttttatagctttttacaaaaaaaatagtgatgatacatattctttcgattgtattgtcgataacctttgtaacattgataacttttacttttataaaaattttctagttattgaacaaatttcagaagatgataacaattatttaaatgataagaaatttatagaaatattttataaagaaaaatctatatttgtatctaaattaaaaaaggatttatatatagaaataatagatttagaaaatgatgataaaagcatactttctgctagcatggattttttagatgataatcctcctaagatactttatgtttccactgtttcaagcatggaaaaagctttagataaaaaaattttaaaagaattatatatttgggataataacttaaataaatttgtaataagcaaagattcaatttaataaataaaaaaggaactccaactagagttccttttttatcttattggcgggagtgcgtgggaatcgaacccacccaagaagctcctaactcctcatactagttttgaagactagagggcacaccagcacccatccacccccatatgggatgtcctctcacttacaaacttatattatcatatatttaattatagtgcaaccatttttcagcaaacattttcatattttgcaataattttaaattaagcttcaaaacttatattataaatttatttttaacattaaaaaaggcacaaaaacttgtaccttttaagttataatccactatatccttttatattttttcattattaaaattatttatcaagtaactcatttttatatataaatttataaattaggtatttgccaatttataggatcccttcctaatttaattaagatatcattagttttagaaaaaggctttgatccaaaaaatcccctactagctgacaatggacttggatgagctgattctattatatagtgcttgtttgtatcaattaatttctttttacttctcgcattatttccccaaagaacaaatatgacaggttcatcccttaagtttaataactttataatattatcagtaaatacttcccacccttttcccttatgagaattagcctgatgtgccctaacagtaagagccgtattaagtaatagaacaccttgttctgcccaaggaactaaatatccattattaggtataaaacatcctaaatccccgtgtaactctttatacatatttgataaagatggaggaatcctaactcctggctttacagaaaacgcaagcccatgagcttgattttctccatgataaggatcttgtcctaaaattaaaactttagtatctttatacgaagtatattttaaagcattaaatatatcatacatatcaggatatataacttgtgtctcatattcattttttaaaaactgtctaagttctaaataatacggcttttcaaactcgccttctaaaacttcatcccaatcatttcctattttaaccataatgtcacctacttttaatttgctattatatctatatcatttttttcattactaactatttttatactaactttattaggtatacatactatactcttgttagatttttttataaatccagtttttacgcatatatcatccggacaagaagcttcacttacttctactccaccatcatgtactttaattttattatatccattttcagtttttattgttaattcctcttttttgtttataggtatttccttataaactttattatctacatatataactactttatcaccttcattagattgtttaaaataattaaaagctaatgctgctactatcactacaagaactaataaaacaagaaaaaaatcgtttttcttcatttttatcccccaaccatttataatataattaaatatatcataaatataaaggggagacactatgaaaagtaaaaaacttacattttatataactatttttattatatcaatcatttcagttttttttatatttaataaaaaagtcaataaattttctaaaaccatgtattatcttggaacagttaatgaaataacaatatacaccaattccaatgaagaaaaagcaaataaaatcctttctaaatgtgaagaaataataaaagatatagataataaaatgaatccatctacactatctagtgatatttataaaataaatcaaaatgctggaaaaaaatttactaaagtatcaaaagacacttataaggttataaaaacctctatacatttttcagatatatcaaatggaaattttgatacaactataggttcattggtaaatctttggaatataggtaatcaaaatgcaaaagttcctatgaaatctgaaatagataaagctttatctactataaattataaaaatataactttagatgataaagataaccaaataatgttaaaaaataaagattctaaaatagatttaggcggaatagctaaagggtatgcagcagataaagtggtagagtacctaaaaaatcaagaaattaaaggagccatagtaaatcttggaggtaatatatatacattaggtacaaaagataaagatgctaattttaatataggaatccaagacccaacaaaacctagaggaaattcaatcggtagtttaagcttatcaaataaatctgtagttacatctggaatatatgaaagatatataaaaaaggataataaaatatatcatcatatcttaagtcctaaaacaggctttccaatagataatgaacttagtagtgtaacaataatttcagataattcaatgaattgtgatgcattatctacaactgcattttcacttggaacaaaagaaggtcttaaattaatcgaatctttgccaaatacacaagcaatatttataaccaaagataaagatatttacttatcatcaggacttaaagattcttttaaacttatagattctacttttactattaaaaactaaaatttttctttaataaaaattggtgaataactttttaaagctattcaccagtttttttaaaataatactcttttattttctattctttttgttattctatttctatcgaaatcttcaagaattatcatgcaattttttctactcgaattaactaaatctctataatctcctaaagttatttcattattttcttttaaatacttaactaatctatctttggcattattgtaaaccttagtagacattatataactatcttcaagtctacaaacagtatttcctattaaagattctaaaacttcttcatattcttttttattgttagttatatcttcaatagtatatatattgttaagtccagctaagtttaatgttttttctatttcatttttaatttctaattgtttttcatttaaaactactttgaaatcttttaaagaaacaatattatcttcaacttttacgatatcatcatttataaacatatctaataaaatatcaaattctctagttttaaacttactttcaattttagatcttacttcttcttttaacataccttttctaagtctaaattttttatggtatgtttttaattcattttccgtattttcctttaataaattatactggtttatatgcatatacatgttatttacacaaacaacgcttttttcatctaaaagcttatttaatgctttttttacattttcttcgctttctccactataactcattatttcttttatgttaggataatttctagaattattttttaaatattcttttaatatagcactaagttctcctttttctttaacctttaaagcatctattatagctttatcaaatcttttatgctttttaggattagtgtctattactattcctccacctatagtttccataggagagtatcttctaactacaaacttatccccttttttagctactatactttcttcaagtcttaattgaactaatccactttcaccaggatttatttcttcaacttctagaggtactgccctacaaagtatttctctagtaccatgataaagtcttaatctatcccagtgcttaagtcctaaatctgtatgtttaactatacttagtctaacatctaacatcatagcttcttctagagagtgttctgatgctaatacatctcctctatttacttcttcaaccttgacattagatatatttatagccgttctttgcccagcataagcagtttctacactttcaccatgaacttgtatacttcttatcttagcttttaattcttttggatatataactaaatcatcatcaacatttattttaccttctattaaagttcctgttacaacagttccaaacccttttatagaaaatactctgtcaatattaagtcttgctggtgcatttaagtttttatcttctatttcatcagtcattttatcaattttagttataagttcgtccattccacgtcttgatattgaatcaacttctataatttcagcatcttctaggaaagttcctttaactttttccctaacatcttcttttactaattctataaagtcttcatcaacagtatcacttttagttaatactatcataccttttttaatatttaaaaaagttaatatatccatatgctctatagtttgaggcataactccttcatcagctgcaacaactaataaaaccatatcaagtcctgatgctccagctaacatgttttttataaatttttcatgtcctgggacatctactatcccagctcttttattgcttggtaaatcaaaataagtaaatcctaaatttatagaaatacctctctttttttcttcagctaaggtatctgtttctcttcctgtaagtgcttttataagagttgttttaccgtgatctatatgtcctgctgttcctattattacgtttttcatatttatccccctattaaagctttttctaattcagttttaacaacttcaaattcatcctcaaatatagttctaacatctaaaacatacttatcatcatatactcttgctattatatgtgcatcacttaatcttaatctattttctaatgtagaaacgtttatatttttaggaattattgttataactttagactccatagtctcagttggcatagaacctcctccaacttgagataatccatcttctatttttatatctgcataattatttaagtattctattttagaatataaattgttagctttttcttctaattcttttatagaataagttagcatttttagtgttggtatttcttttttagctttttcttcatctaagtacattcttaaagtagcttctaatgcacatatagtaagtttatctactcttagtgctcttgtaagttgatttttcttcattttttctatgtattcttttttaccaactataataccagcttgtggtcctccaagcattttatctccactaaaggtaactatatcagcaccttttcttatagaatcaagtactgtaggttcataacttaatccatatttagatacatctacaaaaaccccactacctagatcttcaataactggtatatcatgtttttcccctaattcacataatttatcaacatctacactttctgtaaatccaagtattctataattacttgtatgaaccttcatcaatacttttgtattttcatttatagcttcctcataatcttttaaatgagttttgttagtagatccaacctctactaaatcagctccactaagagccattatgctcggtattctaaaagagccccctacctcaactaattctcctcttgatactatagcttctccaccttttgccatagtactaagtactaaaagtactgctgctgcattgttattaactactaaaacatcttcagctcctgttagtctttttatagtatcagttaaatgtgtatatcttgaacctctttgtcctttttctatattatattctaagtttgaatatctagatgcagattcccacaaatcatcttttatgctttcacttaaaagagaacgccctaaatttgtatgaagtacagtacctgtcgcatttataactttttttagtgataatgaatattttaagttgcatttattcatagtactttgagctattttatctattgatatctcgaatttatcaaaatcactttgttttaaatcaactatagctcttcttttttcgtcaattgattctcttatagcttcaagtaatatacttcttggataactatttaatgcatctattatttttttttgatttaacatttcatctactgaaggtaattgagcaaataactctcttttattcattgaaaacacactccccttataagtccttacttaactgttatataatgttgtcctttttctttaacagttcctattattttagcttctatagaaccatttttcttcatatctttaactagttcttctgctaagttgctatctacagatattaataatcccccagatgtttgtggatcatataagatatcttctatagcttcttctatattttctatatatacatcttttgatatatactgcttatttctatacataccagctggtattatacccattttagccatatcaacagctccatttagtataggtatttcattagcttgtaattctatactaacatctgacgctttagccatctccaaagcatgtcctaaaagtccaaaacctgttatatctgtaactgagtttacatttatattgtcaaaactcagtgctgcatatttatttaaatgaaccatagtctcaactacagtttttgaagtttcttcatcaactaaattttccttcatagcagtatttaatatacctactcctataggctttgtaattactattttatctcctacctttgaagttgcattagataaaactttatctggatgaactgttcccgatacagataatccatatttaggctctttatcatcaacagtgtgaccacctactaataaagctccactttctttaactttatccataccacccttaagaatttctgccaatacattcatatcatgacaagaaggaaaacaaactatattcatagctaccaaaggctttcctcccatagcgtaaacatccgataatgaattagatgctgctatttgtccaaatatataaggatcatctatcatcggcgtaaagaaatccaatgtttgaattaatgcagtatcgtcatttaacttatatacagctgcatcatctgaagtctcaagccctactaataaattttcttttttatctgatgtatttttaggtaacttagataaaactccagccagaacctctggccctattttagccgctcatcctcctgatgttgtcatatctgtaagttttttcattatttccataattatgtctcctccctttaaagcattacataactaataatatcataattaacatttattgaatacagatataatccttcaaattattaaatttattttcgcctataccctttacattttttatttcctctattgatttaaattttgtattctcttctctataatcaataattttttgcgctgttatttctccaactccaggcaaagaatctagttcagcaagagatgcattatttatatttattttattattatcgctactagaattattattgttactaacacttaaatccttatttgtagtttcactattttgataatttgtagattcattactatttacagtttcatctcctattttagggattatataatgtcctccatcttctactttcatagccatatttattttattcatatctgcatcatcactaaccccatcacaaagcattactccatccataagcctgtcttcgctgtctaattctacaactttaggtgattttacggctccacttatataaatggttatcttcttttttatggattcatcattttttagtttttgtagactatctaaattgctatctctagtagattcatttaaatttgtattagtatcgtaattcatttgattgttatgtacatacttatcattatttatattcttatcttcagcttcacttacaacataattatcatcacttgatataaatccactattttttactataaatacagaacttacaagtattattataattatcggtaaaaagctctttattttttccattttatcactccttcaaatttgattattgacataaatatgttatactaaaatataagtttaaaatcggaggacaaaaaatgttaaaaaaagtttcaatattattagcattcatattaacttttattaatgtatttacatttaataatgtttcatttgcagaaacacaagcgccaagtgtatctgctaaatatgcagtattaatggattatacaagtggaaaaatattgtatgaaaaaaatccccacgagaagatgtatccagcttctactactaaagtttggactgcatatgttaccttaaaacatgtaaaaaaccttgatgaagtagtttctataggtaatattggcgatattgatgggtctagtatgtatttaaaaccaggggaaaaacttacagttagagaattacttgaaggtttgcttatagtttcggctaatgatgcagctgttgttttagcagaacatgttagtggttcagttcctgaatttgcaaagcttatgaatgaggaagctaaaaaaataggggctgttgatacacattttaacaatgctaatggtttaccagatttacagcattatacttcagcttatgatatggctttaatggctagagaagctatgagtaatgatgtttttagacaaatagtagatacaaaattattaagattacctgctacggaattttatccagaaagatttttaaaaaacactaacaaatttttaactggagatactaaaataccttataaagggcaaatggtagatataaagtatgatatagtagacggtataaaaactggatttacagatgatgctggtaaatgtttattatctagtgcaaagaaagatgatatgagattaatctccgcagttttcaaaactgaaggagataatatgtatatagatagtagaactcttttagattacggatttgacaattttaagtcagaaaaagctatagatagaaataattttttagaatctaaatctatttggtattctaaagaaagaaaattagaatacatgccaaaatatagctactacactattgttgaaaaaggtgctacaaatcctaattttacaactaaaactaagttagatgatataaagctgcctataaaaaagggttctaaagtaggaactttagaagtttatcaagataatgattctaaaccagtagctaatattcctttaattgcacaaaacgatgttaatagcttatttaaagcaattttaaataatcctatagtaaaagttataaaatcattagtattaatagcactttcattagttgcagtatttatagcattagttttaattagaaaaaaaataagaagaaaaagaagaagattaatgtataataaaaaaagaaaaatctatgctaataaaaagaaaaagatttattcaaacaaaagaagaagaagataaaaaaagaggcaaatgcctcttttttattatccaaatattttcttagttaagcagtttcctgtacaagttgcagcaactccacctaatgcagtttctcttaattccattggaagtcctttaccaactctatacattgcctcaacagtttcgtcaaatggtattatatttaatattccagctaaacaaagttctgcagatattaaagcattcgcaacacctatagcgtttcttccttgacatggaacttcaacaagacctgctattgggtcacatactaatcccattacattttgtaagcagtgagatgcagcagaaacagcagcttctacgcttcctcccattaattcaactataccagcagcactcattgcagcagcagcaccagtttcagcttgacatccaccttcagcacctgcaacagttgcatttctagttattatagctcctatagctgaagctgtaaataatgcatttatcatttcttcatcgctaaatccgtattctttacctatagtaactatagctcctggtaatataccacaagaaccagctgttggtgcagcaactataagacccatagaagcattaacttccattgttcccattgcagcagctaaagctttattcattaatccaccacaaacagttctttggttatttctgtagttgtctaattttttagcttctccacctataagacccccaacagatttaatatcttctgttacagctctttcagtagcttttttcattatatctaaactaacagccattttttctcttatttcttctttagaacgtcctgttaattcttcttctctagctatacacatttcacttatagtcatgtttagctctttacatttttgtattaattctgctccgcttgtaaagttatatttcatattatgtcacccttcctcactcattagaatttatctaaaactacagccttagctataacttcaaactttcttaattgttctaatacatctttgtctaatgcttcatctgtttctatagtaacaaatgtatagtcagatcctgctggtttgttagtagacatatttgctatatttttgttattatgagcaagaagtccagttacgaaagataccgcacctggtatatcttttatttcaagtataacagctggtctagaaccattaaagtcaagtggtaatccatccatttcagtaagtttgatgtttcctccacctatagatgcaccttttacaatagcaacagttccatcttctaaagtcatttccattctaacagcattagggtgttcgttttctcctaagttagtttttataaactcaaagtcaacaccgttttctttagctatatcaaaagaatttcttattctagcgtcatctggctcaaatcctaagattcctccaactaatgctttatctgtaccatgtcctttatatgtttcagcgaaggatccatgtaggtaaaacttaacactctttacaggctttcctgctatttttaatgccatttttcctaatctagcagcacctgcagtgtgcgaacttgatggacctatcatgtttggtcctacgacatcaaatacactataatctttagccattaataatacctcttttcttaaattgtctttttcttttgttttatggaaaacttttccagttatgccttaactcaaaatgaccagcctaaaataggcatggccatcttgattacatttattattttactatagctatagcttctatttcaaccttaacatctcttggtaatcttgcaacttctacacaagatctagcaggtttgttttcaccaaagtatgaagcatatacttcatttatttcagcgaaatcattcatatcgcttatgaatactgtagttttaactacatcgttaaaacttgctccagatgctgctaatatttcttttaaactttctaatgatctagcagcttgctctttagctccaccttctactacttccatagtttctgggttaaatggaacttgtcctgatacaaataccatgtttccattttttatagcttgagagtatggccctattgctttaggagccttttcagtatgtattacttgtttcatatccaatctctccttctcttataacataactttgtatttatattatacttttttcaataatattatactactaaattgtacacactgtatacagttttgtagtaaaaagtgaaaaatatactttttacatatattcccactttttatgtattattatatcataaattaatcttctattacaaatcctgctgcttctacagcttgttttattttatctttatgttcttggttaaatgtttctaattgtatttcaagatataaacttccaagtgagttctctttagaaattcttgacatatttgcatttaatatgtttgcatttaatttacttattatttgagttaattcagctaatccgcctggcttatcttgtattttagttttaaatgcataccttcttccatcttcagttaatgcagttcctataactctatataaagtattaacgtctacatttcctccagatattacacatacaacgttttcatctttagctggtttatattttccacttaataatgcagctgttgatacagcacctgaaccttcagatactaatttttgattttctaataagaataacatagcttgtgctatttcatattcttcaacaactataacttcatcaactaattcttttattatttcgaaagtattatctcctggagttttaactgctataccatctgctattgtagtagctttaaatgcagttgtaacatgtccatgagctatagattctttcattgatggtatattagctgtttgaacccctattatttttacattaggatttaaagctttagcagcagttgctataccagctataattcctccaccaccaattgggcatattatagtatcaactttatcatttaattgttcaaatatttcaagagctattgttccttgtccagccataacataaggatcattgaatggatgtaagaaagttgctccagtttctttttgtatttctacagcttttgcatatgcatcatcatatactaaaccttctaaaactacttctgctccataacttttagttgcagtaacttttgcaagtggtgcagtagctggcattactattgtagcttttattccacttaatttagctcctaaagcaaccccttgtgcatggtttcctgcacttgatgctataacaccgtttgccttctcttcatcagttaaacttgctattttgttacaagcccctctaactttaaaagatccagtcttttgtaagttctcacatttatagtatacgtttgccccagtctttttactaagcttaacgctttctaacaaatcagttgttttaactatatcttttatagtttctctagctttttgaacgtcttgtaatgtaattctagtcatcttttactcactcccataatatgtagatttagtttatttgtttgacatctttattgtatatagtttctcaacaaaaatcaacaggaaaacatttttttgtaattttttaacttgtcaaaaaatttacaaaccattgttttttctaatttcctgaacgttttcctatctaaaaaaaaattatttttttaaatttaattttatttttatacgtttttacattttaaaatataaaatttatctttaattttagttagataacaaacctttttaactttatattttaaattttaacaataaaatttctaaaaaaaatataactttttaaatctaatctatttatttttttaatatttaatataaaatactaaaatattatttacttatatatatcttataaattttatatttaaaataaaaaaaggtcttttaaaagaccttctttttatttaacaactatattaacaagctttttaggaacagctattactttaactatagtttttccatcaactaaagcttttattttttcatcattcattgcagcttcttgcatatcttctcttgatatattagcagctacacttaatttacctctaactttaccatttacttgaactacaacttcaacttcatctttaactaatgcagattcatcatattttggccaagatatatcaaatatacttccaacttttcctatcatagcccataactcttctcccatatgtggtgcaaatggagatagtatagtaactatagtttctataccttcttttataactgcatcatttctattttctaactctttgtacttgtacatttcgtttattaattccattaatgcagatatagcagtattaaatccaaatttttcatttaagtcttcagttactttctttaatgtagcatttatagtaaatctcattgctttatcttctttagttaattcacacatagtagcattagatttagctacatcagctaattcatcaactaatctataaactctatttaggaatctaaagcatccttcaacaccttgatctgaccactctaaatctctttctggtggtgcagcaaataatacgaataatctagcagtatcaactccatactctgctattatctcatgaggagatacaacatttcctttagacttactcatcttagctccatcttttaaaaccataccttgagttaataggtttttaaatggctctttaaagtctaacattcccattgaattaaatgctttaacaaagaatcttgagtaaagtaaatgaagtatagcatgttctactccacctatatattggtcaactggcatccagttattaactgcttctttactaaatggttcttcagtatttttaggatctatgtatcttaagtaataccaagaagaatcaacgaaagtatccattgtatctacttctcttctagctggttttccacaacaaggacaagtagtattcataaatgtttttgaagttgtaagtggtgattcccctttacctgtaaattcaacatctgttggtaataatataggtaagttttcttgtttttcaggaactataccacattcatcacagtatactacaggtattgggcatccccagtatctttgtctagaaagtaaccagtctcttaatctatagttaactgttttctttcctcttcccatttcttctaatttttctattattgcatcaaacgcttttgaagcttccattccatcaaactcaccagagtttaccattatattgtcttcatttataacttcaactacgtttaagttgtacttagctgcaaattctccatctctttcatcatgagctggaactgccattacagcacctgttccatagtcaactaatacatagtttgctatccataactcaactttttgtccgtttaatggatttataacatgatttccaataaacattccttctttttctacatcacttgaagttctttctatttcagtcatagtatgcattttagctacaaacttttcaacagcttcttcatactcagttccagcaactaattcttttactaattcgtgttctggagctaaaaccatataagaaactccatgaactgtatctggtctagttgtaaatactgttatagatttatccataccatctatatcgaaagttatttcagcaccagtactttttcctatccagttcttttgcattgttttaactttttctggccatccatctaaagtatctaagtcttgaagtaattcctctgcaaattcagtagttttaaagtaccattgttctaagtcttttttaactactacagagtcacatctttcacaagcaccttgaacaacttgctcatttgctaaaactgtttcacaagatggacaccagtttacgaaagatttcttcttatatgctaaaccattttctaaaaactttaagaatatttgttgagtaaacttgtaatactctggagtagatgttgctatttctctatcccagtcaaagctaagtcctaatgttttaaactgacctctcatatcttctatgttttccatagtccacttatctggatgtattccatgctttatagctgcattttctgctggaagtccgaatgaatcccatcccattggatgtaggacattgtatccttgcatctttttaaatctagctacaacgtcacctatagaatagtttctaacatgtcccatgtgtaattttcctgatggataagggaacatttctaatgcatagtattttggttttgttgtgtcattagtatcagttttgtattgattattttcttcccaagtcttttgccatttagcttcaacttcatttggtttataaacgctcattgtttacctcctatatttttatattaaaaaatcctcgtcactaaacattgctgtttagggacgaggatattactcgcggtaccaccctaattggttatttttataaataaccctcttatattagtctttataccaactacggttaaatagattttacctagcaagttcaaatcaactttatactagttcacaccaaccactagctctctgaaatcaaaatttaattttactactctagtctattttaattttaagttatatttttaaattatataattattatgctaatgtgtcaacatcaacatatggagcatctttccacattttctctaagttatagtatgctctattttcttcattaaatacgtgaaccattatatcaccaaagtctagtaatatccactcttgagtttcgtatccttctttacctcttgattctattcctaacttagtaagttcatcttctacattgtcagctatagcctttacttgtctttgagatccagctgttgctattacaaagtaatcacataagcttgatactgcacctacgtttattatagatatatctttacctaatttatcgtcgatagcatcatatataactttaaccatttgttctactgtcgtcatgttaaattcctaccttccttatttttcgcgtttttatattataccacaaaaaaacatctttctagtactaatttatatcattagtattgacttatttattaaaagttttcattttcttttattatatattactttatgtttatgattattgtgatttattttataaatacttttgatttaaaatataatttctagcttctatagttctaggatgaattatttgatttctatcaattactagttttatagtattatcaaaagattttaataaagcttcatccatttttccatcataaactaaatctctaagttcatctactccgggataatttctgtttacttcgattaaatcagctatatagattattttttttaacatatccatgtttgattttccagttgtatgatatctaacagctgttattatatctatatcttcaattaaaaattcatgtctaactaatactgatcctattatactatgagacaaagctaagttatctttttcatattcatctaagtaaatttcatatttatttacataatagtcaacttgttcttgacttaaatattttgcacaatcatgaagtattcctgctaaatatgctttatttttatcatagccatatatttcgcttaatttaactgcacagtcagctactccttgtgaatgtatcattctatttttaggtaacattttatttaacttattttttatggtttctaaattcaaacttattcatctccatttgtgtatatatttttttcatatatataagtttctacattttcaggaattaaatattttatagatttaccatcctttatatgctttcttatatatgttgacgatatatccaatgagggaacatttacagaccttatattagcattgtatttaatttttaagttttctattttttctttagcttctaaagagcttattccaggcctatttgctgctataaaagttgctaattcaaaattttcagaaacatctttccaactttccatatcacaaatagcatcaaagccagttataaagtatatattagcatttttatattttttatgaagttcttttaatgtatctatagtataagtcctagattctctgtttatttccatatctgaaactgcaaagttatcattgttcattgttgctaataataccatattgtatctatcaattttatttgttcttaattttgacttatgcggtggatttccatttggtataaaaagtatcttatctagattataagtttctcttatatattccgctgttgctaaatgtgcataatgtatagggtcaaaagttcctcccattataccaatttttattttctcatttcccgtttcatgaaaatttgactttaggttgtttatattcctggcttctaaaactaattcatcaattctcattaactatctccttttgtcctttatactactattgtatcattaatttttgcttcttagatacaattattctatattttcctgtataattttgtatatatttagaaacatatttaatgtaaatattatcaatataaaggagatatatatgcctataataactaaaatagaagctcaacaaaaaaatgaaaatagagttaacatatatttaaacgatcaatttttcatgggaatttataaagaattagttttcactttaaatctaaaaaaaggaatggaaatagatgaagaagttttaaaaaatatgctttatgatgaaatgtatataaaagccaaaaacaaagctttaaatattttatctaaagctcctcaatctgaaaaaaacataataaataaactatctagtgattttgatgaagagattatagaagatgtgcttgtatttttaagaaaatataactttgtaaatgacgaagatcttgctcaaagaataactaacactaacttgaaaattaataaatgtggtaaaaacagaattaaacaaaatttatacaacaaaggaatagatagaagtaccatagattctgttgtttcttatattgattcagatgtagaatttgaaaatgcaatgtatttagctaaaaaaagatatgaacgtgttaaaaacgaagatagaaataagatttatcaaaagatatctcaacatttagcttataaaggttttggctatgatattattaaaagagttttaaacaaactacttaattttgatgagtctgattactgctaaactaaaaattacttttacttaatcttttcagcttcattttgtggacatttgtcgaatattattatattatctattagtataaatttttagaaaagaggtgttgcatttgcctaataatgtagctgaatcagtaactaatgaagttgaaagattaagcaatatgccattagataaactaacagaaaattttataagctgggtaacaagttatggaataaaacttataataggccttatagttatattcatagggctaaaagttataaaaaaagtagtaaaacactttactaaattcttagtaaaaaaatctgttgatattacacttacaaagtttttacatgcttttgtagaaatatctttaaaactattattatttataataatacttgggtactgggatgtagaacttacaggatttgctgctttaatagcatctggaggggttgctataggtttagcccttcaaggaagtttatctaactttgccggaggttttataatattattaattaggccttttaaagttggtgattatatagaaacaggtatatatcaaggaacagtagaagaaataggacttttttatactaagcttactactatagataataaattaattttaatacctaacggaactttgtctaatggaagtttagtaaactactctgctaaagcaaaacgaagagtagatttagtttttaacgttagttatgacaatgatataaatcatgttaaaaatgttttaaataatatattaaaaactcaagatcttattttacatgaacctgcccctttcgtaggaatggttgctcatggtccaagttcaatagatttcgctgttagagtttggtgtaattctgagaattattggactatacatgctagtttattagaaaaagttaaaattaaatttgatgaggaaggtataaatataccttaccctcaaatggatgttcatataaaaaataactaataaaaaaactactttaagtggaaatagcaaaaaatccatctaaagtagttttttgtttatcaaaaattactcactatatctaactctatcaattaatgattctttattaaaattcttacttataaaataagttaaaagtaattgtgctataaatacactaacaaccataattaaaatttgagttatcgggaatgtataagttgcatatgaagcccctgtttttctaaatacataaactgcaatatatccaattattgttcctaaagttaatgaactcaaaagcatcgtacctgtataaaacatagcttctatatttaacattttaacaagttgtttatctgttaatcctatagcttgtaacattccaagttctttttttctagttataatacttgttatcatagagtttatcaaattcataaatcctataattcctataattacaactaatgcataacctatacctttggtaacagctatagatagtttattatctttaagtaattcatctatatagttcgcttgaatataatcatcatttttatctaaactttctatatatgacttaatattttcatattcacctttttgagtatatataccaatagttgttgttgtatctgtatcaaacattttatcaaatgcatcataatgcatagcaaatgtagatgggtttgaagttataccttgaactttaaattctttttttatttttttatctccatcatataaggttaaagttgttttatcaccgacttttatccctatttctgttgataattccggctgtgttataagtatttcttctcctgattttaatttttctaaatttatttcaccatcttctaagtaaaattctaaattctttaaatcctcttcattcacactggataaatcatggtatttatactcagtcttatatccatttaattcacatttggcgcttttacttttatctatattagttactccttttatatttaataatttttttataaagttttctcctaaaggattatttttctgtaaaatattcatttcagtatcaggactatcctcttctccatatgtatatccatctaaatctatttttatatcttgtgaaaatcgttccctagtcatcttttctgcatctatactattcataacactagatataacgacaaatattatagcacttaatgaaagtgatattactgttatataagtacgctttttatttctacttaagttagcataggaaagtctatttaagtttatactttcatatccttttctgctttttttattatttttatcttctccattgtatcttacagcttctattatagataccttggatgcttctttcataggcttaagtaatgatatatatatagttattaaacttataatcataactcctataatcataggtaatttaaaagcattcccttcaaacataaatatctttcctataacaaactcatttattaaaaatccaactaaaactcctattggaactcctatcatagataagaaaataccttctttaagaactattgacttaatttgtttttttgtagctcctatagctcttagttttccaaactcttgtactttagttaccaccgataaatgaaatatattatatattactaatatactagacattataactataataccaattacaacaccccacattataacttccatatctggttttaatgagtttatataatcttcattaactaaaactcttgccttaggtatatttaaatctttagctatatcttctactttaagctttagctcatctccacttaagttagcttctgctttaacagtaacgtatgcattaaaattttctttactcatatctcttgtagagttcatatattccttagaaactatcccagaataaatttttttaatctttgacatttcattagatttaattatgccagataaagtaaattcactttctgtaaatcctttattagcataatcttcatattttatttttattttttctccaatttttcctttatatcctaatttttttaacgctaaattatctaatgctatttcactctttaatttaggcataattcctttttcaagttttatactacttaactccatagccttatcatttacatatgataaagctatcttacttttatcatcatagttaatactccctataccatttactaatcctacagcatctatatctgcatgagctttaatttcttcaattttcttttcatccatattaccataaacgccatgttgtgttcctgaatattttataattctctctttattagctttactccagtctaaacatgttaagccaactgatgataataatgtagttgataatattatagtaataataattaatatactttttgacttatttataatcaaattacttttagctattttagtagtattaatcatttatagcaccgtcctttactactttaccatcttcaatatagattactctatcagccatttgtgctatagtttcatcatgtgttatcataactaatgtttgattatatttttttatcatagtttttaacaaactcataacttcatcagaagttttagaatctaagtttccagttggttcatctgcaagtattattgatggtctacttgctaaagcacgagctatagcaactctttgttgttgtcccccagataaagtattaggtaatgactcttttttattttcaagtcctaaagcatttataatatcatttataaagtttttatctacctctttattatcaagacctattggtaaaacaatattttcccatacattaagtgatggtatcaaattataatattgaaaaatgaatcctatttttcttcttctaaatatagctaattgctcatcctttaatgtaaatatatcttttttatctataaaaaccttaccttctgttggtctatcaagccctccaatcatatgaatcaaagtactttttccagaacctgattttccaactattgcaacaaattcaccttcaattatacttatatttgtgtcatcaattgcctttactaaattttctcctttgccataatacttttttaaatttttagtttttaaaatctccataatttaattctccttatctctattctttatactttaataataaaaggtaagtcttacataacactttcatattggcttacacttttgtaagaaataaagaaaatttactaccttgtcctatttttgatgaaacaataatatttccaccttgactttctattatctttctacttaagtaaagtcctacacctaaaccttcaacttcctctactttttcgcttctgtaaaaccttttaaatatattgttaaattcacttttatctatacctataccattatcttttatatcaattcttataaagtttatagtttcttgcaatgaaacttctatttttccgttatcgtgagtatatttaactccattttctaaaatattaaatatactttcctctgtccatttagaatcatgaagtattattttatcttcaaaatcttttacgctaatttttatattttttaaattagcctttcctttgacactatctatagctttagttaaagtttgttttatacttttatcttctttttttatacttatcatactagcttctaacctagatatatttactaaagaatcaattagattatgtagtttatttatagacattttattagttgttaaaaattcaattctatcttcttcatcaagttcttcttctaataataaagaattatatagctttaaagaggctaatggggtttttaattgatgtgatatatctgttactaattcttttatactttctttttctttatttatatttttaattacataatctttatcaactctttgtattttgatattatgtaaatccctttgaagtttatttatcgttgaattattgctacccacatcaagtattataaaatatccataatcatatttacttcttattaaccttccataggcttgttttgcttttatacttaattgaggataattaacatcttcataagataattttttaaaatttcttatggatgaatataatggatcatcaatacttttatttggaagtttatctaatattacacaagttaatccttctccttgtatatcaaccccctcaaaacaacttttagatgctaatactacacattttttacttaaatctcttaatttattgatagaagttttatctttaaaaagctctatattatttatgtttaatttatgaattagtttatcatagaccttatctaatctatttttactagtaaacaaagctagtacatgtccattgctatttatacatattttttctattaaatctgctgtttgatttataaattcatcatttaaagcattatacttaggaaatttatccatagctaatattttagttttactttcataatcatatatagattctattgttctatccatagttttatgtttatttaaacctaatatgtttttaaaattattcatattttatcaatttaaggaattaagagatattaaaaaagatttagaaactagtttaatggataataagtatattcaagataatatatcaaatataaattcaaatattataaacactataaatgacgaattatctaaaagtcatctgattaaagatattaaatttagtttagataaatttaaagataataaatatttagtagatgctagatttgagttaagtagggtaagtgaagattcaattgtaaagtttatgtataaaagtatcaatgataaagagtggactactatagaagctaaagatatgggaggattatcatataaatgtaatttaaaaatagatgtaaataaaccctatgaatataaagttattaaagaagataatgtatccgaaagtagtgatataaaggaattaagcaagtatgattatataccatatcacccatcaattacttatggggaagattatgaaaagtatggtggaagtcttatattaggtgtcaatttagatgaagaatataactatgaaaatgaagaaaataatcataatgttacaaataagaaagatgctataaatggttttaatataaaaagcatagatgctatagttggaattaatggaaaagaaaaaatatataattataaatataaggatgctgtatatagtgaaaatggagagaaactggaatcagaaaattatgaagtgtatataccaaaaaaagattataaaaataatttagaatatataaaaatgaagataacatatgaaaataaagttattgatatagttgatataactaatgaaattgatgaaaaatatataaattaaaaaataataaaggaagtcgaatttatcgacttcctttaaaaatttatttattagcttgtcttgatttattatattttaatctatcgtgctcatttaagaatttttttctaagtcttatagaatctggagttatttcaaccaactcatcatcatctataaattctaaagcttcttctaaagtaaatgttctagcagcttgtaatttaacagcatcatcagtaccagaagcacgaacgttagttaatttcttgttcttacaagggttaactaccatatcatcttttcttgagttcataccgattatcataccttcataaacttcaacacctggatcaacaaacatttgagctctttcacttaaagcattaagtgcataagccattgtagtaccagctccttgagctattaaaactccattagttcttgatggtatttcacctttgtgttcttcatatctttcaaatgatctaactaaagatccttctccacgagtatcatttatgaattcacttctgtatcctaataaacctctagtaggagctataaatgttattttaacataatctccttctatttccatagcttccatcatagcttttcttaagtttaatttatttataacagttcctgagtaagtttctgggcagttaactataactctttccataggttccattaattttccgttttctcttatgaataaaacttctggtttagaaactccaacttcgtatccttcacgtctcatgttttcaagaagtatagataagtgaagttctccacgtccagatactttaaatccatcagtagtatccattggctcaactttaagtccaacattaacttctagttctttgtctaatctatcttttatgtgtctagttgtaacgaatttaccactcttaccagcaaatggtgaatcattaactaagaagttcatagataaagtaggttcttctatgtgtataagttccattggtaatggattatctaagtcacatatagtttctcctatagatatatcaggcataccagctacaactactatatcaccagcataagcttcatctttttcaacttgacgaaggccttcataagctgtaagcttagatattcttcctttagctacagttccatctgctttacatacagatacttgagctccatttttaactgttcctttgtaaactctacctattccaagtctacctacataatcatcatatgcaagagcagaaacttgaagttgtaaaggctcagatgcatagtcagggtaagcttcaacgtgatttactattgtttcgaataatggagataaatcagtactttcatcatccatttcacgcttagctataccttgtttagctataccgtatattattgggaattcacattgttcatcagttgcatttaagtctacgaataagtcaaatacttcatcaacaacttcttcagctctttggtcttgcttgtctattttatttatgaaaagtattggtctaagtccagcttctaaagatttttgtaaaacgaatctagtttgaggcatcggaccttcactagcatctactaataatataactgtatcaacagtttttataacacgttcaacctcagaagagaaatcactatgtcctggtgtatctactatgtttattttatagtctttatagtttatagcacagtttttagagtatattgttatacctctttctttttctaagtcgttgctatccattacacaatctttaactacttcgttctctctgaaaactccagattgagataagaaagcatcaactaatgttgatttaccagcatcgacgtgggcgataacggcaatattaacgattttattcttagttgtcatatcgataatctcctttttttaaaataacttattaagtataccacaccacttttaaattgtaaaatgaattaaatatattcaatcttattatgtcaaaatttatattattaatttaaaaaatatataataatgtaaggaatataattcaagttaagtaaatacaaaaatgataccttaaaataggtatcatttttgtatttactatttaccttcatttttagtatcaagtttaactctaaatatcagtcgctttaatgcactatattcaaatgggataagcgggtataaataacttttgccagtaatagttttatttgtagcaacaagtataaatgaaattattagacctgctataaatccccataaattaaatgcagctgttagaattaacaataaaattctaatgagttttattgaatatccaaggtcgacacttggttgtgaaaaacttccaagagctactatagccatatacaatattgtatgaggtataaaccatccagtttgaacagcaaagtctcctagtattaaagcaccgataacagataatgacattcctaatgaacctggagtattaagtgatgctaattgtaaggcatcaactgaaaattctaaaattaaaaattgtagaaatataggtacattataagggtcttttgggattataaactctagccataacggaaggtgagaagcatatttaactgctagagtatataatggagttatcattaatgtagtaagtaatgtaaaatttctaattaatcttaaataattacctataattactggttgataaaaatcatctacatcttgtaaaaaatcaaatatagtagtaggcaatataatggcattaggtgaattatctataattaacaatattttaccttctaaaacgtgagcagcagctacatctggtctttctgtatatcgagcttttggaaaaggattataccatctagattggactaatgcctcaactatactttgctcactcattaccaatgatttaacttttatttcatctatacatttttttagattttttagagtttttttatctactaatccatctatgtacccaataacgacatcagttttagaccttttacctacattaaacatttcaaatattaaatcaggatcttttactcttcttcttactaatgcagtattaaaaactatagtttcaacaaagccatctttagctccttttagagacttttctttttctggttctcctattccacgaactggataagttctaacatctaaaattattgcttcatcaaatccatctataattatagccattgggcctgataatacttctttagcaatattttttagttcattttccttagatacctctatataaggtatatatttatggataaaatcttttaactcatgaattgacttaaaatcttcactagttattttgaaaaaaccagaaagaattctttccattacttcatcttttataaagccatctataaaaaataagtaacagcttttttcacctattataacttccctttgtattacatcaaaacttttatctaaagggagatgttctttcataagttctacattttttttaatgtttttagttagaatcataaaaacaccctttctaaattaatcagccaataatagtatttacaaaagctctaaatttatgattaataaaaattgaaaggaaataaaaaatagagtatgcctaaagacatactctattgaatgaatctatattaaatatatttaggaaaagtcataaatattgtgaccgttcccccctacaataaattactttttgaatattccaaatggttttccaactggtaaaaattcttttccaaaatgtccgtttagtacagcagctgcagaaccatagaatgagaatatagctattcctaattcagaatatgctgcaaattgatgagtagcatgttccattactccaaatgtagaaagagttaatcctataaataaacaatctataagtacaaatattataaataataccttatgagtttccattgcaccaacagtcataaataatgtaaatattaagtatcctaaaaatgcaaatcctaattgcttaggatcagctgaagcagctaatttttcaccaaatactccattttgtattaaccaagataatcccattgcataccagaaaaatgcataaccaccaaatgcagtagcaccaaatacattattgtgcttgaaatcatttatacaagcaaataattgagcagtagctcctaagaatattgcccatggtaaaactaatgatacatttgaagttaatccaagtttttgagatgaagcaactaatgttatcattgctaatccgaaaagtcctaatgctgaaggatcagcagttacaactttaacttttgtttcgtttgacattttcaatcctcctataattacaaatgataaattattatataatttctaaaaatgtattttgtatgcaaatacgcaatacttatatataatatcatcttttttttaataagtatacaaaaaatttaaaaattataaattttagaactgaaaatatacaaaaaattataataaatttgaaaaaatagatttattgaattatttttaaaatttaaaatttaattgtgtttatatataaatgttgtgggtatattttataatacaaaaatgatttataggaggattttcaaatgataagaatatgtccattttgttcaaatgttaatgttaataaagtaaaagaaatagttggagaagaaaatgttaaaactggttgtataggacaatgtcgtgcttttaaaaaagaagcagtaggttttataaatggggaattagttataaaggaaaatgaagagttatttttaaaagaattagaaaagtaaattttaaaataggctaggtgaatacctagtctattttgttaaataaagatattctgtataaaaatgagtattataaatataaaataaaaaaataattataatagaacaagtgagaactatatattaaaattaaatttatacaaggtaatttttcataaaatgaataaatttaaagggggatatcatgaaagataaatggctaatctgggcaaaaaaacttcaagcaatagctcaatcaggtattaattattcaaaggataagtatgatatagaaagatttgaacaaataagggatttatctgcagagattatgagcgaatatacttatgtcaatactgctaaaataaaagatttattttgtaatgagaaaggatatcaaactcctaaggtagatgttagatgtgctatattcaaagaaaataaaatattattagttaaagaaagtatagataaatgctggtctttaccggggggatgggctgatgtacatttaagtcttaaagaaaatgcaataaaagaagccaaagaagaagctggggttaatataatacctaaaagggtaatagctattcaagatgcatctaaaaataatgaaagattaagtccctatgggatatataaaatatttttattatgtgatttaatagatggatcttttaaagaaaatatagaaactgaagaaagtaaattttttgatatatacaatttacctgacttatctttaaatagaaataataaaaaacaaatccaaatgtgtttcaaagcatttaatgacaaaagttttgacacaatatttgattaaataaatgttaattatttaattaaattaaattttatagtatattttgtgtgaaattaaattgttttgaggtagatttttatttatgctatattaaaatagagttaagatatcaaaatacatatcatattaaatggaggtaaatataatgagtacaatgtattgtcctaaatgtatagttgaagttatggatttagttaagcatgaagaaggaactgatattgagataataaatgagggtctagaaaatgaaactagagaagaatatgaatattttgtagatatatataagtgtcctgtatgtggacatgaagttgaagattatatggaatatgaagaagattaatactagtttgttttaaggttaaaaaatttatagttaataaataatataactgagtttttatttttaagtaagttttcagttatattatttttttatttttaaatctatcaaatttcaaatctaagaaaatatgaaatataaagtgtatatatttttatccatcgtatttatacaaggtaatgtattttgttaattatattccacaatattaaaaaaattttatatgaaattctgatttacaatttaaaataatgctttaaatataattaaagatgttttttagttttaaagatggggaaaaaatttctggtgttaggggcataaagtaaaaattatatacttattttattactatgaatgataatgttttacaatgcatggtaatttgtttgtaaactaaattagttataaattttatttgaaaaagttaacaaaatacatatcattatgggtaggagtatatatgaaagatttaaaaataggtaaaaaattaggaatatcatttattattttgtaatgattacagcattttcaagtttttatgtattacttaatttaaaaaaagcaagtaaacaaagtcatgaattattgaaaggtccttataaagtaacggataaatctatggcaattagaagagacatagtgtctattgatcaaaatgttatgaattcaattgcaggaaataagcctaaagaacatgaaatttcagtacaaaaagattttaatagtattgataaaagtattaaagtattacgtgcaaattcaataggagataaaaagttaattgatgatattgaaaaatctattgcaaatttaaagcaacaaaatggccaaatatataaatttatagataagaggatagaataagagtgcagaacaacttgtaataacagaagatagtgggtattatcaagtatatgttgaaagtgtaaataattcaaaatctatttatgaagataaaacgtcaagaggtattagatttgataaagaaatagaaaatacaacatcaacagcaatgattacttttacaataatttttgttgcttctatattagcaggaatatttatatgtatatatattacaaagagtttaaaaaaacaattgaagaaatagaaatcgctgcaaataaaatgtcagttggtgattatgatattaatattgagtatgaatcaaaagatgaattaggatctttatcagatagtatgcgtaaaatgatacagttcgagttttaggagaagttgcattagtgaatttcaacattgaaccctaagttgagtatatataaatatttaaaaatattgaaaaatcagtgattagaataactgatgatttaagtgagacaatggaagaaataaatgtagcttcagaagaagtaggagcagcatcatatcaagttgcaagtgggtcacaaatgctatcacaaagtgctactgaacaagcaagtgcaattcaagagttatcagaaaatattgtagagatatcaaagaaaatcaaatacactgaaggtaatcctaaagaagctaatgatttaacattaagctcaggacgccaagttaaagatgggaatgatcaaatgaaacaaatggttaatgtaatggatgagatatcacttacatctaatgaaattagtagaattataaaaaaaagatgatatagctttccaaacaaatatcttggctttaaatgctgcagtagaagctgcttaaatcacttattgcaaactttaaattaaaggatataagcgtttctagtaaagcaataaattttagcaataatcatataaattattttgaaattaattaaatttattaaaaaaaataatagacttataaaaagtagaaatggaaattttaatatttccatttctattttttataaaacataaatataacttaaataaacaattactttagtaaatactctttatgtaaaatccaagtgttatattcccatttaaaaacagaaatattatcaaaaaaacaatcaaactcacatggaatacttttaacgtattcatatatatcagtaaagtttttttgtatttttttagaagttatagttacatgaaaaattttatcttttccatcatgattagaaaaatttatataatttattttagacattgcatctattaagttattatgaacagtttgtccttgtgtactcataaaaaccttcatatatataactctatcatcgaaatggtcatatccttttattttataaggagtaattttattattcttacaaaaattttctaatatattatcaagtttagaaatatcatcagtttcaaatggtgattttatagtaaaatgagctggcaactttgatgatttagcagaaaaattttcatacacttcttttctaagcttattgttaaaatctcctgcttttcctttagttactgatactactacatatctcataatatcctcctaaaaatattttttattaataagtatatcaaaatataaaaaatatatttaacttaaataaaatactttaaggtaaaacatgaaaatattactcagtatttaaaacaaaaataagagcaatataattataaagttattaaaattaataactttaatcaaatacttttacttaggaggattaatatgaaaaaaggcatgataccaatagttttaggaaccgcagttacaacagcaggtattgctttagacatgaaacaaaataaaaataataaatttaataaaaatgattataaaaatatggcaggagcacttttattaggagctggagttgctcatatagctcttggaggaatagaaagagctagacattaattttttatataaaaaaataatatattgattagctgtagataaattttattttaaaaatttatctacagctttttatttggaatatataactttgaatatatatataattaagtatgttagtatatttatataactagtgaaattattaggagggggatattttgacttgtagcgttaaaattataaaaaagcaatgtcaaaaaactagtaaatggtctggaggagaagcaactcagttatacatataccctgaaaactcatcgtatgaaaataaaaattttaaatggagagtaagttcagctaaggtagaaatgcaagagtccacatttactaaattacctaatatacaaagaaagttaatggtaattgatggtgaattgattttaaagcataaaaataacagtgaagtaaaattaaataaatttgaagtagataattttagtggtgattgggatactataagctatggtaaagctattgattttaatttgatgaccaatcaagattgtacaggagagttagaatacattaagattaaatcctatatagatataaaagctaaagaaaagctaaatgaaaataattatagatatgaagctcaatctttttatagtttaaatgaagaatttgatatgattttagaatcaggaaaatcattaactgtggaaaaaggagatttagctataataaaatttagaaaaaattcaaaagagaaagttaagctaataaataaactagaaaaagatttagaaattataaaaagtacagtatattattaaaaaatagtagttataagaatataaaattatcttgtaactactatttttattttctataactatttcaattgaagttgtaaaaatattttgatattatgaaatagaaagttaaaaaagggggtatatatggaaaatttaataaaagattttaaatacttaaaggataatttaaataatttaaatagtaaaaatataaatgaattagatctagaaaaaactatgctttttatagtagatatgaataatggatttgctaaaaaaggagcattatattctgatagagtagaagcattaattaatccaatagctaacatagcaagagttttagccaataaaaattgtgaaataatagcatttaccgatagtcatacaaatgattctatagaacttagaagttatcctaaacattgtttagttgatgatattgaaagtgatgttgttgatgaaattaaaaatataaatggaataaaagtaatacctaaaaattctaccaatggctttttctgcttagaagataaggattttaatggtattgaaaatattatagttgttggggattgtacagatatttgcatatatcaatttgtagttacattaaaagcatattttaatcaaaataatattgataaaaatattatagttcctattgaattagtagacacatataatattgataaactacataatgctgagattatgaacactgtatttttaaacagtatgattcaaaatggaatagaagttataaaaaatattgaaatataaaaaattataaataaaattctataataaaaaagtaggtagtttattagtttataaattgcctacttttttatgttatttttaaaattatatatattaaattaaattttgtatattaatagtatataactatagaattattgttaattatagaaaaaaactatataaattgacagaaaatatcaaataatgtaacatttgaatagttgggtatttatagtaaaatattgggaggaaagtaaattgttaaaaagaaaaaaaataatttcattagtaatgacagctacattagctataagtattcttacaggatgtagcaacaaaggaaataaaaatgacaatgcagtacaaccagattcaaaaaatagtatagtatatgcattaacaagttcgcctacaggaatatttaacccactacttaatgatacagtatatgatgatgcagttatatcacttacatacaattctttattaagttttgatgaaaatttaaatccacaaccagaattagctaagagctatgaagtatcagatgataatttaagtataacatttaagttaaaagataatataaagtggaatgatggaaaacctttaacagcagatgatgttgcatttacatttactagtttagcgaataaagattatactggctcaaaatatggagatgttgaaaagctaaaaggagctaaattataccatgaaggaaaagctgataaaattgaaggtatacaagtaatagacaacaatacgattaagttcacttttgaagagccatattcaccaggtcttataaatttaggtggaatgggaataattccaaaacacgtatgggaaaaagtgccggtagcacagtggaaagatcaaaaagacttattaactaaacctgttggaactggaccatatgaagttgtatcatttacagaaggtcaagatgttcagtttaaaaagaataatgattattttaatggagaagtaaaaactgaaaagttcatattaaaagttgctaatgaagatacagcccaagtagaacttttaaatggtacagtagatgttatagatgcatcaaatttaaagaaaaaagatattaaagagttagaatctaaaggtatgaaagttgtatcttatgataataacttaatccaatatatgggattcaatcttagagaaaagaaatttcaagataaaaatgtaagacaagcatttatgtatgcattagatagaaatgcaatggtagataaattattagaaggaaatggtcaagttgtaaatacacctatgttacctagttcatgggcttatccagataagtcaactttaaatgactataagcataatgttgaaaaagcaaaagaacttttaaaggaagctggatatgaagatagagataacaatggtatagttgaagataaaaatggaaaagaattaacagctacattagcttacccaacaggtaattcattaagagaacaaacagctccaataattcaagctaatttaaaagatataggtgttaagttagaacttgaaaatatggaattctctgctcttatggataaagtagtagcaaaccatgattttgatttatacttaatgggtaacaatttaacaatagatccagatccaaaggcatattggcattcaacttctgcatcagatgaaaaaggaaattctgcatggaatatatcatcatttaaaaatgatgaagcagataaattaatagaaaagggtataagcgtattcgataaaaatgaacgtaaagaagtgtattctcaatttggaaaacttctaaatgaagaagtaccttgggcatatttatattctcaaaatataagaaaagcttataatcctcatcttaaaaactataaaccatctatatttaatgactttaacaatgtagaaaattggtatatagattaatatttaataataaaaagttatccttttataggatagcttttttattccatataagtacagaaaggagtttaaaatttggctaaatatatattaaaaagattattaacatcattagttgtattatttgggatttctataataatatttgcacttatacatttacaaccaggaaatccttattcgacaatgatagatccaaatgtttcaccagaagtagtaaaagagatgttacaaaaaataggttattacgatcctatatatataaagtattttaaatggatttcaagggctttaacaggtgatttaggatattcaatttattatggacaaccagtactaaacataataggtacaagaatgtcaaatacagtattgttagcatcattttcattacttttaagcttaatatttggaataggaataggtattttatcagccataaagaaaaataccttatttgatcatattgtaactgtagtttcttttatagggttatcaatacctgcatttttctttgggcttatacttataaaaatattttcatttgatctgaaactattaccagtatcaggtatgaaaactcttggaactgattatacaggaataaaagctgtacttgatacattaaagcatatgatattgccaggtatagtattagcttttttacaaagcactgcatttataaggtatacaagatctgcaatgatagatgtattagataaggaatatataacgacagcaagatcaaagggattaacaataaataaggctatatttaaacatggatttaaaaatgcacttataccgatagttactatattttgtcttcaaataccatttttattctcaggagcgcttttaacagaaactgtatttgtatggccgggtataggaagacttagttatgaagctgttttaaatagagattactctcttataatgggaattcttatgattctttctataataattttactatctaatttacttgctgatatattatatgcaattatagacccaagaattagatatgataaataggaggatataaagaatgagaaaaaataaactgattttaattggaacgagcattttaataacactaattatagcatcttttataggtcctttatttataaaacaggatatatcgtcagttgatttatacaatataagttcacctcctagtggagaacaccttttaggaactgatgatttaggtagagatgtcttagtaagacttttatatggaggaagggtatctttactagtaggtgtatttgcaacaatgctacaggttatgataggaacaatattaggagtgcttgcagggtactttgggggagctatagatgcgataataatgagaattgtagatatagtaatgtgctttccattttttatagttgctatagcactagctgcaattgttgggcctagtgttgtaaatcttataataataattgctattttatcatggacagatatagcaagaattgtaagatcagaagttttatctataaaagaaagagattttataatggcatctaaagctattggatttaataatttagatataattttaaagcatataataccaagtgtattatctagtattttagttgcaacaactttatcaatggctactgctatacttatggaggcatctttaagttttttaggaatgggtgtaaaacctcctatgccaagttggggaaatatgcttacagctgcccaaaacatgagaactttaagtagtgaatggtggttatggataccacctggatttatgataataatgtctgttttagcgataaatttcttgggagaggggcttaggaaaaaactagatcctaaaaggaagtaataggtggtgaaaatatgttacttaatgttaaagatttaaaaataaagtttaaagatgataaacatgataactatacggttaatggtgttaatttaaatataaatgagggcgaaatagtatccttagtaggtgagagtggaagtgggaaaagtttaacttcattagctataattagattgatatctgaaagtgctcaaattgaaggtcaaataaattttcaagggaaaaatttattagatttagatgaaaaagaaatgtgtttaataagaggaaaagatatatcaattatatttcaagaacctatggtagctttaaatccattgtttaatgtggaaaaacaaataggagaagttatattagaacataaaaagataagcaaaaaagaagttaaaaatatggtaatagatttattagaaaaagtaaagatacaaaatcctcaagatgttttaaaaaaatatccacatgaactttcaggtggtatgaggcaaagagttatgatagctatggctatagcattaaagcctaaactgttgatagcagatgagccaacaactgcacttgacgtaacggtacaaaaagaaattttaaatttattaaaagatataagtaaagagtataatatgtcagtaatttttataacacatgatttagacgtggtatcagaaattgctgataaagtgtatgtaatgtatttaggcaaagttgttgaggaagctgatgtatatgaattttttgataatgcaaagcatccatattcacaagggctattattatctagagttggaagtgatttaattaataatagatttttttccataaaaggtaatgttccaactatcgataaaattcctaaaggttgtagctttaacaatagatgtgactattgtatggatatttgtaaaaataatgagcctaagttaaaagaaataggtgataaccataaagtgagttgctttaaaaattttaatatatagaaaggcatatatatggaacaaaagtatattttaaaagtaaaagatcttaaaaaatattaccctataaaaagtaaatctctatttagagaaaagaaatatcaaaaatcagtagatgatgtttctttaaaaataaaaaaagggtctatagttggattagttggtgaaagtggatgtggaaaatcaactttatcaaaatgtatattaaatcttatagatgcaactggaggaagggtagaatttgaagatactgttatatatgatattgaaaataatataagtatatctaaaaaagaaatgctcaatttaaggaaagatatgcaaataatatttcaagatccatattcatcattagatccaaaaatgagtattggaaaaacaatagtagagggaataaaaaagcataatgatattagtacaacagatgcatatctaatggctgaaaaagctttagaagtatgtggtcttgacaagagttatataaatagatatccaaatgaatttagtggaggtcaaagacaaagaatagcaatagctagggtgttagctttaaaacctaaatttataatctgtgatgaaccaacagctgcactagatgtttctatacaatctcaaatactaaatttaatgttagatttaaaagagcaatataacttaacgtatttgtttatatcacataatttaaatgtagttagatgcttttgcgatgagataatagttatgaacaatggaaaaatagtagaacaaggaaatagtcaaagtatatataaaaatcctaaaaatgaatatactaaaaagcttatagattctataccaaaaagtaatccaagattaagaaaatagaaaagactatatatgaattttaataatacaaattcatatatagtctttttatatattaagctgtttgattaatttttataactctcttagctatacttgcagagtggtcagatattctttctaaattagttaacaaatctaagtacataatacctgaatctatgctgcatgaatgactatttaatctattcatatgtttagctctatataatttatctagtgcatctacttcgtcttctattcttaaaacatcatttgcaaatttaacactattttgtttcatagcatctaatgataatgtatatgcatctagtactttgttatatatatctattatttcagatttagcactttctgatattttagttttcttatctatagttgattcagctaattctgctatattttcagataagtctccaactctttctatgtcatttacagtatggaataataaatctagagaaagtctcattttatcatctaaagtcttattagataatttaattagataatctaatacttttctctgctgttcatttaataatttttctttttcaaatgttttgtttgcatcttcttgagacttttcaagtaaagcatccatagaacaagtaaaactttttttcgctttattacccattctaagtatttctcttattgtatttccaaatgctatagatggagtttctaacattctttcatctaaatattttgttatgcgattatcatattcttcttcaccttgcttgtcaggtataagtagcataactaatttaactatatatttagagaaaggtaataatatgataacattagttatattaaataatgaatgagcatttgctatttgtctagcagtatctgttgggtctaaatgtgtaactatcattgatattggcttattaagaactaacataaatagtatagttcctattacattaaaacataaatgcattaatgctgctcttttagcatttttattagcacctacacttgataaaagagatgtagtacaactaccgatgttatctccatataatataggtaatgctccagctaaaggcattaaaccttgagatgataaagctattaatatacccattgatgcacttgaactttgaagacaagtagtcattgcaaaaccagcaagtaatgctaataatggatgattagcaagtcctgctaatatgtttctaaatccttcatattgagataaaggagcaactgcatctttcataaattccatacctataaataagataccaaaacctataagtatttctgagatatttttaagatttggtttagattttgaaccaatcatgtataaaacgatacctattccaagtgctattgatgagaatatactagcatcaaatgatactaactgagctgtaactgtagtaccaatatttgctcccattataacaccaattgcttggaataatgtcattattcctgcgttaacaaatccaactaccattactgtagtagcaccactactttgtatgattcctgtaacaacagctcctactaaaacccccattactacgttactagttaaaagttctatagctttttccaacttaggacctgttgacttttgaagaccttcacccattaggttcattccgtaaaggaaaagtccaagacctccaataagacttatcaatatagacaaaattgtcgcctcctcataaataagttaaatttattatagttatttttattactttttatgtacgataacatattaacagaaaattcgacagcttttgttaaaaacatgttaaattttgaattaatacttatatataagtgttaattcatgtaatgaaatttatgataactatattattgcaaaatatttatgtattattagaattagcatgaaatccaggttttagcaaatatgaaggaaagtaatatgattaaaatttatatctgttaagactatttgacacaacaatttaaatttaaaaaattttcacaaaatatttgttaaaattttttaaataatagcatttaataattgatagtaattacttaaaaattattcaaaatatatagatatatttttggcctatagattgataaaagataagctaatttaaatatacaatattaaaaaaatgtagtttaatatatattataaaggtggttaataaaaattattaggagatgataaggttgaataaggctgtagtaatatcaatagattcgttatttactagagatataaaatatttagaaaaattacctaactttaaaaagatattagatggggcatctatagtaaaagatataaattgtatatacccaacactaacatacccatgtcatacaactatagtaactggagtatatccagacaagcacaatataagtcataatgagaaattagagttaaatgctaaaatgccagattggtattggtatagtaatgatataaaatgtgattctataatagatatagctaagaaaaataatataacaacttctactatattatggccggttacaggtggatgtaattcagatcataatatagctgaaatatggactaaaaatgaaggagaagatccaatagaagtttatacaaatagctgtagtaaacatcttatggaaaaaatatatccaaaatactctcatattataaattggaataaagagccgtacttagatgaatttggagtttgttgtgcagaggatataataaaagaatataagccagatttaatgcttatacatttagcttacttagatcatacaagacatcaatatggactttatcatgaaaaagttattaattcatttaatacttacgataagtggctaggaagaattataaattctttaaaagaagcaagtgtatacgacgaaacaaattttataatacttggagatcatggtcaattagaagttaaaaagttaataagtccaaacatagtatttaaagataaaggattaataagtgtagataaagatggaaaaataactgattataaagctatatttaagtcagctggaatatctagtcatgttatagtaaaagacaaaacttacatagataaagttaaaaatatacttgaagctatgaaagctgatgaaaggtttggtatagaaagtatatttgatagaaatgaattaaaaaataatcacagattagattgtgatgcagactttgttatagagggaaaagaaggcatagcctttagtaatgatgtaactggagaaataacaaaagacactgataatagtaattacaagtattgtttagccactcacgggcaccttcctcacaaaggagataagcctccatttatagctaaaggacctgatataaaagaaaatgtaattataaatggtggaaatttagtagatgaagctccaactataatgaagatatttgatagagacatgaaaaatatagatggatgtgcattcaatatagttaaataattaaaactcttaaggtatgatattatgccttgagagtttttctattttaagaattatcagaatattgttgactattaaattaaatttgttataaaatgtaaatataagaagaatttgaatttttgaaaaattgccaaaggagtgatgaaaatgaataagacgtacaaaaggcaaattaaattattttttgaatttataatgataggtataggagctttaatagtagctatggggttagagctaatattatctcctaatggtatggtagatagtggaactactgctttatctgtaatattaaagtcattaacaggtatacctatgtttatattgttattagcatttaatattccaattttattatttacatcaaagtcatttgatagaatatttttatttaaaactttatgggctaatgtttgttcatcattatttttgtatttattaactccagttccacctgtaactacatctgaatttcttattgtaatatatggaggagtatcaattggcttaggggttggaactgttattaaatttggaggagctatagatggtagcgaaatgcttgctgtatgggcaaataagaattttaaaatccctgtatctacgtttttgatgagcataaatattatagttttagtaataactgctatagtatttagtattgaaagtgctatgttttctttaattatcatatatataatgactaagatagtagatttaatactagatggatttaatcaaggtaggtcggtaatcgttatatcaaataagcatgaagaaattggagaatatcttataaataaactaggaatatcgataacatatttaaatggatatggagggtattcaggcgaaaagtcaaaagtaatactttgtataacagataagcttatgtatccatcattaaaaagaagtattttagatattgataacaattcgataattgaaagtagctatttagctgatagccataatatagaaagaactcctattgaacaaattattagaaaaagaattaagtaattaaatttataaagcctaaacatataatataaaagctgtatagacacttggaaaagtccaagttctatacagtttttttattattcattaacagtatttaattatttaaggattatttaagattgagtttataataaagtaagattgcatccatataatataaacataacaacgaggaaaacaaatggaggtaattatgaataaattagaaattgtaaacttaacaaaatcatatcagcataaaaatgcaaatgagaatataaatttaacattggagagtggagtatatggattacttggacctaatggagcaggaaaaactactttaatgaaacaaatagcaacattaaagcaacctacaagtggaaaaatattatataacggaaaagatataaattcattagatgatgaatacagagcggttgttggatacttaccacaagattttgatgcttataaaaactttagtgcaaaagactttttattatatataggagcattaaagggaatgagtaaaagtgaagctagggaaaaaactgaaaaattattaaaattagtaggacttcaagaagtaaaaaataagtatatatcaaagttttcaggtggtatgaaaagaagagtaggtatagcacaagcacttttaaatgatcctaaaatacttatattagatgagccaacagcaggattagacccgcaagaaagagctagatttagaaatttattatctcaaataggtaaagaaactatagttatattatcaactcatataatatcagatatagaatctgtagctaaagaaactataatgattaaagatggtaaggtattattacaaggaactcacagagaaattttaaatgatatgagtggaaaagtatatagtataacagttaaagatgaaagagaagtatttgatatacaaaataaatataaggttgttagtatacaacgtggtgtagaggatatagaacttagagttataagtgataaaggaataaaagactttaatgcaaaaaatatagaacctagatttgaagacgtttatatgttttattttgatttagaagattctagggaggtataaaaatgacaaatattataaatttagaattaaaaaaaatatttaataaaaaaggattaattatatcttgggtatttgctttattcttaggatatgtaagtgttagaaatttttcggtagcagatagctatgcagatttatttattaaatattatggactagctcctttaatgggaatattaatgtttagtatgttttcaggaagctttgttttagagtatagttctaatatggattctataataaagtctactaaaaatggcaaaaataagttagttttagcaaaatctatagcatatacaatagctgcaagtatagtaaatttatctatattaagtgttatgagttttaagataatatcaggaaataattttaaaggattagatatggctataaaaaatatcggatattttgggaatagtggttcaaatataactgttttacagatgttaatgataacttgtttaactgttatactagggtctttcttctttgcacagcttggactttggttatcatctataagtaataaagcagtattaccatttttcgtaggtggattaataatgggtataccatattttattcacagcaaaataggtggatttactcctttatggggaatgtatagttcagaaattataagatacaaagtaggtatattaggatttgtagtattcataattttaagtactgtaggaagttttgttctttataagcttgcagataaaggattttcaaaagaaagatagataattttatgcaagctatttaggaggaaaaagatgattagatgggaaattaaaaaactatttaaaaataaatcaataataatatcaagtataatacttatacttttatgctctatgatgagttttttaaaaccagatttagaaacagaaaataattattttgataaaaatgggaattatgttcaagataatagagcaaaaaatgtaatagctaatgaaaaactagtaaataaagttacagaacttgaaactctagataaagctaataaaagtaataagttagatgatatgagtaaaaaaatggcaaatatggccagtggaaagcttcaaaaagataatggaaaaaattataaagatataagtttttacaaagtatttaactttagaataaataatgctttttcagggtttgttatagttggtatctgtgtatatattttttctaatatttacacagatgaaaaattatctaatgtagactctataatattatcaggtaagaataaatataaagcattgttttcgaagttatctttagctattatagcacctatatttatatatttagtttatattctagcaattggagttataactagtatacaatatggtaatccaattaatggaagtttacaagcatatagaatagtcgatacatttagtttattaaaacctataactatatatggatacactatggtaaatatattaactatgatgattgtatttgttagtgtgggagtatttgcaagtttattttcttttataacaaataattcagtacaatctatagtatctgtaactgtatttatagtaataggtaaaataatagcgtcacttaaatttttacctgaaaatttattagcagtagttggatgttcaaattatatagatataattatgaatcctcaaatgcttataggaaattatcttggagatataaatgtatttggcaaaagtataggtgtagtaaatgtaggatatataggattaatagttatacttatgataggtattgtttcaaatatatatgtatttaaaaaagttttaaataaataattaaacaaaaacggatgttttatagtcaaatatttttacaatttactataattcattcgttttttattttaatttatttttttatgtaatttgtaaaaaattcatattttggataaaatattaactataaatctaaaaataaaagttatcgactaaatgaatcactaaagataggagattaatatggaaaatacgataaaagaaaaaaatatattattagtagatgatgaagtagatatattaaagttattaagtacggtacttaaaaaagaaggatttaaaaatatatatacagcagaaacaggaaatgaagctttgaaaatatttacaaataaagaaatagatatagtaatactagatataatgttaccagataaagaaggttatgatgtatttaaagaaataagacaaatatctcaagtaccagttttatttttatcagctaaaactgaggaaatggatagagttttaggattagcattaggagcagatgattatatcactaagccgtttagcccaaaagaagtagcgcttagaattaagttgaacttaaagaaaaacataatattaaattctgtaaaggaagagcctaaaagtgataaattagtttttgggccatttgaaatagatgaagaacgcatagaagttaaaaaaaatggagaacctatagtacttaaggcaaaggaatttaaaatgtttttatatatggcaaatcatttagaacaaattataagtaaggaaaaattttgtgatgaagtatggggagaagattttataggatttgataatactataatggtacatataagaagacttagagaaaaaatagaagataacccgtcaaaacctaagtatataaaaaatattaaagggttagggtacaaactaactttaaaggaagattaatatgaaatggaaaataacttttaaatatatagtaagtattatatgtgtagttatgatagttactatattaaatatatctgggataataggaggttttatttttaataaaattaatgatataaaaaaaccagaagataaatttaccagagattttagtaattatatacagattaaagataataatgtagtagtagataaagaaggtaaacatatactagataaagagcatatatggatacagatattagatgaaaactcaaatgaaatatataggtataatgcaccagagaaacttaacaaaaagcatactcccgcagagcttataaatgggtataaatatgctggagggtttaagtatacggatgcagataatatattagtttctagtaaaattatagataataaagagtacacttatatactaggatttgatagaaattccttacaaaaatatatacttacagttaatccaacagatttagccaataccgttattaaaataatatggattatattatttatagatttaataatagcattaatatttggatatttatttagtaaaaggcttacaaaacctatgaaaaatataatagaaggtgtcgagaacctagaagaaggaaaatatgatatatattataaagaaaaaggattatatcaaagtgtatacaataagttaaataagttagcagatactttaaaaagtaatgaagcccaaagaaataaattagataagttaaaacaggaatggatagcaaatatatcacatgatataaaaacacctttatcatctataaaaggatatgcagaacttttaagtgatagtgattatgaaatagatagtgaagaagtcaaagattatggattaataataaatcagaaatcagagtatattaaaggattagttgacgatttaaatttaactatgaaattaaaaagtagtgatagagtattaaataaaaatgaagaaaatatagttaggataattaaagattctataattcaaattctcaatgatcctaaatactcaaatagagatattgaatttattacaaataaagatgttataaaaaaacaagttgatgctaatctttttaagagagttataaataatcttgtttataatgctttgatacataaccatgaagatgttagtataatagtaagtatagattataaaagtgataacgaaattattatatctgttaaagataatggtaaaggaattagtaaggatgatttagagcgtatatttgatagatattacaggggtacaaatacaggagaaactcataaaggctcaggacttggaatggctatagcgaaggaaattatagtcgctcacggatttgacataggcataactagtgaacttggagctggaacaactgtttttataaatataaattaatagtagataatcataaaagggtatatcctaaagcttaggatataccctgaaaatatatcaaaaactatctacaacatttacagcaatgtctacaacatccacatcttcgacaaattttaaagcagaaaaaacatctgccacatcttttacaacgacagcaaaaaaatgatctattattcataaaattcctcctttataacatacaaagaataaacattctttatatattatatttactacgacaaaatttgtgcaggaaataaaaaatttgacaaaatacattaaacagtgtcaaaaaagttgttagcttcatagtatagtgtatggatattaaaatccataaataatataagggagctgattttatgggatgtaataatcataaatcctgtaataaatcaaatagcaatataaaatgttgtcattgtcattttcattgcaactgcaataataattcagcgaatgaatgcagaaaatttcctacatgcccaaataaaaacaatagagaagatatatataaatatttaggtaaatatttatataatttactagaagaaatagatttaccatgtgatcatcaaggattagatgaaagtataagaatattagctgaaggtggatctttaccatgtggacatcctagtctagaagagttaatattaatggcattgtttggtgataaagaaaatttttgtgaatattgctttaaaaaatgctgtagatagtaaaaatattatgaaagtatgaaccattaacctcctattgtcgtaatatatatcaaagcttcaaatttaattgacagtaggaggtttatattataatggataaaaattttgatataaatagagaaccaaatggagttatagtatatccgccgtggatggaggattttataaagcattattttccacaaaatccggggaaaccacaaaagccaaatgaagataatgataaactaaaagttaatataaaatctatagtagaagatgaatttgtagtagttggagatgatgactatctttatgcaacaggtagaaaagttaatcaaaatggaatatttagaataataatgctagatgataatgaggttaaaatacgacaagcaggtggagattttataagagttgataatagagattttttagtttcagatactgatagaaaaggtgctactaagtttaaaatgtataaaatagctgataaagaatatgtattacaagcacctaatgggtattatgtaagagtaagagacaatgacaagagacttgttgctagagctgaaaatcctggaaatagaactagatttaaatttagagaagttaaataatataaaaaaacaaatcctagaaataggatttgtttttttatgtaaggcttatttaaagtttaaataagcttagcttaaagatttattgattaaaaatagtatattgtaaaaagtgattaatttaattgtgtatattaaaattttgtatgaatgtacaaaaataaattaagtaaaaataaaattaaatttattattattataaatttgattatatggatatgaaatgtaaaaaaaggaaaaaatttactgtaaattcaaaatattgacacttatattaataatgtgataatttaagatgtatttaaataaatactaactaattgatacttaacatcattaatgtcattacaacaacaaaaacaatcaaattatttaccaggaaatattttaaatgttgttgaaaatttatatttctaatcatattgtaattttcatcatatccatatttttttaaaatattttgccctatattttcatattcttcactttcactataaacgctttttactatatctgattcagattgaggatacttgtttactaatttcccaactattcgtttatttatattttgttgttctaagtatatatttttcaagtttttatattggaatatggaaaatgctccaaatattaatattactcctataatagctattaaaaaaattctccttattataggttctctttttaataactctatcatttttttatacacctcttttcaaaggtatatccaatgcctctaatattttttatatactctggatttgacggattttcttcaactttttgtcttagtcttcttatattaactgctattgtattttcatctacgaaatttccatcaatatcccaaagagcttctataagttgttcttttgtaacaatttgacatgaattttccattaaatacttaagtaatttaccttcatttttactaagtattatttcattgctaccttttgtaattttaccatccaaataattataaattaaattatcacaataaatttgattttcatttgtgaaatcacttattcttttcataactgcattaacttttgatattaaaactatcaaactaaatggttttgttatataatcatcagctccaacttcataacctgtaactatatctacttcttgatctagagctgttaacattattatatgtacattacttatacgtcttatatactcacaaaattcaaatccatctccatctggtagtcctatatctgatattattaaatttattttattacttttaaatatttctttagcttcttttatattaaaggcattaaaaactttatagccttcttttttcaacttaaagcttattcccctatttaaagatttatcatcttctaaaagcagtatatttcccataattacctccccaattcatataatatattttactacataaataacccctagataacatttcgttacccaggggtataattattttaatatatattttaatttattatttagatacatttccagctacatttaatatgtcccaagttctagcaaatggtggtgcataacataaatctagcatacctaattggtttgtagttaatttaccaaacacacaagcagctattacattagctctttgaacagcatctttaaatcctgctacttgtccacctagtataactttagtatctgcatcatatacaagttttacatacatcttatttctacctggatagtaattagtttggttaaagtcagatataaacttagctttaacattcattcctaacttagctgcttgagattctgtaattcctgttgcagcagcttccatatccataacttttatacaacttgaacttaaagacccttggaaactaatattagctccagctaagttttctccaactattcttcctaacttattagctcctgttgcaagtggaacatatgaatcttgtccagttactatattttttatagtagcacaatctccggcagcatatatatcttctacagaagtttttccaaactcatcaactattatagccccattttttaacatgtctatattagtatcttttaaaaatgcagtatttggtctaacaccagtagcaactataactaaatcagcttcatattcccctttattagttattactttttctactttagtttctccaactaattcgctaactatttcttctaaacgtaaatcaacattatgatttcttatttcttcttctaatatatcagttatctctttatcaaatacttgaggtaatattctatcttctaattggaatactactacatctttgcctaattttttagcagcttccacagcttcaagtcctataaatccagcacctattatagctaccttttttatatcttctttgttcattaattcttttatttttataccatcttctaagctttttaatgtagatacattttcaagtttaacatttttaataggaggtattatgctactagctcctgttgctatcattaacttatcgtagttatctataaattcttcccctgtatttacatttttaacttttaattctttagattcagtatcaacatctactacttcatggaatatatttagatcaattccactttctctaaatttttcaggtgctcttgctatcatattgttagggtcatcaaaaaatccgcctacaaaatacggaagcccacaagctccaaatgatactacatcagttttttcataaaccacaacttcataatctggtttcattctttttagttttgcagcggcactcatacctgcagctaccccaccaactattataactctcatattttttctccttaaaagtactatattttgaatgtatttttattttcaatattaaaataaattatatagtatatcgtttacccatttctcaaaatatattaccatattttaattgttttttctacttgttttgaaattttgaaatatttattcaatattattttaatataataataatttaaataaaaaaaagatgccatataatttttagggcatctttttatatctatctagcagatctctttgttggttttccttttttagttaccttgtcacttgcttttttcgcttttgcttgctcatgacctgggaatattatcttaggattttctgagtttctcttgtatatagtaaacttaaatcctatagcttgaacaaattctgctcttaaagcttcacatatagcatttgcagtttctttcgcatctaatcctgcattttctaatatagaaactttaactatttctctagcttttaacatatcttctaattgatctaagaaactttcagtaacaccttctttacctatttgagttataggctttaaagtgttagctatagatcttaaatatgctctttgctttccttttaacatgtgtccacctctttacgtcttaaattaattttaattatagaactcaaattctatgtcgtatatcttaacagtgtctccatcttctatgcccatttctcttagcttatcaaatacaccttgagattccatagatttttggaagaactgaacagattccatatcttcaaagttaacagagtacattattcttcttaatgctttaccagtaacaacatatactccatcttctatttctacttctaatccttcttcaacttcttcaactaattctggtctatacatttcttcttctgatactaactctacatcttcaacttcttttaataattgagaaacgtaagctataacatcatctacaccttgtcttgttgcagcagacatcttaaatactttatatcctcttgactctaactcatttttaaagttttcaaagttactttcatcttccattatatctattttgttagcaacaacaacttgtggtctagttgataatttttcattatataactttaattcatcatttattttatcaaagtcttctaaagcatctctaccttctatacctgatatatcaactatgtgtattaatactttagttctttcaacgtgtcttaagaaatcatgtcctaaaccaataccttcagcagcaccttctataagccctggtatatcagcaagaacaaaactatctccaaacttagtttgaacaacacctaaattcggcgttaaagttgtgaagtggtagttagctatctttggtttagctttagttacaactgataagaatgttgattttcctacattagggaatcctagtaatccaacatctgctatcatttttaactctagcgttatccatttttcttctccatcagttcctgattttgcaaatgcaggagcttgtcttattgcgtttgcaaaatgttggtttcctcttccgcctcttccaccttttgcaactatagcttcatctccgtcttcttttaagtcagctattacaagacctgtagcttcgtctcttattattgttcctggaggaactaataatactaagtcttcaccatttttaccagcttgtcttttcttagttccatctccacctgatggtgcagaatatttagtttggtatttaaaatccattaaagttcttaaccctgaatcaaccttaaatattatacttcctccacggcctccgtctccaccgtctggacctcctgctggaacatatttttcttttctaaaagatactgatccgttaccaccatttccagctttaacaaatatcctagccttatctataaacataattattcaccttctttttttaaagctttttatttatatttgccataatctataatataaattccatgcgcgctatatttcaaactaaattaatactaaaaaaatatttaatattaattattatatttaaaaaaggagtgtatgaacactcctttttttagtatattactcagcaactgggtatacacttactttctttcttttcttgtcttttctttcgaatttaacagcaccgtcaactaatgcaaataaagtgtcatctccacctttacctacgttagttcctggatgtattttagttcctctttgtctaactattatacttccagcagttacaacttgcccgtcgaatctcttaacacctaatctcttagatatagaatctctaccgttcttagaagatcctacccctttcttagatgcaagtaattgtaagttcatttttaacattctggagtcacctcctacttttttagaatttttatattttttgggtattcccttttaatttcattaattgctaattgaagatgttgtaataataattgagcttcatctagatatttatctttgacaatacactcaatatgaccttcttggcctattactttttcaaattcaattttcttaagtacacttaaagaatttataactgataaagcattggatgtaacagctgcacatacaatatcagaacctagttctgcgtaatcagcatgtcccttaagacaaaaacctttaagcttaaagtcgtcgttttgataatatttaacctttatcatggctcttacaattaagcgtttattttttcaactactaacttagtgtaagcttgacgatgtccgttctttcttctgtagtctttcttagctttatacttgaaaactataactttcttagcttttccttgctcagcaactttagcagttacagatgcaccttcaacagtaggagctcctactactaagtttccatctttagaacaagctaatacttcgtttaaagtaactacatcaccttcgttagcttctaacttttctacgaagattacatcaccttcagcaactttatattgctttcctccagttttaactatagcgtacattaaatacacctcctcggtctcaaactcgccaatcaaaggtactcatttaagagattttcagacctttattgagcggcactacatttataaataatactataatttatagtttgtgtcaactaactattaaaaataatattcattttttcatgatctatttctgtttttttgcttaaacatatttttatattatattttcgacttatactatctattttttgcttatggtttttgttaatatcttcaaaaactttatcatttaactctatttctacttgattgtaagaggtatgttctttaactctcataacttctttttctatttcatctattaatctatttatagattttatactttctccatttttacaagtatagcaagacttaagataataactatctattgaatctttttctcttcttcttgctatttcaactaaacctaactttgtaattcccataacattagtttttcttttgtctttagatgtttctttatttaaattatcaataagatttttcttatactcatttttttgcatatctataaaatctacaattataattcctgccatatctctaattcttaaaagtcttgaaatttcaagtgcagcttctaaattagttttataaacagtttcttctaaattagaattccctgtaaattttccagtattaacatctataactgtaagagcttctgttttatctataattaaatagcctccactttttaaccacactttcctacttaagcacttatctatttgactttgaacagaatataaatcaaatacatctttattattttctaaaatcaacttacttttataatctttatttatatttaataaaataacttttaactcttcatatttttctttattattaacaatgattttttctacactatcatttacattatcttttacatatttagatgcaaagtctaaatccttatataaaagttttggtccaatacctagtttaaattctcttaaaacatactcatgcttatgttttaaattttctatatctttttcaagctcttccctagaacaaccaacagcttcagttcttataattcctgtaaagtttttatctatatcttgaacaattttctttatcctaaatctctctttttcagactttatcttattagaaatagtcaatctatcatttgatggaataaaaactaaatacctacctgcaaaactaatttctgtattaagcttagctcccttagttcctattgcttctttattaatctgaactaaaatatcttgcccacacttaacactttcattactcttcatactaagataagccaatttatcagttcctatatcaacaaaataagcctctatcccctttaaagcctttttaactactcctctataaatattagaaacagtttttatattagaactatcctctataaaaagctcacttaatttaccatcctctaaaacagccaccttctgagaagtgactaacgactctataacaatacttttcaaaaaaacttcacttcctcttctctttctctatttttttgacaatgtccacaacttttatatctatcaaaaggcgaaggtgttgttgtaattgttgacttaacacttacgtacgtagtacgtcctgtgaagaaagcaatcacaccaatactaagccacccccgataccagaaaaagaggtggacatccacctctttcctacattggagttactaattctccatctttaactatatataattctcttcttaatatatcaacatctaaaggatctatatctaaaccaaaagcttctaacatcttaggtataaatatattagtatttaagtttgctttagagccagtagacatagtagcttctaaagttataactttatcttcaacatctataacatcaaaagtctttagcataggtcttatatcaacttctactgttttaccttttttgtttttctttgttattaatatttgttcttgattcattaaatctgatactttagtttttacaaattccttagataattctttatctacttctaaagtaaacatgtattcaccatattcgatagtagatgctaatgaaggaacttctttagttatttccttagcttttataaactctataccttctggcatagtagcatttattttagttaaaaattcatcagctgttaaatcatcttctatctcaacgtctaaatactccccttgactttctgttccaagagctagagcatgtccataactcatcttagggtgggggttaaacccttgagaatatgataattgtatttcagctcttctaaaagctctttgtaataatctttgtaaatcaagatgtgatatatatatcatatcattttcttttttaaacttacatcttattattttactcattagcacattccccttcctatagtatgtgtatttattccacaaccattacatttatgtctacagtcaacagttatagcatcttgttttgacttttcattttctcttattaagaattttttattaacacctacatctaaatgatcccatgggaatacttcttcataatctctttctctatttgcataaaatgctatatcaagattattatttttcatagcttcttcccatatttctaatttaaagtgttcagcccatccatcaaacttagctccagctttatatgcatcatatataaccttgcttagttttctatctcctctagctataacagcttccattaaactagttttagaatcatggtagttatattttatatttccattttttaatttcttaactaaatatctttgtttttctcttacttgttcagtagtatcttgtccatgccattggaatggtgtaaatggtttaggaacaaaagttgaagtacttacagttactccaaatgctcttcttaactttccaccattaacatctctgtatatatctataactttatacgcaaggtcagctataccatctaaatcatcatatgtctctgttggaagtcctatcataaagtataacttaacactattccatcccatttcaaatgcttttcttgtagcatcttctaagttttgttctgttacacctttatttataacatctctcattctttgagttcctgcttctggtgcaaatgtaagacctgattttcttacttgttgtattttttcagctatttccatagagaagttatctagtctaagtgatggtaatgatataccaatgtttctagatgcatattcttcaactaagtaatcagtaagttctgataacccactataatcacttgtacttagtgaagaaagtgatatttcatcatacccagtattcttaactaatttttcaagtatctcttttaatctacctaaacttttttctcttattggtctatatatcatacctgcttgacagaatctacaacctcttgtacatcctctaaataattctagtactattctatcatgaacagtatctataaatggaactattagtttttctggatattctactaaatccatattctttattattctcttatgaggattagctggtactccttctctattcggttttacttcttttatagtaccatcttcattataagctacatcataaaacttaggtatatataccccttctatgctagctatatccattaaaaactcgtctcttgtagttttatttttcttccactgtttatatctattaattacttctaagttaacttcttcaccttcacctaaaataactatatcaacaaaatcagctattggctctggattatatgcacatggtcctccaactaatataaaaggagcatctaactttctatctttagctaatatttcaacctttgctaaatctaacatatttaatatgttagtataagataattcatattgaagtgtaaaagctaaaaaatcaaaattagttatagcttctcttgattctaatgcaaataaaggaatattgttttcgcgcattttttcttccatatctacattaggagcatatactctttcacaaaatacttcttcatctttatttataacatcgtataatatatgactacctaaatgactcatacctacctcataaagatcagggaaacagtgagcatatcttattaggttttcatttgatatatctttatgtattgaattaacttcattacctaaatatctagcaggtttttcaaccttttttagaatcctttttaagtctacttttttattcataaaaaacctccgtaagtttatttcattctataaacataaatattattatacacgatatactaagatgtatcaaaatataattacctataatatttgtaaattaacaattattctattcaaaacgttcacattttttgttaatataataattgaggtaaaaaatttaaagaatttttaaacttttttgtatacaaaatgtttcaaagttttatttatgggtatattttaagtataattacgtatttattaaccacgttttaggaggattttcttatgaaagaagcttttgaaattaaaaaagatatttattggactggtgttatagataaagacttaaaaatctttgacatcataatggaaactgaatttggtacaacttataatgcttactttatagatgatgaaaagaaagtattatttgatactgtaaaaccaaattttaaagacgaatttattgaaaaattatcaaaattaacaaacataaaggatttagattatgttgttatacatcatactgagccagatcatgctggaagtttaaagtatatacttgatataaatccagatgtagaggttatttgtactaatgcagctaaaatgtatttagcagagcaagtaaatagaccttttaaatgtcatgtaataaaagatggtgaaactttaaatataggtaaaagaactttaaaattcatatctgcaccatttttacactgggcagacacaatgtttacttatatagaagaagataaaactttacttacttgtgatgcttttggatgtcactttgcaagtgttgaccctgaagttgtaaatagtgaagattatttaaaatcatctaaacactactttgattgtatagttaaaccattctctaaacatgtactaaaagctgtaaataaagttgtagaattaggattagattttgatactatattaacttctcatggtcctatattatcacttgaccctatggctcaagttaaaagatatgtagattggtctactgaaacagttaactctactaatcaagatcaagtagctatattattcttatcagcttatactaatactaaagttatggccgaaaaaatatatgatggtatagtatctactggtgaatctgcagctttatatgatatagaaaatatggatttagcagaacttcacgacgttatggttatgtcaaaaggtatactatttggttctccaacaataaatagaactatggttaaacctatgtgggatgcattttctttaatagatcctatggctaaccaaggtaagtttgctggagtatttggttcttatggatggagtggtgaaggtataacaatggctgagatgcttgttaagagcatgggattcaaaatgcctgttgaaacacttaagaaaaaattcttcccaagtgatgaaacattacaagaatgctttgatttcggtgtaaaattcgctgaagcaattaaataaatataaataaaaaagctatctctaatgagatagcttttttatttatatacgttgagttttagtctttctaatttccctccaagaaagttctcctctgtctaatgccttaataaaaatttctgctgaagcaagatttgtagcaataggtacatgatatacatcacaaagtctaattaatgcttgtatatctggttcatgagcttgagctgtcattggatctcttagaaaaattaccaagtcaatttcttgagaaacgactaaagaaccaatttgttggtctcccccaagtggtccagatgccaatcttttaattttaagttttgtttcatcttcaattctttttccagtagttccagttgcatataacccatagtttttaagtatatgctcatagcctatacaaaatccaaccatagtatttttcatttcatcatgtgctattaatgctatattcatttaagtcacccctaatatattagaaatttattttctttcttctcatacctacatttaaaactaatcctaagttagctaatgatgtcatcaatgaacttcctccataactaacaaacggaagagttactcctgtaactggtatagcagctacagtcattcctatattttgtatgatttgatatgcaaacatactcattactccaattataatcaaggttccataaaaatctttagcttctcgtgccatagaaatcattcttattaaaaataatgcataaagaaccattataacaagcattcctacaagacctagttcttcacctataacagcaaatataaagtcactgtcttgaacaggtaagaagtcattttgattttgagtaccttcatataatcctttacctgttagtccacctgatcctatagctatcatagattgcataacttgatagttaccaggcaatgaaacattttctggatttaaaaatgcatctattcttattctttggtgatttgccataagcatatacatcaaaggcatagctacaactattactataatagtatttcttattattttactattaagtcctgctgtaaataacattcctcctattatgcagcaaaatactattgcagtacctaaatctggttgtataagtaataataatattataggtgctgcatataatccaagtggaattaaatcctttatagtatttaatttcccctttttttcttcaactaactttgcataacttagtataaatgttaatttaacaagttcagatgtttgaaaatcaagaggaccaaggttaagccaagatctagctccacccatatccttaccaagtccaggtatccatactagtaaaagtaatattatactaactatatataatcctttataatgctttcctaaaaaattgtaatcaaacaataatataactattacaagtgccattcctacaataaaagctataccttgcttaattatttgtaaataacttccccctgtagtcgcgtgagtagcactacttaatatcataagcccaaaagcaaatatacatgtaactatagttataagtttccaatcaagttcctttattaatttaaatttcgatttataatcaaacacttcatcaccatctttcttattaaggccatacctaagtcgtataattttgtattaatacaaaaaggggcttggctaatacgcctcccccttttacctacttctttcttttatattctttaatggtatattagcaactaatgctgataccggaccatcttcttcatcacttctagatttagccatctttatttccaatccgtcttcttctatctcagcataatttgcaataacttttaatatatctgatttaatcagatctagaagttgtggagaacagtctattctatcatgcactaaaactaatttaagcctttctttagccacatttttactagttttagactcattagaaaatatcttaaacaaatctaacataagtatatccccctttattacttagccattccaaacatcttcttaatcttagttaatatattagtttcattttctatttgcattagaggtatatcttctccaagtattctcttagcaatatttttatatgcttgacctgcatttgatcttgaatctaatatagctggctcacctttatttgtagaaacaattatactttcatcatcaggaactaacccaattaaatctatagcaagtatctcaactatatcttgcttgtccatcatatctccacgtttaaccatttcatttctaattctatttataactaaacgtatatctttaacttcattagcttctagtaatcctattattctatctgcatctctaacagcagatatttcaggattagttacaactatagctctgtcagctcctgctacagcatttttaaatccttgttcaatccctgcagggcaatctattattatataatcaaatgactctcttaatttatcacataaatttttcatttgttctacagaaattgcatttttatctctagtttgtgctgctggtaataagtataaattgtcaaatcttttatcttttattagagcttgttttaatctacaagttccttctacaacatcaacaatatcatatactattctattttctagtcccataacaacatctaaatttctaagacctatatctgcatccactacaacagtttttttattttctaaacttaaggccgttcctaaatttgctgttgttgtagtttttccaactccaccttttcctgatgttataactataacttcactcatagtactaccccctcctactcaataatttatttattttttggcaaataattttctataacaatcatttcattacttgtaaatgctatttctggatttatatcatcacttttcatatattcttcatctggagcttctgctatatagttagctatttttaaaaccataggatttaaattattagcaactatataagcatttttatttccttttgctcctgcatgtataaatccttctactttgcccataacaactacattaccatatgaaaccactttagctccaggttttatatttcccattacaactacacttcctgttgccataaccttacagcccggcttcatatcagtcataacaactacatctccttcaaattcaacattatctccagaacgcatattgtttatatacttagtttcataaactccaaatggtacctgaatttcttcctctataaattcaatatcaaatctagaggttatgtcttctttaagttgaagtaattgtatatcgcttaaatgattataatttatagagtaaattttagctccattgaaaaaacctacagaggattctattttatctattatgctttgtcttatttcttcaaaagaagcttttttctttacatttacaactatgcctcttttatttcctttgaactctattagttcttcattggttgctgctttaaaagacattttatacctccaaagctctatctcattttatatattcttcaaaaaaacttcaaatccttttatttttttaactgtgatacaaaattcatttcattatcttcttttgattttacaagttctgcttctttatttgaatcttcagcttgatttttattttctttatctttttccttatcttttgttaatccaaaatattcacccattacttctcttataggtaacaaagcaagactacttgagtttccttgaggtaaaacagtaactacggctatttctggatcatttgctggagcaaatgctgccgcccaggcaaaagatgcataatcttgtttgaatctatctatatcttcatcttttatcttaggatttaattctttaattgcttttcttaaatatctagcttttgtactttcgctattgtctggaacaaattctgctttatctttttcatcttttccaaataagcctttactttctttctctttttgttccttttcaaattcttttttagctttttcatcgtcttcttttttcatcttattagctaattttacagcttcctctttagatactccatatgaacctatatggtctaataagtatttatactcatctgcagtaggtattttaccacttttttctgcagttcctgtttttgctgcaacctcaacagggaagttaccaaatatacttttacctgtaccttgagtagaaacaagtctcatacctttagttaaatctttaagtttttcactatttttaaatggtatcttttctactttgttttcatctatatctatattcatatagtcgctagatatagttttatctactacagatgcttctactaaattccctccattagctatagctgcaatatatctagccatctgagcaggagtataagcattctcaccttgtccaatcgctaagttgaatgtatctgcatcagtccagttaccaaagttaaagtaattaaatttagctaaatctgcaatttcagtaactttatcttcttttacatgaagcttttctaatctcttcatagtttctgttcttgatggattttctttagtccaacttacaatttcatttattctctttttatactcttctgggtcttttgctttagttatatcagtaaatgcatctctcatagctttatctaaagctaatctaagagaattttcagtgtttttaagtttatcagtttggttaggaacttttcctttactttcaccaatttccttatcaagacctgtattatcatttaaaccaaataatcttgcatattctagtatatctttggcaccaatcttgacattaggatcatttcctcctaaccagtttttacctgtgccaattgtatagaagtatatattacaagactcttgtaatgctttgtataaattagtgtatccatgatttcctcttccgtgatgccatacataatcggcaaaaggtctttttcccatataaattacaccagtatcatttataccataatttggatttagtccattatctaaagctgccataccagttaccattttaaatgtagaacctggctggaatgctcctcttgtaactaagttacttaaaggatttgcacctaaaacatcattaggatttttaggctttaatttttcatagtcctcagatgatattccagttgcgaataagttagggtcatagtctggataactagacattgctaatatgtctccagttttaacatctataacaactgtagctcctgattccaaattaggtgctgcctttcctgatgcactataatctccaaatttacttttaaaagtacctccacttcttccggccttaactactctagccaatgagtcatctgatactttttgtagatctttatctaagctaagatatacagtatctcctgaaacaggtgcagaagatgcaagttctttacttactcttcctactgagtctacctcaacttttttatatccatctttcccttttaatttatcctcataaaacttctctatcccagtctttcctactatatcatttttagtatatccactttctccattttcttgtttttgggctaactcttgttctgatattctacccatagttccaagtacatgtgatgcaagattcttatcagggtagtctcttactggctctactgctatagatactcctggtaattgcatagccctttcttctatttgagatatggtatcttgtgttatatcttttgctatagttactggtttatattgaacaaaaccttgagatttaagtaagtctcttacaatcattatacttctagcatcatcattagataaattgctaggtattttgtaatattttcttacatctttaaaagcatcttttgcattagtgtttatattatctattttataagattttaaccagtcttctttatttctttgctctgtaaacttccaatcttttactaaaattggaggatatatacctgctgaatttaacttcttttggatttcctctggctttaagtctctaacagatgcatctattttatgctcttctatagccttatcgaccatataataaaaactttgtttagcattgtaatctagtggaattttattttccaatttaaattcccttatttttttatcaaatgtgtaaaaatattttccattttcaacatatatagggaattcatctaaatattcttccttattctttttcaataagtttattaattctaatgaaatttcattagctcttgattttccagatttatcttttttctctattccatccttagatatatgaactgtaaaagagtttctatttgtagctatagtacgtccatatctatcttttatttcacctcttggtgcttttacaggtatttctttatatgttttattttttgctaattcattataatgctcatgtttaaatgttgtcatataagcaatttttaaaaaaattgcacataatgccactactactataaacttgattatatcaagcctatcaaacttttttttctccatttaatcaccactaatctttttttagtttaaggattgaatccttaaatacaaaataaaaaattaaacttcctatactattaacaagtggtattgtgcagataccttttataaaaatagttaagatatcatatgtttgatatacgcttcctaaaagaattatatttacaatagaatctattaaacttgatataaaaactaaagcaaaaatagttatataactatttttatatattttatcttttagattacttattccatatgctactacagctaatactaatgcattaactccaaataaactacccatagcgatatctttaacaaaacctaggagtattgctaaaatacttgcttctacatcctctaaatataatgatattatagttatataaataagaagaaggttaatgctaacccctaagaaatctacgtagttagttatacttccttctattataactattaaaatacctataagaaaaagtaatattcttttcatttgtagttctccttttaatttatatttcttggttcaataactacaacatcatcaacgtctttgaaattaacgtatggctttacaactacgtattttaagcctttgtttttatcatcaacaactttttctatttctcctataggtattgacttaggatatattcctaaaccagatgtcactaaaacatcaccaggaagtacatcataagaagtcttaaacatatatccttctaataaaccttttgctttataattttcatcttcatttgcaccttggcttattacacctttaaattctttattttttagtaattggaaactaactgacgatttagtatctaataaagatattgctttactgtaatgatttgaaacctcagtaacaattcctactaatccttttccattcattacaatactattttttttgacaccttcgtcttttccagcacctattacgaaagatgtataccaatttccatcatttttgcttacaacttcagtgctaatcatagtatctttgtaatcttcttctataaatttcaaagatttttttaagctttgtaatgattgtgcactttgtgcatcttcttttaattcaattatttctttttttaaattttcattttctttttctaattgttttacttttttggcattttccttaaatttaaatatatttcctgtaccttcttttataaatgtaaatccattatttaaactaccttctattgaagatattgtatttaagataaatccattttttgcaaaactatcttttgaatatctgccgattgacattcctacaattccaattaaagtgatagcaactcctatagttgctatcactttaacattgtattttttattattttttttatttttacctagtttcaccctatcaccaactttaaattatcttctatcattcatcattaatactttttcaaatatttcttggtcttctacagacttaccagtacctaatgcaacgcagtctagtggattttcagctatatgaacaggcattcctgtgtgttcttttactaacttatcaagccctctaagtaaagctcctcctccagttaacattattccgttttccattatgtctgaagctaattctggtggagttttttctaaagttgattttattccatctactattgatgttataggctcttttaatgcttctctaacttgagttgatgatatatgctcagtttttggaagaccagttactaagtctctacctcttatttgcatagtttcttctgcatcatctttaaaagtagatcctatttgtattttaacatcttctgcagttctttcacctatcattaagttatattctttctttacataactaactatagattcgtcaaactcatctccacctattcttatagatttagcagtaactataccacctaaagatataacagctatttctgttgtacctccacctatatcaacaaccatatttccttctggttcttctactctaagattagcacctatagctgctgccattggttcttctataagatatgcatctcttgctcctgcttgtctagcagcttcttctatagctcttttttcaacttcagttactccaaaaggtacacatatagctattcttgggctaacaacacctttatttgaagcagctttttttataaagtagctaagcattgcttgagttacatcaaaatcagctataaccccatctttcataggtcttatagcaactatattacctggagttctacctatcattttcttagcttcttcacctactgctaaaacagatttactgtcatctcttattgctacaacagatggttctctaactactatcccttgaccttttatataaactaatgtatttgctgttcctaagtctattcccatatctttagacattttattaaatccaaataacgacttgaatccttttttttcctttttctctttctttgccataatttcaagctcctttcacataaatccatcaaattatcatattttccttgaaactgtaataaagcccatcccctattattatatggtcaatgacttcaataccaattaattcgccacattttactaatctagacgttacatttttatcttcattagatggttctatatttccagatggatggttgtgcataagaataatcttgttactacttcttttaattgcttctctaaacacttctctcggatgtaccacagacatatttagagttcccactgatatatctatatcacaaattatttcatttttagtatttaaaagaattatcttaaatatttctttatttaaatacctaaggctatccatataatatatatatatatcccatggatttgtgactttatatcttataggttttgcactagatattcttattccaagttctaaagatgcttttatttgagctgctttagaaattcctatcccatcaatttcgcataactcttctatagttatatcatttaaccatcttataccttgactatctttattaattatataatttgctaattctaaaacactttgtttcttagttcctgtccttaaaataattgccaataattcggcattagataagcttttttctcctttagtaagcattttctctctaggtcgttcttctaatgccatctcctttacacataaacttgatgacctcatcaaattaacctcctaagcttgataaaaaagatttatatcgaaattctctttaaggatatcacttaacttagatataggtaatcctactatgttaaaataatctcctttaatttcttctaccaacaaagctccatatccctgtattccatatgcaccagctttatctaaacactctccagtatttatatagtcttttatatcttgctcagttaaatttttaaatttaacatcacttataacatagtctacaatttttttattttcttccaaattcactatactaattcctgttattacctgatgttttctattagataatttgcttaacatattaaaagcttctttctcatttttaggctttcctaatatttcattatctaaaacaacaatagtgtctgctccaataactaaatctttagtattattagtagcaacatccatacacttttcaaatgctagtctcaatactagttgtgtaggctcctcaaaatcaaatattttttcatctatatcgctagttataaccgaaaatttaacctttgtattagctagaatttctcttcttctaggcgatcctgatgccaatattatactcattaattcacctcttttttaatacctaattagtttatcactatattgtaaaaaattcaatgttaatgtcgaacgtttttgttacactccggttacaatttttatttttttaccaaaataaagaagatatggaaaaactccatatctctatgatatccacattataaaattttaatagcttttttaggacatttttgaacacaagcatggcatccgacacacttactttcatctacttcatgcttttcttttagttctccttttattgcatcaaacttacattgcttcttacatattgtacacccgacacacttatctttttctatctgaactttttttcttttacttaaatccccttttatagcttttgtcggacatttttctacacaaaccatacattgtacacatttactgtaatctattcttgctaatttatcttctattattatagcatcaaatggacacgacttagcacatataccacatcctatgcacccaacactacatttttcctttacgctctttccaaaatctttactattacattctactaccacttgatttttaactggcttttcatgtatcaatccttttgggcaaacttccatacattttccgcaaagaacacatttatcttcatctattacagcgactccatctattatttttatagcatcaaatttacaagcattaacacaagtaccaagccctagacatccatatttacaagatttagctcctccatttaatgcattagctgctttacaatctaacattccttcatatgtatatttgtctttagaaacatcacaattacctttgcaaataacatttgctacttttctctctcctacttctgaggttactcccattattttacctatctttgatgcacaatcacttcctccaacaggacatccatttactaaagcttttccttctactattgcacttgctaatcctccacaccctgggaatccacatcccccacagtttgctcctggcaatacttcaagtatcttttctactctttcatccacttctacagcaaactttttagatgcatatgcaagtatagctccaaagattaaacccattacacctaaaaccaaaattgaattaattatagccaattacttcgccccctaacttataattttataagtcctgcaaaccctaagaatgctatagacattaaacttgctgatattaaagttataggaaatcctttaaatgtttcaggtatatctgctaattctaatctctctcttatacccgcaaataaaactatagctaaagtaaatcctactcctgctccgaatccatttaccattgtctcaactaaattataaccattttgaacattaaccaaagctatacctaaaactgcacagtttgtagttattaatggtaaaaatacacctaaagcttgatataaagatggactcatcttttgtataaccatttcaacaaattgaactatagatgctattactaatataaaagctatagtttgtaaaaattgattattggttatttctaatattctttgaacaaagtaagttataaatgatgctaatgttaaaacaaatgtaactgcaacccccatacctactgctgtatctacttttttagaaacacctaggaatggacatattcctaagaattgagatgttataacattgttaactaatacaacacttaaaaataaaagtattaaattcatatatctccctcctaattagcttttttagcttttaatttattaaaccctgcaagtaaaaatcctaatgttaggaaagctcctggaggtaatataaataataaagctggttggaaagatgatccaaataaagtaaacccgaataaacttccattaccaagtatttctcttatagctcctaatacagttaacgatactgcaaatccaagacccataccaattccatcaactgcagcctctactggtttatttttagatgcaaaactttctgcacgtgctaatattaaacagttaaccactattaaaggtataaatagacctaatgctttatcaagtgctggtatataagcttttaaaagcatccctaccatagtaacaaatgttgctattaccactataaacgctggtattcttatcttagatggtataatttttctcatcatagatattactatatttgaacatattaaaactatcgtagttgaaagacccatacctaatccatttatagctgatgttgttacagcaagagttggacacataccaattacttgaacaagtgttgggttttcatctattaatccatttttaattatttttcctaaacccattttctatgcccccgttccattagttatttttttaaagaagtctatagtagagttaacaccttctataactgatttagatgttatcttagctccagaagcagattgagatttatcatctttgttaaccttttcttgaactaaagatatttcatctattttttttccttctagctgatgtgtcaatcctgtatcaaaagtagattttagatgttcattatcattagttttttcccctaactctaaaccttttattgttccatctaaagttatacccactaatacttctgtcttattttcatatccatctagttctgtttcaaatatatatccaatttttttattttcatcaaaaacttcataagtagctactatcttaccttctgattttccttctattttcttaaattgtgcattatcaaatatcttaaccataggctcatttgcaagagattgaacatctttattttgtgaattgtttaataattgttctttatataaattgatagctgcatttactccagaagtaacagcattagatgttattgtagccccagatatggcagctatgtcattatcattacttgcacttccttttacaaccattaaaggtttttctgtgctctttccattaaattgatctttaaatgttggttctgaagccttagatccaagacctggagtctctgaatgatttccaacttttactcctgtaatttttccatctttagatattcctatcataacttctacctttcctccatatcccttcggcgcagttttgatagtatatcctactacttcattaccttttaatccctgatatacttcctctactaagttagctttaacattatctaattgcttaaattcttcagcttctttaagtacttcttttctggactcattatttgcttgtatatttctttcttttataactggctcagttatattattagttacacttaataatagggctgctacagcacatattaaaaataatatgctgcctaatttgaatatatctttcatttatttcgccacctccccaaacactttagtttttgtgtatttatctataagaggtgtcattacatttacaaataatatagaataagagactccctctggatatcctccataaagtcttataactgttgttataacaccagctattatagcgtatataatttggccttttttagtcataggtgatgtagtataatctgttaacatgaaaaatgcacctaacataagtcctcctgctaccatttgatacatagcaaattcaatgttaaatccccctaatataaacattaatattgctacagtgcatatataaaatactggtataacataatttattatccctttatacattaagtataatccacctagtataagaagtattgctgatgtctcacctatagtaccacctatattaccaataaacatatcaaataatcctgttccactatcagttaaagtttgtataccttgtgggcctgcttttaaaaaagatagtggtgtagctgtagttacagcatctatatttcctgaactaacccagtttacaccagtttttgtccaagcagtcatagctactggaaatgatgctaataaaaatgccctagctgctaaagcagggtttacaaagttattaccaattcctccaaacaccatttttaccactattatcgcaaatgctgcacctgctaaacacatccaccaaggaagagatgctggtacgttaaatgcaagtaataatcctgttacaacggctgaaaaatcccctattgtcgactctttcttacttagcttttgacataaccattcaaatcctactgatcctaatatacaccaaaatattacatttatagcacttagtctaaaaaagtatacccctgctaatgtagctggtaaaagagctattataacttgcttcattatatatgatgtatcttcattacttctcacatgtggagaagatgacactattagtttgctatccatcatatttccccctaactttatttacttattgattgttttctttttagtgaaattatttcttttttagctaccctaattgattgaagtagaggtcttcttgctggacaaataaatgagcaagatccacactctatacaatctaatgctttatacttttcagatgattcataatcaccttttatactatatgcacttatgtacaatggttgtaaaaatgctggacatacatctagacatttaccacatcttaaacaatttttaggtttaggagtgctcgcttcgattttatctagacataatattcctgacgtgcctttatttgtaggtatgtttattgtatgctgagctattcccatcataggtccacccattataacttttcctagttctttttctttattaaatccaccacactgatcaataatttctgagaaaagagttcccactttagttacaagattttttggttcttgtatacaacttccagttatagttgttatcctttctataagtggcatgcctgtttttatagttttagctatctgagcagcagttcccacattattaactacagctcctgcatccatcggtaacccacctgatggaacttccctttttgtgcatgcataaataagttgcttctctgcaccctgaggatatttaacctcaagttctacaacttctatatcattatagtttttagctacatttgatattgcatttatagcatctggcttatttacttctataccaatataaccttttcccacatttaatgctttcataaggactcttaatccaaatacaacatcttctggattttcaaccattaatctatgatctgctgttaaatatggttcacattctgcaccatttaatattacaaaatctattttcttatctggtggtggagatatttttacatgcgttggaaatgttgctcctcccataccaacaattcctgcttctttaataatttctactatctcttctttccctagttcatctaaactcccctttggtttaacgctttcatgaatggaattttggaaatcattttcaacaactatacacgtacttattcctccaggtacctccatatcttttatagagattacttttccagatatagatgagtgaatatttgcagatacaaatccttgcatctgaccaatcttttcccctacctttacttcatctcctacttttactataggtttagctggagcacctatatgttgttgcatagaaatatatactattttaggatcattagctttttctaatgccttgctatttgtatactcctttctatacggagggtgtattcctcctttgaaagttaagagcttcattcttttacccccttataacttaatttaaacttttttctaatataagtatactataacaattgtaaaatattaactatcgttaaaaaaatatcttattttgaaacaaattccaactttttgtgacttatttttctgattttataaaaaataaaaaagttgttttttaacaactttttaaatagtttttatagaattaacaaaactatagtattcttgcatagatgacataaataagcttttacttatataatattgatctttttctacattttttaaactttcatttgatttatcttttactgattttatatatacacttaaattttctttaaatcccttcatacctttataatttattttctttgtatgtttttcaagcttacttaaaatttctaatttattattaattatttttttagatgtttacatagaagatagagaagttagcttagatggtataaaaagcataaaaaaatctatattatctattctcaatttaaatattgaaagtaatatagacaatatagattttataaactctatgtcagaatatattataaaacttagaaaatacaagatatctaaaaaagaatataatataaaatctgacccaagatatttaataagtttagaaattggagatgtaaagtctgatccaatactaaacaatataaaagttgtatcaaaagatttttctaacaatatattgactattaatttggtatcaaaatctggtaattatagctttaaatttagaaaagcttaattatcagattctaaatattcaacaaaaacttcttctttagtgtttgttagaaaacaaagttcttttataaggctgtttctaaggtcgatgaaatcttctaaattagtattttcataggtatattctaatgcttttacaataagcaataaatctcttttagatagtgcatcaatagatactttgtcgaacaatttcataaaaaacttcctttcatgtgtaatttagtgattaagaaaatatataataagatataattctacaacaatataaaaaaaccttctttttatatacataatattataaataaaaatcatacatatagtattttaacaaaaatagacgattatagctaagaaaattaataaaagaggtgaattaattgaaaatacttttaactacgttaaattcgaaatttatacatacaaacctagcaataagatatctaaaacaaatggtaaaagatattgaagatataaatgtagatataagagaatatacgataaacaatgaattagattttatattaaaagatatatatacaaataattatgatgttatattattttcaacatatatatggaatgtaaatgatatagttaagttatgtaataacttaaagaaagttaaaccaaatataaaaatagctttaggtggaccagaagtaacttatgacagtgaagaagctatgaaaaaatatgattttatagattatatactttatggagaaggagaacttatatttagagattttacaaaatatcttataggggatatgaaaatagaagacgttgatggaatagtttatagaagtaatgattctattataactaataaacctatgaaacttttagaaaatttagatttaatacctagtccttatgaagagttagataaaaaagaatatgaaaatagaattgtatattatgaaacatcgagaggttgtccttttaactgtcagtactgtttatcttcagcgatagaaggattaagatattttagtatagatagagtaaaaaaagatttaaagaaacttatagatgctagagtatctcaaatcaagtttatagatagaacatttaatgcaaataaaaaatttgcaatggaaataatgaaatttttaatggaaaatgataatggttatacaacatatcattttgaagttacggcacacttattaactgatgatatgttagagtttttaaaagactgtaaagaaggtctattccaatttgaaataggagttcaatctacaaatgaaaaagtattagatgctgtaggtagaagagatgattttaaaaaattatcatatgtagttcaaaagatagcatcatttagaaatatacatcaacatctagatttgatagcaggattaccatatgaagattatagtagctttgaaaactcatttaatgatgtatttaatctaggaatagagcatttacaattaggtttcttaaaaatgataaaaggtacaggaattagaaatcaagcagatgaacatgaatttagatataaagattatcctccatatgaagttttatataataaatatataagttacaatgagatattaaaattaaaagatatagaagaaatattagaaagatactttaactctaaaaactttgttctttcaatgaggtatataatacataattattataaagaaagtccttttaagtttttcgaggagtttgcaacatatttcaatgataatggatatttcaatgcatcacaaggaaagaaccagttatataagatattagtagatttctatacagataaaattaatatagaaactgaattatttaaagaaattgtaaagtatgattatatatctttaggaaaaacatctaatgtgcctgcatttatggataaagtagaagtagatgattttaaaaatagatgccatttatttttacaaaatgaaggaaatatattaaaatatatacctagatttgaaaatactcctgcaaaacaaataataaaatatgttaattttgagacatttaagtatgatatattacaattaaagaaaaatataactgcaaaattacaaccaaaagaaagtataatattatttgtttatgatgataaaaaggtgtttgagaaatctaaatcatacacagtggaaatataggaggtataaagtgaaatttagaagtgagaaatatatactaaaaaaagcggaagaattagcatttttaagaataaaaaatggagcagaatttaatttaaaaggatatgaattccctaaagatggactagatgtacctataaaaaatgatgtattagtaaaaggtataaaaactaatacagctcaaaatgggttaagttcaatgtctatagctgatgcaatgatatatattatgggaattgatagtaagtttaaacttaatgatgaatataagaagtttctagacgctatacaaaagaatctagatttagacttaaaagcatatatgggatatatgtctagaaagtattttgaagctggagaatatacagattctttaatatacctaaaatgtagtgtaagtttatatcctaatgatgtagatggtctttatcattatgctatagtttgccaagaattagctaagcaacatcaaaaaaatggtgacgaacaacctatggaagcatttttattagatgctatagaggcattagaaaaagttagagatttagatgagtcatttgcattagcatactatcatttagggtatcactattataatcaaaatcagtatataaaaagcaaagttacatgggaagaagcaattaagctaggattaccagaagacttatgtgctgagatacaagaacttataggaaaaatggattttaaagttcaatatgaagaaggatataatttagtgttccaaggaaaaaatgaagaaggattagaaaaactacttccattagcagatgagcatggagactggtggaatcttttatttatgataggattagcttatagaaatatgaatgatataggacaagctcaaaaatattttgaaaagatacttataataagaccaaatcaagtggacacattagttgagttaggtctttgtgaggcttcaaattacaatatgaaaggtgctatagaatattttgaaaaggctgctaagttaaaaaaagaagacccggagatactttgtaatttaggtatggcttatttaaatgatggagatttagataatgctatttattacatagaaagagcatatgaaataaatcctcaagatgaagtaacagtagcatgtttaagagaactagatagttatagataatataagctaaatttataaagctatgagaatttattcttatagcttttttatttaaataaaaaggagtaggcgttaatatgtcaaattaggtttattataagtattaaaaatttatatacatatttataagttgacaaaaataagaatataagggggtgttatattgattaaaaatttaagcgatataataaatgagctaaaactaaatgaaaaagttaagttagctatagcggcagcacaagatgaagaagttttatgtgctgtagtagaggctatgaatatgaatataatagaacctattttaataggtaaaattgataaaataaaagaaatagctaaaaatttaaatttaaatttgaataatgttaacatgattgaagctagtacttatgaagattgtgctcaaatagctgttaaattagtaagtagcaaaaaagctgattttttaatgaaaggaatactagatacatctattttattaaaagaggttttaaataaagattatggattaagaacagatagtttacttagccatgttatgatatatgatataccaacttatcataagctacttatgcttacagatgggggcatgaatataaatcctagttatgagcataaagaaaaaattgttgaaaatgcaataaaagcatgtaagccacttaagattgaaaatattaaagtagcagccctagcagcaaaggaaaaagtagattctaaaatgcaagcaactgtagatgcaaaaaaattgcaagaatctagtgaaaataaaaggtttggagaaaatgttatactggaaggtccattagcacttgatttagctatatcatctgaatcagccagaataaaaggtatagaaagtaaagtatctggagatgtagacattcttttagttccaacaatagaagttggaaatggaattggtaaatctttgacatattttgctggagcaaaatctgctggagtggtaatgggagcaaaagcacctatcgttttagtatcaagagctgatacacatgaatcaaaattatactctatagcttatggggcattgatagctatgctagagaagtaatatataatacttgttaaaaaattacctaaattatagtgaaagtaaaagatattgttgttataatttaggtaaataacattattttagatgtagaaatatacgaagctcatatatgacaacatacttagctctattaaaaattttataaaaaaggggatagaagtatggagaaaaagatgttaactatcgatttaaacagccaagaacttatagaaaaggctgaaagagatggtgtagaaactatgtatgacaggaaagctgctatgaaagctcaatgtggatttgggttacagggagtatgctgtagaatatgtgcagcaggaccttgtagaataactcctaaaacgccactaggcttatgtggggctgatgaacatgttatagtaggtagaaactttgctagaatggttgcagcaggaactgcagctcactcagaccatgctagaggtatagtacatacgatggctatagctagtagagatggaaactatactataaaagatgaagctaagttgaaaaatttagcaaaagaatggggagtagaaacagaagatagagatatatatgatatagcgcatgaagttgcagatatagctttaatggaatttggtaaacctcatggtacattaaagtttttaagtcatgctccatatcaaagacaagatttatggaaaaaacataatatagagccaagatctatagatagagaaatagtaacaataatgcattcaactcatatgggatgtacagctgatatagatagtttaattaacttatcattaagaacttcattagcagatggatggggaggttctatgataggaactatatttagtgatattctatttggcacaccaacagtaagacagtcagaagcaaatctaggagtattagaagataataaagtaaatataatattacatggtcatgaaccttcattatcagaaatgatagtattggcatctgaagatccagaacttgtggcattagctaaagaagtgggagcagaaggtataaacttagcaggaatgtgttgtactggtaatgaagtaactatgagacatggtgttagaacagcaggggattttcatcaacaagaattagctataataacaggagcggttgaagctatgatagttgatgttcaatgtatattcccagcattagctaaagtttctgagtgctaccatacaaaattcataacaacatcaccaaaagctaagatatcaggatcaacatatatagaatttaatgaagagacagcattagatgatgctaaaaaaatagtaagagaagctatacttaactttaaaaatagagataaagaaaaagttcatatacctcagctaaaatcaagtacaacagttggatttagtgagcaagctataataggtcaactagatagagttgtaaactctcaaatagatgaaacaggaacagttaaaccattagttgactgtttaaaatcaggagtattaagaggggtagtaggagtagttggatgtaataatgcaagaagtgtatcaaataaagctcatgtaactataatgaaagagttgattaaaaatgatatcttagttgtaacaactggatgtggagcttcagctgcaggtaaatttggattattaaataaagaagcaaaaagcatggcaagtaaaggtcttgctacagtttgtgaattagttgatataccgccagttatacacttaggttcttgtgttgactgtagtagaatattaagtgttgtttcagaggttgctaaatatctagatatggatatgtgtgatataccagtagctggggtagctccagaatggatgtctgagaaagctgttgcaataggaacttatgttgtaggttctggtatagacacttacttaggtataatgcctcctataggtggatcatcaaaaactgtagaaatattaacacaaacattacaagatagtatgggagcaacatttaaagttaacgaaaatccagaagaattagctcgaatgataataaatgatatagagaaaaaacgtgtacattttgaagaattagttgcacaaaaaaatgctgagaaaaaagcattaccagcagaagcttaaaaataacttaataatataaaaaactaggagtactactttgaaaagatagtatgtaaaattaattagtttatgaaagctagctatagtttatttttcatgcaatcataactaattataaattaaaaccaaaagatgaaaaatataaacttaaattaagttgagataaacaaaaggggtagaatatgaaaatagcaataacaggtaaaggtggagtaggaaagacaactttttcatctatgttgtcaagaatgtttgcagatgatggttatagagtagtagctgtggatgcagatcctgatgctaatttaggtttagctttgggatttccaaaagaagtttatgaatcaatagttcctatatcagaaatgaaaaatttagttaatgaaagaacagcagctgaaagtggaacttttaataaaatgtttaaactaaatcctaaagtagatgatatacctgataatttttgcaaggaacataatggggtaagacttttaactttaggaacagtagattcaggtggtagtggatgtgtatgtcctgaacatgtacttttaaaaagactatgttctcacctgattttgcaaaataaagatgttgtaataatggatatggaagctggtatagaacatttgggtagggggactgcacaaggtgtagatgcctttatagttgttgtagagccaggagaaagaagtttacaaacttatagaaaagttaaaaaattaggaactgacataggggttaaacaagtcttcgtagtagggaataaagtaagaaataaatcagatgaagaatttataactagtaatttacaagatggagaattactaggctttgtttactacaatcaagacgttatagactcggatagagcaagtaaatctccatatgatgtaagtatagatactaaaatacagatagatgaaataaaaaatagattaatgacgaattgttagtatattagtataatagatataataatgtaaagtgagaggagatttagttatgggatttaaatcagatatagaaattgcacaagaagctaaaccacaagatataagagaaatagctaaaaaattaggattaagtgatgatgaagtagaactttacggaaaatacaaagcaaaagttgattataacttactaaaaaaagataataaaaagaaaaaagctaagttaatattaacaacagctataaatccaactccagcaggagaaggtaaaactactactacaataggtgtagctgatgcatttgctaaattagataagaatgtattagttgcattaagagaaccatctttaggtcctgtatttggtgtaaaaggtggagctgctggtggaggctatgctcaagttatacctatggaagatataaatctacactttactggagattttcatgctataggtgctgcgaataacttattagcagctatgcttgataatcatatacaccaaggtaataatttagggattgatccaagaagaataacttggagaagatgtgttgatatgaatgatagacagttaagaaatataactgatggattaggcggaaaagcacatggagttcctagagaagatggatttgatataacagttgcatctgaaataatggctgcattttgcttagctaatgacataatagatttaaaagaaagactaggaaatataatagttggttacacatataatggagatcctgttacagctagagatttaaaggctaatggagctatggcagctttacttaaagatgcattaaaaccaaacttagttcagacattggaaggtactccttctttcgttcatggaggaccatttgcaaatatagctcatggatgtaactctgtaatagctacaaaaatggcaatgcattttgctgattatgtaataacagaggcaggatttggagcagacttaggagctgaaaagttcttagatataaaatgcagaatggcagacttaaaaccagatgcagtaataattgtagctactgttagagcattaaaatataatggtggggtagctaaagatcaattaaatgaagaaaatttaggagctttagaggctggaattccaaatcttttaaaacatgttgaaaatataactaaagtatacggacttccagcagttgttgctataaacagattccctcttgatactgaagctgaacttaaattagttgaagaaaaatgcaaggaattaggtgttaatgttgcactttctgaagtatgggctaaaggtggagaaggtggaattgaagtagcaaaagaagttatgagattaatagatgaagaagaaaataattttaaattctgttatgtagatgatttatctataaaagagaaaattgaagctatagctaagaaaatatatggagctgatggagttgattttactcaagcagctgaaaaagaaatacaaaacttagaaaaattaggatttagcaaattaccaatatgtatggctaaaactcaatattctttaactgatgatcaaactaagttgggtagacctactggatttagaataactgtaagacaattgactgtttcagcaggtgctggatttatagttgctcttactggagatataatgaaaatgccagggcttccaaaagttccagcagcagaaagaatagatgttgatgaaaatggtgtaatatcaggtttattctaatataattaaacaatcgggggtcgctcgttgtaattgtagttttcttcttcgcacaaagtactaaaaagatgtactttaagtgctacgtcgacaactacaattacaatttcgctacttccgattaataaaatataatagaataaacataaggtattatgtatggaggaaagaaaatgagaatatcggaaaaaacatgtgtagattttgttgatgtgttagcttcaaaatcagcagttcctggcggaggtggagcagcagctttaactggggcgataggtattgctctaggaagtatggtgtgtaatttaactataggaaagaaaaaatatgctgaatatgaagaaagtgtaaaatctatattagaaaaagcaagagtattagaaaaagatttaataaatatgatagacgaagatgcagaatgcttccttccattatcaaaggcatacgggcttccaagttctacggaagaagaaaagaaaataaaagcagatactatggaaagtgcattaaaaaaggcatgtgaagttccaataaaaatagtaaaagtatgctatgaagctattaaattacatgaagatttagtagataaaggatcaagacttgcaataagtgatgttggagttggagttcaatgtctaagagcggcaatacttagtggacaactaaatgttattataaatataaattcaatcaaagatgaagaatatgtaaaaagtgtaagagatgaagttaataatcttgttgaaaatggagttagaatttgtgatgaagtttgcaagaaagtagaaaatgaactaaacaaataagactcatactataatttatttaatttttaagatatagggggccagattaaatgagcaatataacaactaaaggacaaataataaaaggtaaacctgtcgcagacaaaataagcgaaaatttaataaaagaagttaatgacttatctaaggaaggtataatacctaaattagctatagtcagagtaggtgctagaccagatgatttagcttacgaaagaggagcacttaaaagatgccaaactataggcatagaaactgaagtaatagagttagaagaaaatataactcaggaagaatatataaaagcagtacataagttaaatgaagacgaaaaagttaatggaatattgactttcagaccacttcctaaacatctaaatgaagatgtaataaaatatgagatagatcctaataaagatatagactgttttaatcctataaacatatctaagatattagaaaatgataaaagtggatatcctccatgtacacctactgcagtagtagaaatattaaaatattatgacgtagatttatcaggtgcaaacatagtagtattaggtagatctatggtagttggaaaacctgtatctatgcttttattaaatgaaaatgctactgtaactatatgtcattcaagaactaaaaacttgccagagataacatcaaatgcagatatacttgtagcagcagttggtaaagctaatatggtaaaagaagaatatataaaagatggagccatagtaatagatgtaggtataaatgtagacgatcaaggcaatttatgtggagatgtagatactaacaatgttttagataaagtttctatgataactccagttccaggaggagttggatcagttacaacttctatattagctagtcatgtagttaaagcttgtaaattacaaaataataaataaatggagattttcaagggggaatagagatgataatttctgaaaataagccatttgaagagatattaggttatataaaaaatgctaataaaatagtgttagttggatgtaaccaatgtgcagctacgtgtaaaagtggtggagaagaagaagttttaaaaatgaaagaaagattagaatctgaaggaaaagaaattttaggatatcaaatgttagaccctgcatgtaatcttttaaaatctaaaaaagatttaaaatcactaaaatcagaaataaaagaagctgatgccatactttctttagcgtgtggagatggaacgcaaactatagttaaaaacttaaaagataaaccagtatatccagctaataatactttatttataggtgaagttaaaagagttggtgagtttgaagaagcatgtaaagcatgtggagaatgtgaacttggatggactggaggaatttgtccagtaactatgtgtgctaaaggattattaaatggagcttgtggcggagcaagagatggaaaatgtgaagtagaccctgaaaatgactgtgcttgggtacttatatacaatagattaaaatctataaatcagttagataatctattagatataaaagagcctaaagattactctaaatcatgtaatcctagaagtctaagcttaaagaaaaaagaatctatggccaatgcttaattagttttttaaaggttaaagggggataaaaaatgagcttattaaaagaagctttagaaaatggtaagtttgcagtaactgctgaaatggctcctccaaagggaacagatttatcacacttaatagaatgtgctaaagctgttaaaggaagagttcatgcagttaatgtaacagattttcaatctgcagtaatgagaacgacttcgcttactacatgtaagttattaaaagatgaaggattagaaccagtacttcaagtaactggaagagatagaaatagaattgcaatacaaggagaattattatctgctggagtatttggaattacaaatatgctagcattaacaggagaccacaccatagtaggagatcatcctcaagccaaacctgtatttgacctagattgtgttgggatattaaaaacagcacaaaaactttcacaaggaacagatatggtaggtaatcaattaaaaggggcaccaagtttttacttgggagcatcagtaacacctagatacacacctcttgaaattcaattattaaaaatgaaaaagaaaataaacgcaggagctaagtttttccaaactcaagctgtgtatgatatagatactatgagagaatttagaaagcatactaaagatatgaatacaaaagttttagctggaataatacctttaaaatctccaggaatggctaaatttatgaatgcaaatgttccgggtatatatgttccagatgaacttatagaaagattaagatctgtaggtaaagaaaattgggtaagtgaaggaataaaaatagcgggtgaactaatacaacaattaagaaatgaagatttatgtgatggagttcatataatggctataggagcagaagaaaatgtaccagctattttagacgcggcaaatatataaatttatattagggggattgttaaatgaaagtagcagtaattggaggaggtccaggtggatatgtagctgctataaaagctgctatgcttggagctgatgttacagttatagaaaaaagaagagttgggggaacttgcttaaatgtaggatgtatcccaacaaaagcattattagcatcttcatcattaattacgtctataaaagaagctaaagattttggaataagtatagatggaaatattgaagcagattttgaaagtataatgggaagaaaaaataaaatagtaaatcaattaattaatggaattgaatttttatttgataaaagaggtataaaattagttaatggatttggtaaattaatagataaaaataaaatagaagtaaaaaaagaagatggtactatagaagtaatagaagctgataaaataatattagcaaatggatctcaacctgttatattaccgatgtttccttatgatggagagactataataacaagtgatgaggcattaaacttaaaagaagttccaaagtctttattgatagttggtggaggagttattggatgtgaatttggtcaattctttaaaactttaggaactgaagttactatagttgagatgtttgatcagttgcttccacttgaagataaagatgtggctaaacagttgcaaagacaatttaaaaaagataaaattaaggtaatgacaggtattagaatcgaaaaatgtgaaatagttgacgatgaagtagtagcaactctatccaatggaaagcaagttaaagctgaaaaggcgttattatctataggcagaaaaccttatttagataattcaggggtagaagatataggaatcacattagaaagaggtaaaatagtagtaaacgaaaatttagaaacaaatattgaaggtatatatgcaataggagatttaataaatacaccatttttagcacatgtagcatctaaagaaggattaatagcagcacaaaatgctgtctgtggcaattcaaaaactgtaaattataaagcagttccaagatgtgtatatactgaaccagaagttgcaggagtagggaaaaccgaaaaagagcttcaacaacaagatataacatacaaagtaggacaattcgattttagagcattaggaaaagctcaagcaataggacacttccaaggattcataaaaatattagcagatcaagaagacaaagtaataggcgcatctatagtaggacctcacgcgacagacttattaacagaattatctttagcagtacatttaggattaacagtagaacaagttggagatgtaatacatgcacatcctacattatcagaagggataatggaagcacttcatgatgttcatggagaatgtgttcatgcagctccaaaattagcaaaagcataaacaggaaaaagtcctgtttagacgaaacaaagggggaaatcttatgggatttaatattgcagtggcaggaaaaggtggaactggtaagactagtcttacagggcttttaattgactgcttagtaaatgataagaaaggaccaatattagtagttgatgcagatgcaaatgctaatataaatgaggtattgggattagacatagatgtaacattaggtcagataagggaagagataaaccaaagagaaaaacaagggaattcattcccaggaggtatgacaaaagctcaatatctacaatacagattaaatacttcagtagcagaaggtccaggatacgatttaatagttatgggaagatcagaaggagaaggttgttattgttatgtaaatggaatattaagagaacaaacagataagctttctgatagttatgattacttagttatagacaatgaagcaggtatggagcatttaagtagaaaaactactaaacatatagataaattattgttggttagtgactgttcaagacgtagtatacaggcagttgcaagaataagagatctagcaagggaattaaatttaaatgtaggggatatgcaattaatagtaaataaagctccaaatggaatattaaatgatggagtaaaagaggaaatagaaaaacataaattagatcttttaggtgtagtacctctagatgagcttatatatgaatatgattcttctgggataccattagtaaaactacctgaagattctaaatcgagagcagctattaaaaatataatatctaaattagaattaaattaggctaagggggagaaaaatatggcatttaagatgtctgttcaaaagtactctggtaagatatcagaggtggaattagggtcaggtgaaagttgtataaaaataggaggagaaaatatacttcctttttataactttgatggagaaagtacaaatactcaaaaaataggggttgaaattttagatatatatccagaaaactggacacaagaaataaaagatttatataaagatgtagctaatgacagtgttaaatgggctaaatacatagaggagaatataaagcctgattttatatgcttaaaatttgaaggagcagatcctaatggaatggataaatcgcctgaagagtgtgcagatttggcaaaagaagttgcatctaacgtttcattgcctatagttatagctggaactggaaactttgaaaaagatgctaaggtttttgaaaaagtggctcaatcagtagatggatataactgcttatttatgtctgctacagaggaaaactataaaggggtaggggcagcagctggtatggcttataaccataaagttggtgcagagtcttctgttgatataaacttagctaagcaattaaatgtattattaactcagctaggagttaagcaagaaaatatagtaatgaatgttggttgttcagctgtaggatatggatatgagtatgttgcatctactatggatagaattagacttgcagcattaggacaaaatgataaaacattgcaaatgcctataataacaccagtttcttttgaaacttggaatgtaaaagagtcggtagctagtgtagaagatgaaccagcttggggatgccaagaaactagaggaatatatatggagatatcaactgcagcaagtgctttagttggaggagctaatgcagtagtacttcgtcatccaaaatctgtagaaactataaaaactttagttagtgaattagcttaatataagttaaaggttagggggagaaaaaatatggctttaaaagctttagatatatttaaattaacaccaaaaaagaattgtaaggattgtggatttccaacttgtatggctttttgtatgaaggttgcatcaggagcttgtgaaataggtaaatgtcctcatatggcacaagaatcattagataaactatcagaagctactgcacctcttatgagaactataaaaataggaacagacaaatcacaatatgatttaggtggagaaactgtattatttagacatgaaaaaactttagtaaatagaaatagatttgcagttgaattttgtgacactatgacagaagaagaaataagttcaagaatagaaaatataaaggctgttaactatataagaatcggtgaagaaatgaaggtcgagatagcagctttaagatacaattctaataaagaatcttatttaaatttaataaataagttaaaagaaagtgatttaaatgtaacatacatgataatttgtgaagatgtacaaatagcaaaagatgctgttgaattattaaaggaaacaaagcctatagtttatggagcaaataaagaaaattataaagaaatggtagaagtagttaaaaatgataagttagcattaggggtaaaagcatctagcttagaagatttatatgctacaacagaagctatacaatcacttggatataaagaattaatattagatacaacaggagaaactataaaagatacatttacaaatacagttcaagtaagaagaatatctttaaaagagcaagatagaacatttggatacccatcaataatatttgcaaataaattatcaaaagaaaatcctatgatggaagtagctttatcatcagtgtttacagtaaaatatggatctataatagttttagataatatagattacgcaaaagcactaccattatttgcacttagacaaaatatatatacagatccgcaaagaccaatgagagtagaaactaagatatatccaataaataatccagatgaaaattctccagttttagttactgttgattttgcattaacttatttcataatagcaggagaaatagaaagatctaaggtacctgtatggttagctataccagatgcaggtggatattctgttcttacagcatgggctgctggaaaatttggaggaagttctatagctaactttataaaagaaagtaaagtttctgacatgactaaaaatagagatttaattataccaggaaaagtagctgtattaaaaggtgatatagaagataacttacctggatggaatgtagttataggtactgaagattcaatggaattaccgaaattcttaagagaatataaagctagcaaagaagaagctttagctaaagcttaataaaaaatataaattaatagggggattaaatatatggaaaaattcatggttataggtgaaagaatacattgcatatcgccatcaataagaaaggctttagaagaaagaaatcctgaaccaatactaaaaagagctaaggaacagctagatgctggagctcattatatagattttaatatagggccagctgaaagagatggagaagacataatgacttggggtgttaaattacttcaatcagaatttaacaatgttccattagcactagatacagctaatagaaaagctatagaagctggacttaaagtttataatagagaacacggaaaaccaataataaactcagctgatgcagctggaagaatagagttaatagatttagcaggcgagtatgaagctaaagttatagctttatgtgctaaagaaggtataccaagagataatgatgagcgtatggcttattgccaagaaatgttggaaagaggattaatggcaggtttagagccagaagatatgttatttgatccactatgtttagttataaagggaatgcaagataagcaaatggaagttttagaagctataaaaatgatgacagagatgggattattaactacaggaggattatctaatgtatcaaatggatgccctaaacatgtaagacctatattagatagtgcatttgtagctatggctatggctaatggatttagttctgcaatagtaaatccatgtgatgaagaattaatgagaatgataaaatcttgcgatataataagaaattcaagcttgtatgcagactctttcctagaattaaatgaaggtggatttgcatataacgtataaatagatatattcaataaaagggggaaatagagtgaaaaatttgtacagtactgtttttaatggatctgagcaagctttagaagctgcaaaaggattacttaatgaagctatagaaaagcatggaaaagatcataaagtagaatttcctgatacggcatattcactaccttgtatatatgccgcaacaggaaagaagatgaataatttaggggacttagaagcagctttagaaattgttgaaagtttaataaataaaacacacttattagaacatgtatttaatgctgggttagctactgcactagctgctgaagttatagaagctataaaatacgctacaaatgacactccatataatgaaccttgtgcaggacatataacagacccgataataagatcacttggagtaccactagttacaggagatatacctggagttgcagttctacttggagaatgtccagatccagaaattgcagctaatgtaattaaagattatcaatctaaaggactattaacattcttagttggaaaagtaatagatcaagctatagaagctggagtaaaaatgggtctagaacttagggttatacctttagggtatgatgtaacaagtgtaatacatgttgtatctgttgcagtaagagctgcattaatatttggaaacttaactcctggtgatttaactggattattagattatactgcaaaaagagttcctgcatttgtaaatgcatttggtccattaagtgacttggttgtatcttgtggagctggagctatagcattaggattcccagttataactgatcaatatgttttagaagttccaatgaatttattaactcaaaaaaattatgataagtttgtagcaacttcactagaagctaggggaatcaaaataaaagttactgaaattccaataccagtatcttttgcagctgcttttgaaggtgaaagaataagaaaaaatgatatgtatgctgagtttggtggaaataaaactgaagcttgggaattagttagaaaaagagaattatcagaagttgaagaccataagattgaaataataggtaaagatatagacgagttagaagctgtaaatggagtagtaagattaccacttgctgtagtagttgatatagctggtaagaatatgcaagaagattttgaacctgtactagaaagaagacttcactatttcttaaactatatagaaggtgtaatgcatgttgggcaaagagatataacttgggtaagaatatctaaggatgcatttgaaaaaggatttagactaaaccatataggtgaagttttatatgctaagatgttagatgaatttgaatcagttgttgataagtgtcaaataactttaataactgatgaagctgaagttgctaaattaaaagaagaatatgcaactccaaaatatagatcaagagatgaaagattagcttcactagtagatgaaagtgttgaagaattctacacttgtaatttatgtcaatcatttgcaccagcacatgtttgtgttgtaactcctgaaagacttggtctttgtggagcagttagctggttagatgctaaggcaactaaggaattagatcaaacaggaccatgtcaacctatagtaaaaggtgaatgtttagacgacttaaaaggtatatggcaatcagtaaatgatgaagtagctaatatatctcaaggtgcagttgaaagtgttacactttactctatattagaagatcctatgacttcttgtggatgttttgagtgtatatgcggtataatgccagaagctaatggatttgttatagttaatagagaacatggtggaataactcctgttggtatgacgtttggagaacttgcttctatgacaggtggaggtgttcaaactccaggatttatgggccatggaagacaatttatatcttctaagaaatttgcttatgcagaaggaggtccatctagaatagtatggatgccaaaagaattaaaagattatgttgctgataaattaaatgctactatgaaagaattacatggaatagaaaactttacagatatgatatgtgatgaaacaatagctactgattctgaaggggtattagcatatctagaagaaaaaggtcatccagctttagctatggaatgtgtaatgtaaaaaagtaaatttttaaggagtgaaaatatgaaagttataccaagtttaaaatactgtaaggaacatacatgggttaaagtagaagatgattatgcttatataggaataacagattatgcacaagatcaattgggagaaatactatttgttgagatgcctgaagtagaagatgaaataactaagggtaaagattttggggttgtagagtcttctaaagttgcatctgacttaatagcacctatatctggagaagtcgttgaaataaacgaagcattagaagatgagccagaagctataaatgaagatccttatgaagcgtggataataaaagttaagatatcagataatgatgagttagaaagtttattaaactctgatggatatgagtctagtttagaatagaaataaataagctgtatcaaggtaaaattattaaataaaatttactttgatacagctttttagatagcattaaatttttagcaataataaggaaaaatcaaggtaatacaatataacatatagaatatataacttattagaaaaattaatattaaatcgctttataggggggagttcttttggctaaggttaagatagcatctcataaaaaagagattgagtgtagtaaaggggataatttattagatgtaattagagataacaaaatatttatagatgctccttgtaacggaagtatggtttgtggtaagtgtaaggttaaattaatacatggaaatgtagattctgagatgaatgtacatataagtaatgaagaaagaaatcaaggatacatactttcatgtgtgagtaaaattattgaagatatagaaattgaaattccttctaaactatcgtcgtctataaatgaaatgaaaatagaaggtagtgataaaaatgatgataagaaaatatttgaaaaatctataaatatgcttaaggaaaatggattagaatttacaaataatatattaaaaaaatatatagagctagaagaacctaatttagatgacaatataagtgatatagataggctacaaagatatataagaaataatataggctatgaaaatatagattttagcatagaatttttaaaaaaagttcctatagcacttagggaagataaatttaaagttactatcacatatgaagaaaaaactaattatatatacttaattgatatagaatctggaaatacagaagataaactttatggtatttcagttgatatagggactacctctgttgttgtttgtttagttaatttaaataataataaaattatagataaagcatcatcaggaaatgctcaaattaaatatggtgcagatgtaataaatagaataatatattctacaaaaaaagatggtcttgaaaatttaagaaaatctataatatatgaaactataaatcctttattagaaactatgtatgaaagaaatagtataaataaaaataatgttatttcttttatagtggctggaaatacaactatgagtagcttatttttaggtgtgtattcagactttttaagacaagaaccatatatacctccatttgtgaattcaccaaatcttaagggaaaggatgtaggtataaatataaatcctaatggacaaatttacttagcaccttcagtagctagttatgttggaggtgatataacatcaggagtattatcagcaggaatttggaccagtgaagaaaatgtcctttttatagatttaggtactaatggagaaatagtatttggaaataaagactatatgatgacttgtgcttgctctgctggtcctgcatttgaaggtggaggtataagttgtggaatgagagcatctaatggagctatagaaaagatagatatagataaacttaccttaaagcctgaattaacaattataggagattgtaagccagtaggtatatgcggttcaggaataatagatcttatatgtaaaatgatgattaatggcatagttgatagaagaggtaagattaataaagatttaaataataatagaataaggtttaatgaacatgatataggagaatatgtacttgcctttaaagatgaatataatatagaaaatgatataactgtaaatgaagtagatatagataattttataagagcaaaaggtgctatatactcaggggcagcaactcttatagaaagtttaggtatggattttagcgtagtagataaggttttaattgctggaggaattggaaatagtttaaatatagaaaattcaattatgattggattgcttccagatatagaaagagaaaaatttaattatataggaaatagttccttaataggagcatatttaactttaataagtaatgatgctaaaaataaactaaaagagataggcaatcaattaacatatgtagagctaagtgtatatccaacctatatggatgagtttatatctgcttgtttcctacctcacacaaatatagaacaatttccaacagtaaaaaagatgctaggagaataaatatatgaatacaaatgaaaaaattaaactagcatacgaaacgaaaattaaaaattttggacatgatatagaatttgcttatccaaatcaaacactaactttaagtacaacagataatgaatgtagcttagggtgtgcgcattgtaacggacagtatttaaaaaatatgattcctataagtgattatgaaaaaaatttaaataaaagatatattacaagtatcttgttaagtggaggttgtagttatgatggagatgtacctatagaaagatatattgatattataaaaaaattaaaagaaaaaggatataaacttaattcacacataggacttatgaacaaggaaaatataaaaaaaatatgtaagtatttagattatgtatcttttgatttagtatttgatgaagatacaataaaagaagtttataagatgaataaaagcaaaaatgaatatatatccacctatgaatatatacaacaacacacaaatgtagcgccacatatatgtataggattaaaaggtggaaaaataaaaggcgaatatgaaattattgattacttaaaagaaaatcagccaaatcagttaacttttatagttttaattccaactaaaaatactgaatatgaaaatgtgaagcctcctcaaattagtgaagttgcagatttattatgtgaagctaggttaaaccttcctagaacaaaaataaatttaggatgtatgaggcctcgaggagaatataggaatttattagatagtatagcattagaatgtgggataaataagattgttttaccatcaagaaaatgtagagaattagtaaaagaaatgaaattaaacattatagagagcaaggagtgttgtatattatgattagattatctattggaactgcgatagagcttgaaatgaaaaaaggtaagagtgatatacctcctactactgcatatataatgataggtaataagtgtagcaataaatgttctttttgttctcaatcaatagaaagtagtagtaggaaagataagttatctagagtaatatggccagagtatgataaagaagatatattagatgcatttataaattataaaaaagataatattaaacgtatatgcatacaatctatggctagcgatgaatcatatgatgaagtaacaaaatttataaaatatataaataaatatttagacattcctatatccttatctgctaagttagaagatatggaggatttagataagttttttgaacttggagtagataaaataggaatagcaatagatgctgtaaataaagaattatatgaaagtataaagggaaataattttgaagaaaaaatagattttattaaagaagctgggattatgtatcctaacaaaataagcacgcacataatagttggactaggagaaactcataaagaagtatatgatttgtataaaaatttaaagagttatagtataactataagtttatttgcttttacgcctgtaaagggcactaaaatggaacatgtatgtcaacctaatatagaaagttatagaaggattcaattaatgacatacatgattgataaaggatacaacagggattattttaaattcaataaaaatggatatttggaatttgtagaaatagatgattatatgaaacaagatattttaaaaggactgccatttgaaataaaaggatgcaaagactgtaataggccatactacaatgaaagaccaggtcacacaatatataattattcaaaaaaactaaataaggatgaaatagatttagcaataaaagaattgaattttaaaataggggaaatttaaaatgcaaaattggagattaataagaaataaagctttcaatggggcaatgaatatggcaatagatgaagcaatcatgatagcttataaagaaggaaaaagcaaaccaactttaaggttttacacttggcatccacattgtttgagtataggatactttcaaagcttagagaaagaagttgatttagaaaaatgtagaaaattaaatattgattgtgttagaagaataactgggggaagagctgtattgcatcaaaatgaattgacctattccataatagtaggtgaagataataacctaatggataaaagtataaacgcttcatataaatttataagtgaaggaattgcaaaaggattaagtattgaaggtgtaaatattgataatttaagtaagggagaaaggataaatagagaaaaactttcggcagcttgttttaatgcacacgcatcatatgagataacaataaataataaaaaggttgtaggtagtgctcagcacagaaaagaaggtattatactacaacatgggtctatagtactagattttaatgtagatgatttatttgaagttataaaaactaaaactccagagttaaaagaaagagcaaagaaatttactttaagtaaagctagtggtattgaaaatgaattaggaaaaaatgttgatattacaagtttggagaattcattgattaaaggctttgaagatgtgtttaatgtaagttttgaagaagatggtataagtgattatgaatatgaattagctaatgaattatatgaaaaatatatatctgaagaatatttaaataaaaggtaaataatgtagattaatcaattgactttgcattattttcaatgatatactcaaagtagatagttaactgaaatcatgaaggtttctttgagggacttgaagtgccttgaagaaatctttttttgatataaaaatagattaaaagggggaaggtattatgtgtgaatcagcagcttatgttataaggggagaaaaacttgaaagagttatggacaatgtagtgagcatagacccatatgaaggaaaagtatatcttacagatttattaggagatcaaaaaataatagatggagaaataaaagaaataaaacttatggatcacaaaataataataaatgaatctaagtaaaatatgtaaagcttatatagcgatggataaaacaaggagataaattatggtaatagcagttattgatggtatgggtggaggaataggagctcaaatagtaacatctttaagagaagaattaccatcctatatagaaatctatgcactagggactaactcaatagcaacaagttcaatgatgaaatcacatgcaaataagggagcaacaggagaaaatgctataattgtttctacaaaaaaggcaagtatagttgtagcacctatatctgtagttatacctaattctatgatgggagaagtgacatctaaaataagtgaatctatagcaacgagtgaggcattaaaaatacttttacctattatgccggaagacatagagatggtaggtttagaaggaaagccattagcacttttaattaaagatgcagttaaattaataaaaaaagaatttaatataaaataacttgggggagattaatatgattttaaataaagatagtattagatatcatcatggaacgcatgatcatgaacatggtcatcatcattctcatggatcatcacaagaaaataaagatgaaaagactttaaatatacttttagtgcattgggtaaatcataatgaatctcatgaagaaggatttagagaatgggtagataaagcaagagaaatgggtaaagaggaaactgcggttaatatagaaaaagctatagaatgtttaagacaagcaaacgaaaatttattagaagctaaaaggcatatgtaataataaatgggaggtatactcccttttattattacataaatttaaataaaattttacaaaaaacgttgacagattaatattaagattatataatttaaatatagtaatgatgaatacggagaagtactcaagtggctcaagaggatcccctgctaagggattaggctgggtaaccggtgcgagggttcgaatccctccttctccgccagttatgtcgaggtgtagcgcagtttggtagcgcacgtggtttgggaccatggggccgggggttcgagtccctccacctcgaccaatatgtggacctttagctcagttggttagagcgcccggctcataaccggtaggtccggggttcgagtccctgaaggtccaccataacaaaataggggtgtagctcagttggtagagcgtcggtctccaaaaccgtgcgccgggggttcgagtccctccacccctgccactaaaaagttaaaaattctcgaggtgtagcgcagtttggtagcgcacgtggtttgggaccatggggccgggggaatttactataggcatttttactataaacttaattccatcatactctataattgatttatcttctattacttttaaaggtttaaaaccttgtattatagatgatgttaaattattaaaattaatttctcctttagtttttacatttatataaaaaatagatactactattgtaataagtgctgttaagaatataagtctttttctataaatcataatatatattcctcctaatctgtaatatatattattttctgattatatcctaaaaatattatattaatattttggaaatatatttattcaaataaaaaagccttgaagaatattcttcaaggccttttaattatttttttaaaattttatttatttggtttttatatgcatctgctttagctccatatataacttggataccattgccgacttccataacaccaacagcacctaatgatttaaacttatctttttctaccttagatttatctttaacttctactcttaatctagttatacaagcatctactgaaactatattttcttccccacctaatgcttctaatacatatggtgcattttcttctatttcactacttcctgatttatcagtttttcctgcttgataatcagcttttgtatataacttagtttcttgttcattttcatctctacctggagtttttaaattgaacttaactattaagaatttgaataagaagtagtaaactaccgcatatacaattcctaccattatagctcttaaccaattagttggtactcctgctcctgctggaagtataccaaataatgagaaatctataaatcctccagagaatgtcattcctataaatacatttaataaatccattaataagaatgaaagtcctgcaagtacacagtgaactgcatataatactggtgcaacaaataagaatgtaaattctaatggttcagttataccagttaagaaagatgttactgctgctgataataataaacttcctactacttttttcttacttggagcagctgtatgatacattgctaatgctgctgcaggtaatccaaacatcatgaatgggaatttaccagccataaatctagtagttcctgcaactattttagacatagtttctggtgaagctcctactaaatcttgcatgctacctaattgtgcgaagtatgcataattcgctccttgtactgttttccatgctccatctattaaaacatgtccatctacgaaagaaccaaaccaaaatggtgtatagaatacatgatgtaatccaaatggtattaatgatctttctattaatccatagaagaatgttcctattatacctgcattattaactcctaatgctatgtaagctattgcgtcttgaacaaatggccatataaaagcaagtattgcacctacaattgccataactactgaaactactattggaacaaatcttgatccagagaaaaatcctataacttgtggtaattgtatattatagaatttattgtgtagtgtagatgtaactataccagttatgatacccccaaacactgacatattaagagtaaatattcctagtgttgaagttacatatgttgcatattgagctggtgtatttgcttctgttacaacacctaatctagtaactcctaaagctaataatacacttataactttattcattattaaaaatccaaatactgaagcaagtgcagatgttcctttatcttcttttgcaagaccaactgcagtacctactgcaaatagtagtggtaaattaccaaatactatatctcctacaccttgcattatttttaatactactgtaattgctggaatagatacaaagcttataagtggttggtatatagctggagcattatctagtgctgctatattaagtaaagctcctccaactcctagtaaaataccagcaaccggtagtgctgctattggaagcattatagccttaccgattctttgtaaaaattgaagcatttcataattcctccttacttattataatatgtgtaattaaatttaattttagttaagttttcatgcattattactataataaataaaaaagagctaaaatattcatatttatgcgtactataaaatagttacataaatataaataatttagctcttgcctgctttaccagtaacacgctctttatttatttagtataaattaagtataacatttaaattgtacgttgtaaacaatttccctgccacttttttgtactatccgttagaatttgtcattaatctatctatatgaagtgctataaaaccgacttcaccttcatttaaatttatatcatggtttaattttagatattcgcataatacttcagatatactgtacgatttatttaacttctcccttatatgatctaataacatattttcttcagatattcccttaatagatctgttaatagcaagtcttaaatgtactataagtctattgtagtatattgaatctttatatatatttatatctaattctttttctaaaaaatctatagcttctttaattattatagcttgtttagcactatctactgcttttgttttatttaatattccatttatatgcatagttacaaatgctatttcatcttcatttaatgttatatctaaagatttatttataaaatcaactattttctttgctaattcccattcatattcatataaagtctttaattctgctttgaattggttttttaagcacatattgtcatagtatctttctattgcaaatactaaatgatctaataatgccatatgtgatttattgtttatatctacatctatactatcatctattgtagataaaccctctgttactaccccaatatagtttggatttattgtatcgtataattcctctaaacttttatatctatcttcatttataacaaatattttttcaattttatctacatctttaaaaattgaatttgtagatgctttaaatccaattccatttccaattaaaatatactccttatttttattttcttctatacatagaataacgttattgttaaagctttttataattttatacatattccctccttatttacaaattatatgagaatctgcttaaatatcattttactttattaatatacaatatttcataatttaagtatacctgtttattgatattaactgctattttcccaaaattttaaatatttttataaaaattattttaattttcatgtgaatgtaatttaatattttattttcattttcctttttttagggtataatatgcattagataatacataactttttaacaatctagttaagggttaattttcttatggaggtttttaatatgttagtttcagctaaagaaatgttaaacaaagctagagaaggtaagtatgctgttggtcaattcaacataaataacttagaatggactaaagcaatattacttactgctcaggaaaacaattctccagttatattaggggtatctgaaggtgctgggaaatatatgggaggatataaaactgtagttggtatggttaatggaatgttagaagaattaaatataactgttccagttgcactacatctagaccatggtagttatgaaggagctttaaaagtaatagaagcaggattctcttctgttatgtttgatggttctcactactctatagaagaaaacatagaaaaaacaaaagaaataataaaaatagctaatgctaaaggaatatctgtagaagcagaagttggttctataggtggagaagaagacggtgttataggtgctggtgaaatagcagaccctaatgaatgtaaattaatagctgatttaggtgttgatatgttagctgctggtataggtaatatacatggtcaatatccagaaaattgggctggattaaactttgatgctttagaatctataaataaagctacaggagatatgcctttagttttacatggtggaactggtataccagccgacatgataaaaaaagctatatctttaggggtatctaaaataaatgttaatactgagtgtcaattagcttttgctgctgcaactcgtaaatatatagaagaaggtaaagacttacaaggtaaaggtttcgaccctcgtaaacttcttgctccaggatttgaagctataaaagaaactgtaaaagaaaaaatggaactatttggttctataaacaaagcttaatattataaatattttttaaaatttatatataacactgtttatatcagaaatattaatgattatgtaaaataaaaggactatctaattttagatagtccttaatttattaatgttttttgcatatcttaactactgtttcaacatgaggtgtattagggaacatatccatacacttaactctttcaacttcatatccatactttttaaattctactaaatctaaaactaatgttttagggttacaagatatataaactatttctttagaattaaatccagctatatctcttatagcatctttatgaacacctggtcttggtggatcaactattattatgtctggtttagcttttagtttattaactgtcttagcaacatctcctgctataaattcgcagttagttaacccatttaatttagcatttttattagctgcttctactgcttcctctattatctctattccatatactttcttagctttttctgccattacttgacctatagttcctgttccactgtataagtcaaatacaactttattattatgctctccaacaaattctctagctattttgtataattcttcagctcccttagtgttagtttggaagaatgagaaaggagatattttaaatttaagtcctaaaagttcttcttgtatataatctcttccatgtaaaactcttaattcatcacaattaacagcatctgctaatccatcatttatagtatgtaatatacttactaaatcagcttttaaatcaagatttaataacatatccttatactctgtcatatcaaaatcttcttgagatgaagttactatatttaccatcatttcatttgtgtttataccttttcttactacaagatttcttaagtatcctttatgactcatatttctatagtaaggaactttcttctcattgaaatattcaaccgttgaagttaatacttttataaaatcatcgtctactaaaaaacatccatctactgttaatatatctatatgttttccttttttatgtagacctaaagttaaaggtccatccttcatctcatctccaaaagtatattccattttatttctgtattctttagcttgaggacttctttctattccttcaaatttaaatccaaatatatcttgtgctaaaaataaatccattacttgtctttcttttatttcaagttgtttttcatatggtactgataatatactacatccaccacatacattaaaatgcttacatggagtttctgtttcaataggtgagttttctaatagttctagcatcttaacttcagcttttccacttctagtttttttaactgaagctttcaccttttgtccacttattccacctttcatatatatgtctctatttcctaaacgacttacagacgtaccaccaaactccattttatctacttcaaattctattatatctcttctcttcacgcttttatcctccgttattaaagactatctttgttctataagtcttatctcttcttctgttagttctctatattctcctaattctagactttcatctaatttcaatttacccatagataatctttttaagtaaattacttttttacctacgctctcaaacattcttttaacttgatgaaattttccttcatttatagtaagttcaatttctgatacttcatgacttttaagtattacaagctgtgctggcatagtcttgtaaccatcatctaatactacaccttctttaaaagcacttatatcttcgttagttactattccatcaattttagcataataagtttttggaacatgactctttggagataataccctatgtgctaattgcccatcattagttaatactaatagaccttctgtatctttatctaaccttcctactggaaatggttcaaacactaaagatttatcatctatcaaatcaagaactattggatcatatttatcaaaagttgctgatatgtatccatctggtttatttaacatcaaatatataaattctttatattcaatagtttctccatcaaatactataatgtctttatctgtatctacttgaagtccaggattattttcaatttttccattaacacttactaatccttttttgcaatctctctttatttctgctctacttccatatcctaggtttgaaagtaccttatctaaacgttgctttttagccataagttataccttccttttaaaagtgttctccattttcatagtacttttctttctcaaatactgtaaatgctaaatccatgctttctacatctagattctttcttatactatcagttattattttagctactgtatcttgaacttcttgtcctctatcaaaccaagctacctctacaaatggataaacgtctgctatttttccatctcttatagctactgattttatacattctatctcaaaataatctcttggacatttaacagcctcaactaaatcatctatcattttttcacttattttacatatatcattttcatgtattcctcttattttaatttgtggcatatatatcatcctttctttaattatttatttacttatttatatagatattattatacttttaatttttcattattacaatttatctataaatactactacataaaaatagggctatctcaaatattattcattttgagacatcccttttttaattttaatttattaactataaaacttagatgctccgtttaactgttttttacctaacaaattagctaaacttgtaagtgatgctatacttattttcttaaaacttattacaaatactagtttaaaatcagtaaatgtctcatctatactataaacattaaaaaaacatcttatattatcatctaagtatcgctctcttaaatcagattcaatttcatctgttacatcttttacaaaagctcttacatcttcaaataaaatttgaatatcttctatattagcatcttcacccaattcttctaataattcatttatttcatctactgaaaatatagtgtcatctaactgacagtcaaatgccattatactatcttcttttatattagtcgatatatcttgcacactagcaaagtcttcacgttgatttagcatttcttttatatctatactttttatatttagggtttcttgattttgttttaattttacttctaacaattatttacctccccccaatctatctatttacttcatattaagtataaagtcttttatatcattccaactactcactcttattatattttcattatcgatatctttattgtaattattatctattaataatactgttaatccctcttgagctaattgcatagcattgcttggattatcttctatgaaaatattacattctagttctttagctttattaactttataatcacttcctaataaatgaacatctatatagcctaaatcattttcatttagccatccttgtgttatatcttttaacatttcatctctagctgttacaaaatataaattatgattttcatttaaatcttttattacttcttttgcaccttctaccacattagcttctttatatgcgtaaatataatctgtatggaaagcctttaataagtcatctagtttaacttcatatagttcttctaatttatgagttatacattcagcttctgttatttgtttattatacatatcatttaaatatggaataaaatgatatggattagttattgttccatctatatctatacatatgtttaactttcccatctctacctccagttgatac

SEQ ID NO: 34 - DNA, 3058354 bp, Clostridium sp. (residues 1,529,178-3,058,354 of 3,058,354)
  modified_base (246614)..(246712): a, c, t, g, unknown or other
  modified_base (380006)..(380015): a, c, t, g, unknown or other
  modified_base (408873)..(408983): a, c, t, g, unknown or other
  modified_base (506638)..(506737): a, c, t, g, unknown or other
  modified_base (619520)..(619618): a, c, t, g, unknown or other
  modified_base (996811)..(996906): a, c, t, g, unknown or other
  modified_base (1573758)..(1573767): a, c, t, g, unknown or other
  modified_base (1602122)..(1602131): a, c, t, g, unknown or other
  modified_base (1622352)..(1622450): a, c, t, g, unknown or other
  modified_base (1705391)..(1705498): a, c, t, g, unknown or other
  modified_base (1722606)..(1722676): a, c, t, g, unknown or other
  modified_base (1926207)..(1926349): a, c, t, g, unknown or other
  modified_base (2001456)..(2001551): a, c, t, g, unknown or other
  modified_base (2066144)..(2066180): a, c, t, g, unknown or other
  modified_base (2160595)..(2160604): a, c, t, g, unknown or other
  modified_base (2208858)..(2208895): a, c, t, g, unknown or other
  modified_base (2230563)..(2230572): a, c, t, g, unknown or other
  modified_base (2287816)..(2287885): a, c, t, g, unknown or other
  modified_base (2393930)..(2394015): a, c, t, g, unknown or other
  modified_base (2460390)..(2460397): a, c, t, g, unknown or other
  modified_base (2478222)..(2478231): a, c, t, g, unknown or other
  modified_base (2500004)..(2500100): a, c, t, g, unknown or other
  modified_base (2509968)..(2510100): a, c, t, g, unknown or other
  modified_base (2626186)..(2626284): a, c, t, g, unknown or other
  modified_base (2679690)..(2679759): a, c, t, g, unknown or other
  modified_base (2704310)..(2704316): a, c, t, g, unknown or other
  modified_base (2895461)..(2895470): a, c, t, g, unknown or other
  modified_base (2912241)..(2912248): a, c, t, g, unknown or other
  modified_base (2928449)..(2928524): a, c, t, g, unknown or other
  modified_base (2968980)..(2968989): a, c, t, g, unknown or other
  modified_base (2970187)..(2970228): a, c, t, g, unknown or other
  modified_base (3043629)..(3043666): a, c, t, g, unknown or other
cttatttttatggttaagacattatatcacaatacatattataaatcaaaaccgtactattagtatatgtatataaaagaaaaaacttgtgtattcacaagcttttccaaaaaatgtttcacgttcaacattattttccaattgttttatatttctttaatagtatctacaaatctctttatttctatatccgatagccttaaatattcttttatttctcctacatactttaaatttttactttttaataaactttgagctgaatccatagcctttcctcttaagatatatgctttttgtacatacatctttgattgtgctagttttttagtatctttatcatttgaaagacttggtactttcatatcttcatatgttttaactacttcttcacacatatctttagcataggaaacatctttttttgcattttttattgtttcagagttaatttttaaatgcttcatatctggcatacattctctcataggaactaaagcttttctttctatagaataaatattttctttaaatttatttataatctctttatcactttttccttttggtttggcattttttgatttattataatctttatttattttcttatcttctatatcgtcctctaaaatctctttattaactttaaatttattttcttttgatttttttggattttttttctttgataaatttgtatatttttcatctaatgcatatgctttataatctagcatatcttccattttatttaatgtacttatatatatattactaattactataacactggcaacaactatatagatactcccatatatactagctcgtttaaaatctcttctatatttaaataaagtccataacggtaatatatataagattaaaattactaatgcccatctcacattaacaactcctttacataaattttatgtattaggctaaccatatcttatagtatttaccagattatattaattaatccataatttttattatattaaaatttgtataatcacatgatactaatttatattcaacttcatttcgtattccttctaatcccatcttaaaagattctttaccatgaagatgtccatatagaactttttcaacacaatattgttcatatatatctgtaaacaatgatgattctaatttatcattagtaggtggataatgcgttattacaattatttttttaaatcctgcttttttagctgcatctaaagaaagctttaatctatgagcttcccttttataaattttttcatcttcttgtgtgaacttaaaatcatttgggcatatccaacctctagttccacagatagcataatctttgtatgagtaaaaattattttgcaaaaaactcatattttcataaagcttattcaatttagttacggtagtccaccaatagtcatgattcccttttacaaatatctttttgccaggaagtttatgtattatatctaaatcttgctcggcttcattcatatttataccccaagatgtatctcctacaactaacactatatcatcatctttaacttgacttttccaactattaattattttttcttcgtgattatcccaattgtctccgaatatattcataggtttattaactgcagttgaaaaatgtaaatctcctattgcatataaactcatattaatgtcctttctttattttaaaattaaaaaaagaagcgagatttctaccctcttctttttttattatacccttctaataaagtatctatctcactttttagagctattatttcagttatatctttctcactatcaattttatctaatcttctttgatatattatagctttttgagtttctcctagatcatataattcttgtatcttacctaatacgtctcttactgttatagattttacttgatacattacttgagctttcattatatgttctctaatttcactcatttcttgatctaataaaaatgctgcatcagctgctcttcttaatctcattgctaagtcttctggtatgtaatgttcatatttatattttaatgaatgttctatagttgcccaaaagttcatagctaatgttcttatttgtatttcacataaaatttccttatatccgtgtgctgtgtttataggatattttattattacatgataacttctatatccactatctttaaagttttctatatagtctttttcataaactattttcatatcatttcttgatcttataagttcaactattgtatatatatcttcaacaaactggcacattattcttataccagctatatcttccatttcctctatatctgaaatatctaatctttttgctttagatattattgatgctattttttttgttctacctgttacaaactctataggagaatattctcctttttttaaaagctcttttcttatattcttaaacttaactttaagttcttcaacagcgtgttcataaggaacaagtatcttatcccacttttcgtattccattatttctcaccctttattttcaaatttaccaacttctatattttaacataatttataatcattttgtataataaagaacgtctccatctcttaaatcataatttagttctcctaattttgttaagtagcttatcatacttactaatgttgacttaaaaaaatgatattctttataattataacttaatttattattgtttaatatagtttttaatatagattccaaatttttaggttctttagttaattctcttaattgatttaaatatttcattacacaaagttcatgttttttagccaattctaaggcttcatttctacttaataccttttttccatgacctaatacaacatactcaaagtctataatttctaatatgcttaatgattttaaataagcttctatatcaaataaaaataacaattcaaatttacttagtagctcttcacttactaatgtatcccctataaaaaatactttatctttagtaagaacacctatagaccctagtgtatgtccttttaaatctattatatctatatattcattatttattataattctacctggttctattgttttatctatattaactgtttccatatttttgtttgttagtatagtatttaaaaactcattagtgtttccacccattatatatgctgaaaataaaattggattatcaatataaggtttactatctttactagacatgttaatcagatctttaaatttatctttgaattgataacctgcaccataatgatcattatgttcatgtgtatttattatccattttacttctataccatctttttcaaggtctcttattatatttcttggtctagctcctggtaatcctgggtctataattagtgcacttttgtcttcaaatatataaacgcctgtattagtaccaccttttatataaaaagagtttccctttatatttattagcctcattagaatcaccttacaatactattttttttaatcttcttaatgccctactcctaatattttcgtcttttgatacctttatctttatattatacgccaaatcttcatataataaagactctataaaatattcaacgatacctctatctttaaattctatatcaataactccacttgaatatatcttagaatctaaaatcattaatgaatcagaaaaatttaatctttcatgcttttctaagtatctctcacttggtttaaaatcttcacaatagtttattttatagtttacaacatcatcattaatatcaaaaccatatttagattttattaaatttgcataatctttatttctcttatttatattgtctaaatttaaattgtaatcacttttaatccagtgtccataaatcctacaatttaaaggtctaacttcatatattaaacatctattattttcatctttaaaaggacacggactcttttttatatactctaagaagtaataatctattaccttatctaaacatctttttcttagatctttattgttttttaagtggttatatatatttataaactctactaagtttatacctactgattccatacaacactttccacatccagtgcaatctccacttggtacagtttcatatactttatttaattcactgattaaaccattgtttttagcaaactctatgcttttctctatatcaatcttttttaggctagccattattattactccttgttataattattaggttaatacaaacaattattataacacatttttttgaattttataggaggtactttatatgaatagatatactaaggttataaatatgatggaaagttactatacaaaagactacgagaaaaagaaaaaaaatgtaactaaaatcagagaagtaagagaagaaacagttagaaaatttttcttacaaggtgactgtgaagttttagttatattagaagacagtggaagagaaattttaatagatgacttctctccagaagaagaaataagaaagtatttaggtcctaaatttgttaataaaagatagttttatatccctaacaatttgttagggatatttttatacttttttattttttctgtataaaactataaatattgttaataatactagtatataaacaatatttaactcaatctcccccaattatgagctttcattcccctatgaaagctcttttttttattatatatattgttatttttaatatataatatataataatttactaagtaactattaaaaaggagctgttgtttatgataaaaatatataacttaaacttagatacagattttgattatagaattataagagaagaaaatgatgatgttgatttattcattgatgtcaattatagaagtgtagatatagattgctctgataatagcttcttttcatctagagttcaatttccttttgttagatccattatactgagatttaataaatctagtaatttaatgacggttcactttatgagagatatagatttattttccgcatttgcaaattttgaaatcaattgtgctgattctagtatatgtattaaaaataatcatgaaaaagtaatatttagtaaaaagaaactatctttataaaaatttactataaaataataagggggccttaataggccccttttaattttatatattattaatcaaatacaattcaataatttaggttaatgaatttatcttctctaaaattctaattttctcatatagcctttatttattttcaccttttccaaaagcagttaagtatatatcttttaattcagatactaatggatatcttggatttgccggagtacattgatcatcaaatgcatctaatgctaatttatcaactgatgccataaaatctttttcacttactccacactcagctatagttttaggtatatttaattcaactaataatttgtttatagcgtctattaaattatttacaccttcttcagtagtattagctttaagacctatatacttagctatttctgcatattttttatcagctacaaatgatttatatttagggaatgcagagaacttagttggtttagtagcattatatcttataacataaggtaataaaactgcatttgctctaccatgtggtatatggaattctgaaccaagcttatgagctaatgaatggtttatacctaagaatgcatttgcaaatgccattcctgccatacatgatgcattatgcattttctctcttgcttctctgtcacttccatctttatatgctcttggaaggtattcaaataccatttctattgcttttatagctaatgcatctgtgtaatcagtagccattacagaaacataagcttctatagcgtgagttaatacatctactcctgtatctgctgtaacagattttggtacagtcattacaaagtttggatctattattgctatatctggagttaattcataatctgctaaaggatatttaacattattaactttatctgttacaaccgcaaaagatgtaacctctgaacctgttcctgatgtcgttggtatagctactaacttcgcttgtcttcctaatttagggaacttaaatactctttttcttatatccataaatcttaatcttaagtcatcaaagtcaacttcaggattttcataaaataaccacatacctttagctgcatccattgatgaacctccacctaacgctattattgtatctggtttaaattgtctcataacattagcaccatttaatacagtttctactgatggatctggttcaacatctgcaaatacttctatcattactggattatttctttttcttaaatggtaagttaacttatctacataccctaactgaaccatcattctatctgtaactatcattactctattagtatctgccattttttctaaatagcttactgaaccaaattcatggtaaactctttcaggtattctaaaccattgcatattgtttcttctcatagtaacttttttaacatttattaagtttactgctgatacattgtctgttgttgaattgttacccatagatccacatcctaacgttaatgatggcatatttacattatatatatctcctatagcaccgtgagttgatggtgcattaacaagtaatctacctgttctaaccttttcaccaaattctaatattatatcatcgttatgtgaatgaataacagccgaatgtccaagacctccaaactctgtcatttcaacacatctttgtattccttctttataaccttttactttatagcaagctaatactggacttaatttttccctagataaaggataatcatgtcctacaccttctaactctgcaactaatatttttgtatcctttggtgcattttttattcctgccatttcagctattttatatgcactttgacccactatattagcatttattgtacaagtttctttatttataactaaaccttctagtaatttcttttcttctttatttacaaagtagcaatcataagctttcattaaagctactacgtcatcatatatttcttcatctattattacggcttgttctgaagcacatatcattccattatcaaatgtttttgataatattaaatcgtttactgcttgtttaatgtcagcagttttttctatgtaacaaggtacgttacctgctccaactcctaatgctggttttccagaagagtatgcagcttttaccataccaggcccccctgttgctagtattaatgataccccatcatttttcattaatgcatttgaagcttctattgaaggttcttctatccattggatacaatcttttggggctccagcagctattgcagcatctcttactactttcgcagcttcagatgaagacttttgagctgatggatggaagctaaatattattgggtttctacttttcatagctattatagatttaaacattgttgttgaagttgggttagtaactggcgttactcctgctataactcctataggttctgctattaatttataattttcttcttcattttcttctataactccaacagttttattgtactttatactattgtaaacgtactctgttgcaaatatatttttagttactttatcttcaaaaacccctctttgagtttcatctacagctagttgcgcaagttctatatgtttatcaagaccacactttgccatttctttaacaattttatctacagctttttggtctaattttaacatctcttttttagccttgttagctttttcgaccaaaacatttactctttcttctgctgttaattctttcttagttcccatatttactacttttttagcttctttactcattttaaaaccctcccaaaatgttgtttatttatttcaatgttagttatttaacaatctttatgtttatataatatacctatcaaaaaagaatgtcaatcatttttgttaattttttatccattatttaatgttgtaaaatatataataatctaattatttttgatattaactttagtatcttaatataaaaaatccatctgatttattaaaaattagatggatttttttatattatatttattacttaaaattaattatcacttcttcgtaacccaaatttttcaaactattttctaaactcttttttacgctaccacttatatcattcataaagccttcttctataatttttttctcatattcttttttactatttgctaattcatctataacttcatttgtttctactctattaaataatgcatttttaacatcataaacaaatatattttcttcatctatgtaatgatctataatactgcattttgctatatttaaagttatagagtctttttttatactatctatagtaacatcctttgaatttactccaccctttactactccattgtactttataataaatgatttttctgtgaaaggtatcttgatatttttaaaacttttatctttttttatagttactatattactataattgtactttgatgttgaaagttctaatacttgttctatggtatttaatacttttgatgtatcttttggagcttttttggaaaagattaattttaaagatagtgttattcctattatgattcctataattataaatattaataaaactctattcttattaatttttttacgtttttgtaacaaaattcttcctccttttgatataatataagttacggttaaaaagttttaaatttgtatacttaaataaaaattaatacataaattttttcaaatatgaaaggagacttaaaatgactttattagtttttggtcataaaaatcctgatacagattcaatctgttcagcaatatctttaacatacttaaaaaataaattaggacaatcagctaaggcttatgctttaggagaagttagaaaagaagctcaattcgttttagactacttcaaagttgatgccccaactgtattaacttctatatcaaatatatgcaatgatgatgctaacttagtactagaaggtaaacctcaagttatattagttgaccacaatgagtacggacaaagcatagatggactagaagatgctgatttagtagaagttgttgatcatcataaattaggaggattaaaaacagatactcctttatcaatgagattaatgcctgttggatgtacttgtacaataataactcaaatgtttaaagaaaataatgttgaaataccttatgaaatagctggtcttttaatgtctgctatattatcagatacattattatttaaatctccaacaactacagatatggataaaaaagctgttgaagaattaaataaaatagttaaagtagatgttgaaaaatacgctatggatatgtttaaagctggtacatcattagatggatttactgttgaagaaatagtaaatatggactttaaaccatttgatatggaaggcaaaaaggtaggaataggacaagtatttactttagatatagatgcagttcttaataagcaagatgaatttttaagttatataaatggaactgactttgatatgttattattagcagtaacagatataataaaagaaggttcatatttaatatacaaagctgaagataaaataatatctgatgcatttaaagtaaatgcttctcaaggagtatttgttgaaggtgcggtttcaagaaagaaacaattagttccaaatttaacagaagcagttaagaaaaatatataattttaaaatataaaaaaaagagattcttaaacttaagaatctctttttttataaccatatataatatacaattacattttttctacgtcagaataatcttttccaaatgtttcaactgtaacttttttcattacttgtggagtttgaggtttatccattctatcagttttaacagaagctatttcatctacaacatcaagaccttctattattctaccaaatgatgcatattgtccatctaggtgtggagaatttgcatgcattaagaaaaattgtgaaccagcagagtttggagccattgttctagccattgatataactcctctttcatgctttaagttgttagtatgtccattttgagtaaattctccttttatagagtatccaggtccacccattccatttccattagggcatcctccttgtatcataaatccaggtataactctgtggaatgtaactccatcatagtatcctgactctactaaagatacaaagtttttaactgtatttggagctatatgtggatataactcaacttttatttgctttccattttccatttctatagttactataggatttttattttccattttatgtacttcctttcttatgagttttatattctcattttatattatataccaataacactaaaaaatcacaaaaataagctacttattttagtagcttatttttcatttaataatgcagtttcttcataatttatatctaataaatctaatatttgcttagctctatctttcgtagatcctgaaacttctatataatttatattctctgcttttaagaaacttaatatagcttcatcgattttaatagctatactttcatcttgccatcttactccatctttaacatatccaaattctctaggaacgtatattatcatatcatagttttgtatatcttctaatgctaaacaatataaatcctttaaaatttgaatctctttttgagttctttttctatctcctagcataaatctaccgtatatgtaaggtacaaatgtagcataatctgtaagtgcataatcaaatgctgataaatcgtcttctattttcttttgccctaaatatataccatactgctcagatatagtttctatcatacccttatctcttaaatattcagtagagtattctaaagcatatcctacatctaatccagatatcttcatttctacatataagtgttgtattaatgttgtctttccgcatctaggtccacctagtacagcaattcttttagttgccataatttatatcaactccatattttatatttcaaaattagaacttttttattatactaatatatgacaatttattcaatgtttttaatataattgtagttatttacaaattaatatccatattttttacaatttcataaccttcattaaatatcttcttacaaaactcaccttcaaatcttagagtagcatttttttcaaatatagtatttggtcttataataattatatcttcctctttatatatgttctttatatcttctggtaattcataatcatgtttcatagttataactattattttatccattttagcttctattaagggctttattaaaacattatttaatatacccccatctaatttatatccatcatataacccctctattaaatctttgccaaattgttcaaaaggctttaactcttttgacggtctaaacggaagtaatgaactatattttatacttaataatgtatcttcataacttagttcagatatatctactattttttcttctaattttgaattttcaacttccacataattgatatagcaaggttttgaataacttgagttgttgattaatcctcttaattcatcaattgctaaagaattatccacagtattatcaactattttgacaccgttttcaccaattttctgaatgtttatccacatttctttcaacttgttaacattttctgtgtatatataatatccatttatagctcctatagatgttccagctatagcatcaaattttattcctttttcatataatccatatataactccagcttgaaatgctcctttagcccctccgcctgctaggcataaacctgtcttcatctaaaatcactcctattctttttcctatatttattttcattaatgattataggggatgtctaaaagtaaaatactttttatacatcccctaactttaactttttttattgattttataattcataaaatgttttaaaagtcttatatatatccatatgatcttctacacagcctagttctcttatagaatgcatagcaagtatcggacttcctacatctactgatggtatatctatatgtgtagatgatataggtcctattgtacttccacctcttacatcagatctattaacaaattcttggcagttaactccagcttctttacatatagatttataaacagctgtagattgactatcacttgtatatgcttgatttgcatttatttttataactggtcctttacccataactggtctatttgttggatcatgtttttctgaaacattaggatgaacagcatgtgcaagatcagcagatattataaatgaagaatataaacttctaaagaattcttctctactttgacctaaacataaagatattctttctaatacatttattagcatattagaatctgctccttgcttagttgaacttcctacttcttcattgtcaaatactgatactacattaacacctcttgaaggtttagaatctattaatgcatgtaaactagcatgtgccatagataaattatctagtcttccacaagatatcatttcttcatttggtcctattagcatacctttttcatattcatataaaaataaatcaaaatcaagtatttcctctacttttcttcctaactcattagctatagtttttattaagaaattatccttttctaatgtatcatttaatagtcctactaatggcaacatatccttttgcttatttaaagctacaccttcatttacttgtctattcatgtgtatagctaaattaggtattatacatataggtctatttatatttattaaagtttcaacaggtcttagtatatcttctccttttaatataactctacctgctatagctagtggtctatctagccaagtgtttaatataggtcctccatagcattctgtatttaattttaaataagttttttcaacttccatctctggatttggtttaattctaaatgaaggtgaatctgaatgagaacctattattctaaatccatcctcttttaaattatcagtatcaacagtaaaagctattatagctgatgaatttttagttgtgtaatactttccgcctttttctatagtccacttgtctctagcatcaagttttttaaatccattcaatttcaataattcttctgatgtttctactgaatgaaaagctgttggacttttctctataaacccgattaaatttctagcaaattcttttgaattcatattaaatcccccttaattatattaaattttatagtaaatctaatgtagtgtattctttatttattttctttataccttgattattaaaagctattgttaaatcagaaccagaagctgctactacagttcctactccaaacttaggatgatgaaccttagaacctaattttatatcatcaacattagattcagttttactttcttttatagtagcattaaccttacttgcaacattcgccttattcatagacttcatatatttttgcttatacttatctaatatattgtaatttgctttagaataacttagctcatgctcctctttatttaatttttctatacactcttctggtaattcctccataaatcttgattgtatagatggattagtttttccataaagagttcttttctttgtaagtgtcatatataactcttttttagctcttgttatcccaacatagcaaagtcttctctcctcttctatatctgactcactcatagatcttacggcccttgatattgggaataatccttcttccataccaactaaataaactacaggaaactctagtcctttagatgtatgtatagtcataagagatactctatcgtcttcttcatcatcactttctgaagaagtaagtgcaacattagttaagaaagtttctaaatctttttcttcactagtattttcaaattctatagctatagatataaactcttttaagttatctattctatcttgagattcttcacttttatctttttcaagttcatctaaatatcctgtaacatcaagtaccttttctataagcttacttacggaataagcatcttttattactctaagtgttcctattaaatctacaaatccatttatattcgctctagcttttgtagatatatctgaattagtatctacatctaaaagcacagagaatatactttcttgtcttaaacttgctctatcttctattttttctatagttctaagtccaattcctcttttaggtacatttattattctttttaaagatatatcatcttgtacattttgaagaactcttaaataagcaactaaatcctttatctcttttctttcatagaatttagtaccaccatatatattataaggtatttgacttctatttaaagcatcttctatagcacgtgcctgtgcatttgctctgtatagtactgcaaaatctttgaaaggtttattttcttttctatggattctccatatattatcagctacaaaatcagcttcttccatttcatcatttgcaacttgtatctttattttttccccttctttttgctcactccacagtttttttctttttctttctatattgttagatataactgtatttgcagcatccaatatgacttgagttgatctataattttgttctaattttacaacatgaacatcttcataatctctttcaaattcaagtatatttcttatatctgcacctctccaaccatatatactttgatcatcgtctccaacaacacatatattttgatgctctttagctaacaattttataaattcatattgagctttgcttgtatcttgatactcatcaaccattatatatttaaatttatttctataataagctagtacgctttcttcagtctttaacaattctactgtctttattattaagtcatcaaagtcaagtgcactatttctttttaatctatcttgataaagtgtatatacatcagcaattttactcattctagcatcatttctatgcatatccttatattctttaggagttagtaatttatcttttgctccagatatataacttataacaactttaggctcaaatgccttgtcacttaaattaagttcttttaaacaatctttaactaaagttacttggtctgaactatcatatataacaaaagatctattatagcctattctatttatatcttttctaagcattctaacacagcatgagtggaaagttgttatccacatatcttttacatctgaatctatggtttcttcaactctttccttcatctcatttgccgctttatttgtaaatgttattgctaatatattactcggatgtactcctttatttttcataagatgagctattctagttgttaaaactctcgtttttccagatccagctcctgctaatataagtactggtccttctgttttaagtaccgcttctttttgggcggggtttagcgaatctatatccattaattacctcctacagtcaatgttatatgtatattttaatctattatctatattaattcaaatttattaattctacatattaatgatatccataatttacaatctttaaaatcatatcgtctttataattaaataaaaactccttagataaaatctaaggagctaaagttaggctaaaatataatttctttatttatattaatctaataagattaggggctcaattatatattaggatttaaaacaaaaaaatcccaataccgggattagaattaatataacttaatagtttgtatacaaaataatcatcatcaacttattatatacaaattttaaactattttccttcaccccgaagaaattaatttatatattataggcaggtctcctggcttagcttcatcttactacttttccttcccataacttatattaagtcacagtggtatcaaaagtttcatcagcataacagtagcgggggctgcagaggattctaacctctttccctattaattttataaataaaaacctataatataggatattaaattttcatcatatgtaatagtattctataaaaatattattactcctttatttatatttagatatctttatattttaatcatattatatttaaactagtattattacaatataaagatatttatctaaaaatttagtttgataaaatcctttaaccatatttactaatttaatttcttatacatcatccaacgactaaaattgcctatctagtattttgtctaatgcaatttatactttctatttactttaatatattgaaaataaataaggaagaaatctatttagatttcttcctttatatattattttccaaaatgtctatttaataaacctaagaatgctttaccatgtctagcttcatctttacacatttcatgaactgtatcatgtatagcatctaatcctaattctttagctttcttagctaattttaattttccgtcagttgctccgtattctgcttctactcttgcttttaagttagcttgagtatctgctactactacttcacctaataattcagcaaatttagctgcatgttctgcttcttcaaatgctattcttttataagcttctgctacttctggatatccttctctatctgcttgacgactcattgctaagtacattcctacttctgtacattctcctacaaagttagctcttaatccttctactacttctggatctacgccttgtgctacacctattctatgttcatcagcccaagtcatttcacctttcatttcttcaaacttactagctggtgctttacatatagggcacacttctggtggcatttctccttcatgtatatatccacatattgtacaaacaaattttttcatatttataatcctcctaaatttatataaactttttattaatttccctatcaattcaacctttaattttgttaacttttgactttactcatatatatactaccctatattactatattaaatcataaatttcaaaatttttctgacttttagttaatataataagaggaattatataattcctcttattatattatttcccaaaatgtctgtttaataaacctaagaatgctttaccatgtctagcttcatctttacacatttcatgaactgtatcatgtatagcatctaatcctaattctttagctttcttagctaattttaattttccatcagttgctccgtattctgcttctactcttgcttttaagttagcttgagtatctgctactactacttcgcctaataattcagcaaatttagctgcatgttctgcttcttcaaatgctattctcttataagcttctgctacttctggatatccttctctatctgcttgacgactcattgctaagtacattcctacttctgtacattctcctgtaaaattagctcttaatccttcaactatttcttcatcaacaccttgggctacacctattctatgttcatcagcccaaaccatttcacctttcatttcctcaaacttactagctggcgctttacatataggacacacttctggtggcatttctccttcatgtatatatccacatattgtacaaacaaactttttcatattaaaatcctccctttaaccttatctatattaataaattaaaattaattcatattaatttcttattaacttgttataatacatatatacccgtcaacatttgctttaaacaaaaattgaaaataaatttaatattttttaaatttataagaataattatatttctataaattaacctaccatataaaaaaagagctatcttttattaaaatagctcttaaaatttatttttctagtaattcatcatgaggccaacctttttgaccgttttctagtataaacaatctatctgcttttatacctttagactctaaatgatctatagtttttttagctccaccgccaccacctgggcacactactattattggattttcattttcttctaattgaggtaatattttatctaatttagctttttcttcttcagtttctaccggatatgcatatgtaggaattacaccctttatatgatgcttcttataatctttttcaacttgtatatctaacaatgtaatgtcttcttttttctcaattgcttctttaagttggtctgcagtataataattatactttttttcattactagtttcttcccctttgctacaccctactaaaactaatgatgtcattaaaaacaccatgctacataatagtaaaaccttcttcataataatcctccctaatatacgatttcaattaaaattttacattaatattcaaaatattacaaatagattttttatatagcaatagttttggatatcgatttcctctatattaaatttaaattttttcaaataaaaaaagattacgtggctacgtcctactctcccaggcggcttcccaccaagtaccatcggcgctaaagagcttaacttctgtgttcggaatgggaacaggtgtatcctctttgctataataaccacataatctttatttggagcgggtgaaggggatcgaaccctcacagccggcttggaaggccggaactctaccattgagctacacccgcatgtttttaatactttgaaaactgaataacatttataagattaaaattcactataatcatttcgccaacgtctaaatattcatatgcattcatatttatcccgttgctcaaataatcttggtcaagtcctcgatctattagtatcaataagctacatacattactgtacttccacctttgacctataaaaaaagtgtattagaaaaaatcaagaataacaaagatgaaaatgataaaataactatattttcttatttaacaaaactaagacaattatgtcttcatcctagaattttactaaaagattacagtggaaaaagttctaaaattgatatttgtatagatatattaaaagatgctatagaaaataatagaaagatacttttattttcacaatttactagtatcttaaaatttatagcacatgaaatagaaaaaaataatataaaatatatgtatttagatggtaaaacaaaatctgaagatagaataaaattagtaaatgaatttaataaaaataatgaaattaaagtatttttaatatcattaaaagcaggaggaacaggtcttaatttaactagtgcagatatggttatacattttgatccatggtggaatatagctgttgaaaatcaagcaagtgatagagctcacagattaggacaagaaaatgtagttgaagttataaaattaatatcaaaagatactatagaagaaaaaattataaatctacaagaaagtaaaaaagaacttatagaagatataattgatgataagctttctaattccaaaacactaaataagttgagcaaagaagagttgatagatttatttaaatagaaattattttatattaaaataaaaggttttatatattttaaatgtgtaaccaaacttcaaaatactacatactagtatataagtagaatattctacttatatactagtacaggagatgtatataatgggaaagaaaaaagttgaagaaaatattaaaaaagttactaaacctgtaacagatgtaggaaaagaagtaataaatggagcaggtaatattagtaaagaaactataaatactggattaaatgtaggaaaagatgtattaaatggcgtaggaaatattgctaaagaaactataagtacaggggttaatgtaggtaagaaggttaaagaaaatattaagggtaaatagttattaaaagggagtggtatactccctttattatttaatatgtaaatattgggataaacacaaaatgacaaaaaacgacaatgattctgagttataatatctacataaaagacatcttgaaaggagatttataacattggggaataagttggagttattaaaagaatcatatgaattactattagaggtagatgaaatattaaaagagaattttgattatgaaatcgatatcaaagatggatttttagatgaagaaaatgaaataataactataaaagatgattttggaagttatatacaatatgatgtatatgattgttacacagcattaataaaagtttcaaaactttacaatgacactaaaatacataatatatggaaaagattaaagagaataagtatagaagctgaaataatttattaagttttaattagccttaaactatatagtttaaggctatgattatataatgaaattataggattataaatttaatgtgatataataaaagaaaataaaaaagggtaaataaaaatataaaggaaatttaacgttatgaaagttacaataaaagatgtggcaaaggaagctggggtagcgacgtctactgtatctagagttctatcaaataattcaaaaataagtgatgaaacgaaagaaaaagtacataaggcaataaaaaaattaaattataaaccaagtgctatagctagaagtttagcaaataataaaactagaattttaggtgtaattttgccaaatgaagcacaagaatttcttgataattcattttttctaaatgcaatgaagggaataagtatttatgcacaaagtaagggatattatataacttatgtctttacaaaagaaaataaaaaagagttagatagcataatagatattattgatgcaaaattaatagatggaataatactattaagatcagaggaaaatgataaaagtataaattacttaaaaaaaattaattttcctttttcagtaattggaaggccggaagattctaatgatatattatgggtggataatgataattttcaagctacttacaatgttgtaaacaaacttgttcaaaggggacatagaaatataggatttattggagctattgaaaatctaaatatgtctaaagatagattaaaaggctataatatggctttagaaataaatggaataaatttaaatgaaaaccttataattcatggtaaagattttactgaagaggaagggtatatttgtatggaaaaattgtttgcaaataatgacttaagtgcaatcataactactgatgatttattagcatttggagttagaaatttattaaatgaaaaaaatataaaaaatatatctttagttggatttaatgatacgaaattagataaatatcaaaatccaccgctagcatcagtaaatattaatgcagatgaattaggatattatgcaacgaaacttttaattgataagttagagaataatagtgttataaacaatcattatattgtaaaaactgaatttattgaaagagaatcatttatataataaaccgcatatgtatatatgtggtttatttaatgcaaacgattgcttaggatttgaaaatataaaatataaatatggtgaaattcttgaaaacattttcataaagtggtataataaacacataaaaatcaatctaacgaagtgaattaatatatttttttaaaaaataatgcaatcggttgcataaaagaaaggggatttataatgaatagcaaaactaaactaatatcttttgatttctggcaaaagctaggaaaagcacttttagtagttatagcagtaatgccagctgcgggacttatggtttctataggtaaacttataggtatgtcatcagatgcccattttataatgacaactgcaaaagttgtagaagacataggttggggaattattgggaacttacatatattatttgcagtagcaataggaggatcttgggcgaaagagcgtgcagggggagcttttgcagcagtaattgcttttatattaataaatcgtataactggagttatactaggtgttacatcagatatgctattagatccaaatgcaacagtaacatcattaacaggatctacacttttagtaaaagattattttacatctatactaggtgcaccagctcttaatatgggggtctttgtaggtataatttcaggttttatgggagcagttctttacaacaaattctataactttgataaactgcctaaagctttagcatttttcaatggaaaacgttttgtaccatttgttgtaattttagggtctgtagtgggggctattgttttagctatagtttggccatttgcacaaagtgcattaaatgcatttggtatgtggattgcatcttccaaagatacagctccagtattagcaccttttgtatatggaactcttgagagactattgttaccatttggacttcaccacatgataacagttcctatgaattatacggaattaggtggagtatatcaaatagcaacaggagcagctgctggaactactgttgcaggtcaagatccattatggcttgcatggataacagatttaataaatttaaaagctgcgggagatacttcagcatacaatcatttattaacaagtataactccagctcgttttaaagcaggtcaagttatattatcaactgcatcacttgcaggtatatctcttgcaatgtataaaaatgtagataaagataaagcaaaaaaatataaacctatatttatttcagctatgttagcgtgtttcctaacaggagtaacagaaccaattgaatttatgtttatgtttatatcaccagttttatatttagtatatgcagtacttactggacttggatttgcacttgcagatataatcaacttaagagttcatgcatttgggtttatagaatttttaactcgtactccaatgatgataaaagcaggacttactatggatttagttaacttctttatatcatgtgcagtatttttcttattaaactttggaatattcaatttcttaatcaagaagtttaatattgcaacaccaggacgtagaggtaattatatagaagaaggtaatgaagaggataataaaaaagttgatacaaatatggcacaagatgttttatcaagtaaaataattaatctacttggaggagcagacaacatagaagatgtagatgcgtgtatgacacgtttaagagtaacagtaaaagatgttagtttagttggaaatgaaaaagaatggaaagcattaggagctttaggattaatagttaaagatagaggggttcaagctatatatggacctaaggcggatgttttaaaatcaaatatactagacatgttaggggcgtagtaaattgaaacttttaacattaaattgtcattcatggcaagaagaaaatcaaattgaaaaaataaaatatatagcaaaaactattaatgaaaaagattatgatgtaatagctttacaagaggtaagccaattaataaaaaaagataaagtatatgataatgttaaaagtgacaattttgcattgctattacaaaatgaattaaaaaaattaggtaataatcagtatgaattttattgggatgtagcacatataggatatgatatttatgaagaggggctttgtcttatgacaaagcttcctatagttaataaagaaagcttttatgttacaaattcaataaaacttgatttttggaaaacaagaaaaatagtaggattagatattatttataaatcaaaacaaattagatttttatcttgtcatttaggatggtggaatgataatgaagaaccatttaaagaacaagtaaaaagacttattaatgaaactgataatgaaaaattagtttttttaatgggagattttaataataatgcaaatataaaagacgaaggttatgattatctatgcaatgaattttttgatacatataagatttctaaagttaaagatgaaggaattacagttaaaggtaaaattgcaggatgggatgaaaataaacttgacttaagattagacttaatactttctaataaaaaaattgacgttgaaagttctaatgttatatttaatgggataaataaaaaagtagtatcagatcactacggagtagaagtatgtataaatataaattaaaaatataagttatggaggttgacatatatgaaaaaagtttggtggaaagaagctgtagcttatcaagtatacccaagaagtttttacgattcaaacaatgatggaattggagatttaaggggaataatagaaaaattagattatataaaagaattaggaatagatattatatgggtgtctcctttttataaatctccaaatgatgataatggatatgatataagcgattaccaagatataatgaaagagttcggaaatatgaaagattttgatgacttattagaagaggttcataaaaaagggatgaaattaataattgacttagtaataaatcatactagcgatgaacacccttggtttatagaatcaagatcttcaaaagataatccaaaaagagattggtacatatggagagatggtaaagctgataaagaaccaaataactgggaaagtatatttggagggtcagcttgggtaaaagatgaaaaaactaatcaatactacctacatttatttactaaaaaacaacctgatttaaactggaagaataaagatatgagaaatgctatttatgagatgatgaactggtggttagataagggaatagatggatttagagttgatgccataagccatataaataaagaggaaggtcttttagatatgccaaatcctaataatctaaagtatgtttcttcttttgataagcatatgaatgtagagggtatacatgaatatttaaaagatataaaagataatacttatggtaaatatgatgtaatgacggttggagaagctaatggagtaactccagaggacgctcacatgtgggtatctgaagaggaaggtaaatttaatatggtgtttcaatttgaacatttagatttatggaataacaatatggataaatctttagatttagttaagtttaagaaagtattatctaagtggcaaaataatttacacaatataggttggaatgctttgtttatagaaaatcatgatatacctagaattgtatctatgttaggaaatgatgaaaaatattggtatgaaagttcaacatgcttaggtcttatgtactttatgcaagaaggtactccttttatatatcaaggacaagaaattggtatgactaatgttgaatttgaaaatatagaagactatgatgatgtaaaaactaaaaataattattatttaggattagaagctggagaaagtcatgaaaatcttataaaaagagcttggagattatcaagggataattcaagaactcctatgcaatggtatgatagtgattttggtggatttagcaaaaacaatccatggataaatgtaaatccaaattataaaactataaatgtcagaagtcaaataaatgatgaaaattcaattcttaatttttataaagctatgataaaaataagaaagtcaaatgaagcattaatttatggggaatataagttaatattagaagatgataaaaatatatatgcatataagagagttttaggaaatgataagtttgtgataattacaaatatgtctaatgaaaaagttatgtataattataaagatattaaattaaagtatgagaatttagtaatatctaatttagaagtgaaaaaacatgaaataacaaatagacttgagctaaaaccttgggaatgtagaatgtacaagatttaataaagggggattatatgacggaaaaagagaagatgttaagtggaaaagcctatatagcatcagatgaagaacttgttagagaaagaaaatatgctagaaaaataactcgattatttaatcaaactacagaagaagatgatgaagagagagtggttttattaaaaaatctatttggagctactggagaaaatatttatatagagccaagctttaaatgtgactatggatctaatatttatataggagataatttttatgctaactttaattgtataatgctagatgtttgtgaaattaaaatcgggaaaaatgttatgttagcaccaaatgttcaaatttatacggcatatcatccaatagatgcaaaacttagaaattcaggtattgagtatggagcttctgtaactataggagataacgtatggattggaggaggagccataataaacccgggagtaactataggagataatgtagttataggatctggaagtgttgtaaccaaagatataccagctaactgtgttgctgtaggaaatccatgcaaggttataaaaactttataaaaaataaaattagctatctttattaaagatagctaattttatttttttatattacttagatggtaaaataaatacagaatgtatggctttaattggatttacaataattctttatttactaaatataataggtttttaattatatagaaatatataataaaattagtaataaagtatcacttttcacatataaaaactaataaagaaatttttatatgtggagggtttatgaaaagtttattatcaaaaatagatgaaatgaaaaaaaatttacaacaaaaagatataaaatctataaaaagtagtaaatttaagactatatccacaaaagatattaataatgaaaattcacaaattgttaatacatataattattatgtaaaattaacaaaaagagttaaaaaatatataaatacagatgaagatataatatttgaaactagaaaagatatatacaatagattgatttgtttgatgataaaattaacaaaaagtgaaatagaaatatttatgaaaatagatatacgagtaattactggaaatacaagagatacatatatggactgtgcttactacaatatgaacgatgaaggtgttttgtatataaaagaattttcttcagggaagccaaaccatggatacggaagtatattactgaaaaatttagattatatagctaataaaataaatatgaaattagatttgtataatcattattttgaagattatacatttaactatataaaaaaaatagaaggagtcgcgataccttataagcctataataagtcaagagaatctaaataaaatatacagaaaatatggatttgaagtagatgaaaaaaataatatgaaaataactagatatattaaaaataaagaattaatttataattagaatatcaatttagtttttggacaaattaaatatgaaatatatttatcatctaggaggatttattatggataataataaaaacagacataaagatagaaaaaaaactaatgctgaaaaaagaaagatattatttgaacatggttctgaaataggaatagtagatggtaaaaaaataggagctagaaattcaggctcaactaaaactagagatgaaaagttatatgataagataggtaaaaaaggaacttattaaataaaaaataggtgtaatgattaaatcattacacctattttttatttaataaaagattgaaaaaatatttatataagtatcagcattaacaaaaaaatataaggaacatattatataaaagataattaaacccaaggagggattgatatgaagtatgcatcttataaaataggaaatatagtagatatacaagacattaaaggtcaaccatataagtttataactatagcaacaaatccgtgtgatatatatacatttactaggttaatttatagtgaccaaactttaatacttgattgtgaatataatgaattaactattaaagatttaaagatcggagataaagttatagcttatcattctaatgcaatgactatgagtataccacctcagactcaagtatatataatagaagtaaaataaatgtataaataaaaaataagctatatagtaaattgctatatagcttattttttatttatacagattgatatatcaattttatagctactccaatagccataactaaaaatataggctttattaaagttgaccctttttttatagcaactttagcacctacatatccaccaataaccatagatattgcataaaatatagctatattataaagtatttgaccattaaacataaacaatataagtgctgtaaaattgctagtaaaatttaatattttagtattagctgatgcatgtaaaaaatcaaatccatatattttaataagagcaaatactaaaaaagttccagtgccaggcccgaagaatccatcataaaatcctaatgaaaatgccatgattactcctaatttaatatttttactagtaagtgtttcaaatgtgttttcagatccaagatctttttttaaatatgtgtatattgcaactactaaaatcattataaagactaatatgtttaaaatagtatcacttatagataaaacacatttaacacctaatatacaacccaaaattgtaaatggaataagtttttttagtaattcattattagttttcccagattttgtatatctataagcgctggaaaaacacccaaaagcaccagcaaacttattagttccaagtgctaaatgaggagaaagtccagacattaaaagtacgggcatacttataagacctccacctccagctatcgaatcaataaaagcagctaaaaatcctccaaagcaaagaaaaattattgtaagcataaaccctccaaaaaaatatataatatatgtattaattataatataaaataatctaaagatgttattataaaaattagtgataaacataatcatatatgtaataaactaatcatatattttagtaaggtataatatataaattgggaggagtgattaatatggctaaggacatagttatagattttttaacaaaattatctttagatatagaaaataaagctaatgtagatataagttatagccaacaaagagattacttttctagtggtaaaatactaggccaacccatatactatgtatttaaatattttagaaaagagcaacaattaggtatatatatagaatcaagagattctgaaggggcccaatttataaaagatatatactatgaaaaaaatgaatctatatcaagaaaaatagggtatgaaataggtataagtgaaagaaaacaaaataaagattgggttagaatgggttttgaaatagatgtagataattttagtgaacttatggaatatagaaaattatattttcatgcatttttgaagtttaaatcatctatagaaaaaatagttgaaaagtatgtagatgcaatatttaattttactggtaattttggatatactaagacagaacttctaagagaagtatttatggatgaagaagttttagatgatataatatttaatttagaacaaaagaaaaatataatattacaagggccttcaggagttggaaaaacattcattgcaaaaagaatttgctattttcatcaaggtaatagagataactctaatattgaaatggtacagtttcatgaatattatacatatgaagagtttgtaagaggatataggcgagggaaaaatggagaagattacataaaaaatggtatattttatgattttataaaaaaagcacaaacatatccagaacataagcattactttataatagatgaaataaatagaggtaatttaaataaaattttcggggaattaactatgctaatagaaaataataaaagaggaaaagaaaattctataaagcttttatatagtgaatgtgatgaaagtttttatatacctgaaaatgtatatattataggaaccttaaatacatcagataatacactaaaagatatatcatacccattaagaagaagatttggatttattgatatagatcctgtttttgaaaatatggatttaagaaactatcttggaaattatataggtgttgagatggcagataaagtagtatgtaagatgatgtatttaaataaaactatagaagaagataataaacttggaaagagatataaaataggtcaaagctattttatgattaatgagaaagtagacgaatatcaagtgtatagttggtataggcaagttataaaaagagatatagaaccattaataagagaatatatgatagataaagatgaagaatacatagataatataattaaaaatttaattgatgattaaaaagtctcggatataaataaatattagaggcttttttatttatctttttaatgatatataaattactatataatataaaatataattgaataaggaggttttatattatgaatgccaaagatagaaggaataaaattttagatgttttaaaaaattcaacacaggcagttaatggatcacaactatctaaagaattaggagtaagtagacaagttatagtttcagatattgcactaattagagcatcaggaatagatataatatctacaccaaaaggatatatacttaacaaaaatgtagatgatagatatatagttaaaacaatagcatgtaaacattcaagggattgtacagaagatgaattaaacttaatagttgacgaaggtgctacagttgtaaatgttatagttgaacatagtgtttatggtcaattaacaggagatttacatttatcatcaagaagagatgttcgtgagtttatgaaaagtttaaatgaaaattcagttaatccgttatcacaattaactgatggaatacatttacatactataaagtgtgaaagtgaagatatattaaatagtgttttaaataatttaaaagaaaaaggttatgccttatagagttgacataaataattactaactatacaattgtaattaagggtgtaaagacacttataattataattgtatgggggaatttattatgaatcgtaagtcaagtactaaatctattgtcatatcggctttattatgtgcattggggattataatacctatgttttcgccaattaaaataatattagaaccggcatcatttacattagctagtcatattgccatatttatagctatgtttatttcgccatctactgcaatatttgttacgttaggaacgacaataggatttttattaggaggatttccagttgttgttgtgcttagagcacttagtcatttagggtttgtaagtataggatcaatatatttaaagaaaaataatgaagttataaaaaatgtaaaatcgtcattattatgttcatttattttgggacttatacatgcagttggtgaagttttaatagtagtaccattttattttggggatggattgtcaaatggatactatgaacaagggtttatgatatcagttttaggtttagttggaataggaactataattcatagtatgctggattttggattatcagtttacatatggaatttaatgcctaaagaaattagaagtaataatacaattaaaagtactataaaagcttaaaataagcagtgctagatcaaatttatctagcactgtttatttttttatgtaaaaatttaacatatgtgttaaaaatactttaaaagtaagttataatatataatagaatcggaaattcatataaaatatagaaaaatattcataaattcacaaaaaattcatattaaaggtataatatacatatataatgtaaatatatgagttttatatgacttaaaggttacaaaaaaaatacaaattttgaaaatttattaaaagttagtatagttaatgaagggagatcaagtatgtttgatagaaagattgcaacagctatatcagtaacatctttaggtatagtactatcaggaacatcggtatttgctgatacaaaaacaggaacagtaacggcaagtgcattaaatataagaagtggaccatctactagttattcaatagtaggaaatgtatataaaggagatactttacaaatattagaaacatcaaatggatggtataaggttaagttatcaaatggaaaaataggatggggaagcggtaaatatataaatgtatcaggagaatcaaattctaatacttcatcaacaagtaagtcaggaacagtaacagcagatgcactacatgtaagaacaggaccatcaacaaatcacagtaaggtaactaaggtgtatagaggacaaactgtaaatatattagaaagttcaaatggatggcataaagtaaaaactccaagtgggcatgttggttggtcaagtgctgaatttatcagtttatcaggtggatcaaataattctggatcaaacaataatacaaatacagaaactccatcaagtggaaaaaaagcaacagtaacagcaagtgcactaaatgtaagaagtggaccatctacgaatgatggtgtaataggaacagcttacaaaggaaatactgtagagataatacaaagttcaggtggatggcataaagttaagttatcaaatggaaaaataggatgggtaagtggtaaatatttaagcttatcaggggatacaaataataatacaaacacagaaactccatcaagtggaaaaaaagcaacagtaacagcaagtgcattaaatgtaagaagtggaccatcaactagtaatggtataataggaaaagtatataaaggaaatactgtggaaatattagataattcaaatggatggtataaaattaaattatcaaatggacaagtaggatgggctagttctcagtatataagtacatcaggaaattcaaatagtggatctacaaacaatggaaactcaagtaatgaatctacaaatactaataaagctcaagctatagtaaacacagctcgtgctcaacttggtaaaccatatgtatggggagcagaaggaccaaatacttttgactgttcaggattaatatgttatgtatatggacaaaatggaataaaaatgccaagaacatcaagagaacaagctaatgtaggtacaactataagtcaatcacaattacaacctggagatttaatattctcaagtactgatggtagtggtagagttacacatgtaggtatatatataggaaatggacaaatgatacatgcgccgcaagaaggagacgttgtaaaagttactaacgcgaattcatcatattggcaaaaaacttttgtaaaagctaaaagagttttatagatattaaggtatagggagatatttaaaataaaaatatctccctataattattttacacaaatttaacatagaattttttatttatttaaggtaatactatagtgtaaaacttaaatataatttataattaatttatatatatttggaggtggagacgtgaagaaaaaaatatcatctttagttttagtttgtataatgatactttgtatgacgccaataaatgcatttgcaaatagtaatcataaaactattgttataaatatgaatagaagcaatctttctgattttttagaaataccagcgctaaaaaatgaactgaaaaatcgaggatatatcgccttaatgaatgtaagaggtgaccaaggtacggatgataaaaggtcatatgcaactataggggctggaggaagagtaaatacttatagtgatgattttaaaggatttaaagatgtagataaagaaaatcgagttttatatgaaagtgccacaggcaaaaaagctaaaggtgtaaatgatacagatataaatttatctataaatgacaacttagaaaatggaaaatatggatctatattaggagagttaggacaaactctaagtgataaaaataaaaaggtttcagttttaggaaatgctgatacaggaatagagcctaaagacctaaatagaaatatagcagctatggctatggacaactatggaagagtagatattggaaatgttgataaaataaataaaaaaaatgatgaaatgccatttggaataagtactgattataagaagttagaaaatgaaactaaaaaatattacaatgaaagtgatgtattatttgtagagttaggagatacatatagattagatttatataaaaaatacttaaatgaaaatacttatgcaaaaatggaaagtaaaatacataaaaatattagttcgtacttaaaagagctttttagtagtataagcaaaaatgataaagtatatataataagtgcttttcctaaagatatagattataaaaataaacgaagattatccccggttgtaaaatttgatggtagtggtaaagggttattaacatcagctacaactagaagagatggtataattggtaatatagatattgcagctggtatacttgcagattataatttatcatctaagaatatagttggtagaccattagaaacaattaaaatgaaagataataaaagctttatagaaaatgagtataaaaaaatagtaagtatatctgatgtaagaggaaatataatacattcttttataaattctatgtctataatactaatattaattataggtttattagtatttaaaaaaccaattaaaagaaaatttaaagaaaagtataataaaatgtttaatatactaaaagaattaattaagtttggacttatactaccactagcatttttattggcgcctatacttaattttaatactcagttaggtatatatatatcaataacagctatatctatagtgatatatgttttaggaaaattaatatttaaagaagataataaacaagtaggattttacgctactatatcaataatagctataacattagatgcacttttagggtcttatttaatgaaaaatagtatactatcatacgatgcgatagtaggagctagatactatggtataggaaatgaatatcaaggaataataataggttcgtctataatatctatgacaatactccttgtaaataataaactttcaaagataatggttcctataatttcatgtataatattatttttaagtgcatcaccatctatgggtgcaaatgttggagcagctatatctgagagtgttgcattaatactatttacaatgcttatatttgatataaaaatagacttaaaaaaatcaatatttatattagttggtgcaggagcagtagttttaggatttgcagctttagatatactaagtggatcagaatctcatttatctttatttgttaatcaaatattaactaatggacctagtgccataatagaaacttttacaagaaaaatatctatgaatattcaacttatgcaaaatagtgattgggtgaatataatatatataggtattttaagtataataataattaaaatagtatattctaaagtatttaaaggattaatggatgaatgtgtatatgcaaaaaaagcattaatatctatgggtgcaggagctatagtaactttacttgtaaatgactctggagtagtttcagcagcaacaactatgttatatatagtaataccatttttaattattatggttaataaaatagtttttaaagataaataactataaaatagcgtactatgtacgctattttgttttataaagtaacaagttctattaatccatcataaaatataataaaggcaaagcactagccaaaattgggggaatatttatgaaaaaaataggatttgttatagattcaaatgaaaatagtgctagtataaaactaaatgaaagtaaaaaaataataactgctaataacgatatagatgcaaagattggtcaagaagtatgtgtagaatttaaaaaaataaaagctataaaattaatatatataaatattatacaacctataatacttgccataattggtatactaattggagactttgtatcaataaatctcaatcaaagaactttaatatataaattagtatttggatgtattttctttactatagctataatatataaagattaccataaggaaaaaagtaagataagtggtgataataattataatatagtaaaaataatatctaaataagataatagtataaaaaatatcctataagtaaatatattataggatattttttattttaaatatattagcatttattaacttaacgtagtataatcaagtatagaataagtaaggagatgattttatgaatttaaatagaaatgatgattgttggtgcaaaagtggaaaaaaatataaaaaatgccatatggaatttgataataaattaaatgaattaaaaaaattaggttatgaagttccaacacatgatattataaaaaataaagaacaaatagagaaaataaaagaaagtgctaaaataaataatgcagtattagacgaagttgaaaaaaatataaaagcaggaatgactacagaagatataaataaaatagttcataactatactatatctcaaggtgctattccagctccacttggatatggaggatttccaaagagtgtatgtacatctataaactctgaaatatgtcatgggatacctagcgaagatatagtattaaaggatggagatataataaatgtagatgtatcaactatatataatgggtattattcagatgcatctagaatgtttatgataggaaatgtaagtgaaaatgctaaaagattagtcgaggttactaaagaatgcctagaagaaggtatgaaagctgttaagccttggggacatataggtgatataggagcagctatacaagaacatgcagaaaagaatggatattcagttgttagagattttggcggacatggtatagggcttcaattccatgaagatccgtttgtattccactatggagctaaaaatgagggaatgatattagtaccaggaatgatatttactatagagccaatgataaatgaaggtggatatgatttatatatagatgcagaaaatgagtggactgcatatactgatgatggttcactttcagctcaatgggaacatatgattttagttactgaagaaggaattgaaatactagctaaataaaaaattgagtatttaaattatacattaataaatatacaaagttgcgcatatttataatattataagttgctttaaagaggtgatttatggataagaatcaaaataaagtagcaaatattaataaatgtagccaatccatatgtcaaaataataaattgaatttgggattatcaaactatacatatgcagactttgtaattctgtcttctactttagcttatgctatctcatgtgaactgactgatgaggatttagatttttttattgtatttttgacacaggtatcaggggatttagcattattaagaactaagaggggatatgaacaaatagcagtaaaaggtagtcaggtagtaggtgaagaagaaattttagaggaagcagaagctaatgaagctgtggatgtttccttagaatctggaccattaagacataaaaaaagaaaaaaagttaaaaggaaaaaaattaaaaagaaaaggatatagaaataatgataatttttatatcctttttcttttatattaaattatataaaaataagtgaattatagtgtataaatatatataatgtatataagaatataaatttagaaataaataggagtgatactttgcggtcagagttaaaacgtattggaattattatgttgggagcaactatattagcatttggaagctataatttcaattatcaaaataatataacagaaggtggagttttaggtttattattattaataaaaaatgtatttgatatatcaccatcattttcaagtttgataattgatttatctttatttgcattaggaacaaagttttttgggaaaaaatttttattatattcagtactatctacaattacattttcaacaacatacaatttatgggaaagtattggatttttaatccctagttttgaaaacaatatgttaatggcaagcgtattagcaggaataggagtaggaataggagtaggtctagttataagaggtggaggagcatctggaggagatgatgttattgcccttgtaggaaataaatttactccacttaaagttaaccatatatatttaataagtgattgtatagttttactactgtctttagtgtatttagattttaaacaaatattattttcccttatagctgtaactataagtggaaaaataataagtttaatatataatgatgaagataagaatgaggaaaatgaatctgtattaatataattagaaaagaagtacttaattttaagtacttctttttatatgcatttatatgggtatatattattcatgcatataatttcgatatggaaaaatatgttataatataaactataatattaattggatgggggaataatattgaaaacaatcaataaaaaattaataattacaaatttaataatactattaagtattgtatttatggttggatgtacatctaaatctaaattagaaagtgcatttaataattatactaaatcatgggagaataaagattttgggaaaatgtattctatgttatcaaaacaatctaaaaaagatataaataaagaagaatttataaatgaatataaaaaagattataatcttataaaagctaataatataaaaatatctaaaactgatgaaggtatagaagaaggtaaagattttaatataaaagttagtatggatactattggaggtaaaatagattcaacagatgcactaattaaatttgtaaaagaagatggagaatataaagttgtatggaattatagcttaattttacctcaacttaaaaaaggagataaaatagggattgaaagtgatgcctataaaggaaaaagaggaactatatatgataggaatgggaatgtattagcaggtgagggtcaattaaaacaagtacaaataagtataaaaaaattcaatgattcaaacgaatctagtaaaatagaagaaatggcaaaaatacttgatataagtaaagaaaatattgaaaataagatatctaaaaataaaaatccagagcatgctgtgtgtatagtggatttattaagttcagatactgagaaaatagataaattattaaagataccgggagttcaaattataacaattaataatcaaaggatatataatggaggagaagctataggtagtttaataggctatacaagtaatataacttcagaacaacttagtaaaaataaagataaaggatataatgagcatagtaaaataggtgtaggtggaatagaagaagtatatgaaaataaattaagagccatagatggaggtaaaatatatatcttaagagctaatggtaaaaaagatgttatagcagaaaaaaaagcaaaaaatggccaagatataaaattatctatagaccttgatttacaaaagaagatatatgaacaaatggatggagaaaaaggtgcaagtgtagctacagatcctaaaactggagaggtattggctatggtaagttcgccttcatttgacccaaatagttatattacatatataactaaaagtgagaaagctaaatgggaagcaaattcaaatgcgcaattagagagaagatttaaaaatgcatattctccaggttcaacaatgaaacttgtaactgcatctataggacttgatgataaagtaatagatcctagtaaagctatagatataaaaggtaagacatggaatgaatatgatgtaacaagggtaacagatccaggtagaccagtgaatttaaaagatgcaactaaattatcagataatatatattttgctaaagctgcagttgaaataggtggagaaaattttgtaaaaggagctaaaaattttggaataggagagaatataaaatttggatatcctatacaaaaatcacaaatatctaatgatggaaagttaagtaataaatcattacttgctgatacagggtatggtcaaggacaagttttaataacacctttagatatgactatgatatattctaccttaggtaatgatggtaaaataatgatgccaaaacttgatataactaagccatatgaagcaaaagtatataaatcagctataaaaaaagaaaatttaccgacgcttatagattgtttttcatcagtaataaatgatgaagatggaacaggtcatattgctaaaattaatggaattaatatagctggaaaaactggaacagcagaaataaagaaaagtaaagatgatactaatggaactgaaaatggatggtttgcagcagttgatactgaaaaagggaaattagcaatatcaatgattatagaaaatgtaaaagacagaggaggaagtcatatacctgctattaaagttaaaaatgtaatggagtattatttaaataaataaaaattatggggaggatatatgaaaaaattactagcatctgatgtggatggaactctttatgtaaataaagagataaataaaaaaagtatagaatatataaagagatttagggaagaaggaaatatatttttattatgtacaggtcgtaatttaggtggaataaagcatttatttgatgagtatgatatggaagtagatggatttgtactttgtaatggttctatagttttagacaaagactttaatccattacataatgaatatatggatgatgatactataaagttattatttgaagaagcaagggacaatagtttatataacttttattttgcaaatgaagaaaatttgtacataatagatggatataatacacatcctgttataagttcatcagatatatctaataaaatgaatattattaagttaaaagaagaagatttttataaaaataaatactgtgcaaatatagtagggattgatataaaagatgaatgtataaataaagctgaaaataaaaaaatagatataaaaaataaattttcagataaagtatctgtatatagaaatttatcttttatagatatagttcctagaaatacatctaaaggaagtggtatttctaaagtattagagcgttatggagtaaaagaagataatgtatttgttataggggattcttggaatgatttaagtatgtttgagaaatacagtaattcatatacctttagttactcagagaaagatttaaaggcctatgctaaaaatattgtagatacattttatgattgcttagaagatatcatgaaataattaaaatctatttttagtggaaatagtacatagctaaacatatatataaatatatactattttcataggaggaatagatttgaaaagaagatatgaaagaatgaaaaaagcatgtaaaggcttatctgaagaagcatttaaatcctatacaggtaaaaaagattataaaagggctatacagtgttatacgatacttgcaacaagtcttggagtaccagaagatactgctaaattttcaaaaaatatgctggctagactaaataaaaaaattgaagaaaattctaagtaaaaggattgcttgataaaaatcaagcaatccttttttgtcattttatacatattttatataaaagtgttgacctatatatgtaaaaagtgttatatatattaatatgaagtgataaaaagcatacactaaataaaataataaaacatactataaattgatatataaattaggaggactcaataatgaaaactagagttgcaattaatggatttggaagaataggaagaatggttttaagaataattaaggaaaatgattttaacaacattgaaatagtagctataaatgctagaagtgatgctaaaacgttagctcatttatttacttatgattcatcttatggagtatttagaggagaagtaaaaacggatgaaaaagaaaatattataataaatggaagtaagataaaggtgttaaaggaaaatgatccagaaaatctaccgtggaaagatttaaacatagatatagttatagaatctactggaaaatttactaaaagagaagatgctcaaaagcatattaaggcaggagcaaaaaaagtaataataacagcaccaggaaaaaatgaagacaagactatagttatgggtgttaatgaaaatgaatatgataataacatacaccacataatatctaatgcttcttgtactacaaattgtatagctccagtagttaaagttttagataaagagtttggaataaaaaaaggcttaatgacaactatacatgcttacacaaatgatcaacaaatactagataaaacacataaagatcttagaagagcaagaagtgctggtgtttctatgatacctacaacaacaggagcagcaaaagcagtggctaaagttttacctaatttacaaggtaagttaaatgggtttgctgttagggttccaagtcctagtgtatcattagttgacttagtttgtgaagtaagtcgagatgttacagtagaagaaataaataatgctttagaaaaagcttctaaaaaagagttatatggaatattaggatattcagatttgccacttgtttctatagattataagcaaacttcagagtcttctataatagatgggctatcaacaatggttaataatggaaatatggttaaggttgtagcttggtatgataatgaatggggatattcatgtagaacagttgatttagtagcatatgtcgcaaatgaacttttaatatcaagcaaagttagtgcatagtataatttttaagctcacagtgaataattgctgtgggcttttataatattaaaaaaatttctttaaaaattcatattgtattcacaaataatttatataatttatttgaataatacagttatacaaaatggagggaaaaaattgaatatattattttttattacccctaaaattgaagttgagtacgtatatgattattatacaataagacaagcgatggaaaaaatggagtatcataggtatacctcaataccaataataaataaaaaaggagagtatgtagctactataacagaaggagatttactttggaaaattaaaagtagatttgaagataagcaagatgatattaacttaaaatcactagagaatatagatataaaaaacattgataaatataatgattataaaacggtatctataaattctgatatggaaaatataataagtttagctataaatcaaaattttattcctgtagtagatgatcaaaatatatttataggaataataaaaagaagtgatataatatcttattttaatgataaaatgaatgataatcagttattaaatatagataataaagttagttaataacaataaaatagaaaatatttccaaatagttttaaaattatgtattatagtatataattttaataagaaataaacaataaaggactgtcaaatataggcagtcctttaaattaataaggaagtggctttatgaatttttggagggagaaaaaaaatagaatatactttattgttgtagctatttttataacacttacaggtcagtattttcttttcaaatatggaataataagtccactagtaaaaggagtagaattaagaatatcaaaaggaaactatattcaaaatatagatgaatatgtaattaaattaggtaattctataaaagtaaatagtggagattatataattataccaccatatgcatcaaaacctaaaattggataccaagcatcaaataatgatgttttatctataaaaggaaatacaataactggtattaaagaaggatattctgctcttatgataactaaagatggcagaataataagaaaaactactataagagtagttaaacctaaagtagaaaagttagatgtagatataggcgagcttaaatatgtaggagatagcacttctattgatgtaagtgttgatgttgattttgattttaaagaaaaagaaaaatatacatatgaaatatcaaatgaggatgttttaaaggtagaaaataatactttaaaagctataggagtaggtagttctaagttatacataaaatcaggagataaagtaaaagagtataaatttaatatacaagcgaaagtttcaaacatatatgcaaataacaacattaatataagcataaatgagaagaaaaaaattgatgtaaatgttgaaacatctcctaaaaatctaaaacatcctaaggtaaaatatgaattattaggatttaaattaccgatatctagatcaataactatacctactagtgatggaacaatattagggcttagagaaggaactgaaaaaattaaagttacatgtggaaataaaagtaaaataataacaataaatgttttaaaagaagaaactgaatttaaagaaattaaaaacttacaatcatattctaatatagttggagataacttagaaataactcttacatgggattatttagaagatgtatcagagtatgaagtatatctaaaaaataactctaatggagataatgattttaatttatttaaatcaattaatgtaaataaagaagaattaaatgaatctaagaaagtgaaaactactannnnnnnnnnctataacaataaatctaaaagatatacaagatcctagtatagatttatatgtgataggaaagagtgatggaaaatacacacaaaagagtaatgttgtaaaaattagagaaaaatataaaaatctagataaaatagaaaattataaagttgaaagtttaaatggaggtataaatcaagaaaatagtataaatatttcatggaataaactagataagtttgactgcacatatagtatttatataagaaacaataaaacatcaaaagatggaggatttactttatatcaatatggaataagtgataataaaattacaattcctttaaatgaaggtgaagatgtagatttagatatatatgttgtagcaaattcatcacaaggagctagtcaaaatagtgatatattaaacgtaacaaatataaaacaagagacaaaaccagaagaataatcataaataaaaaaatcctgagaattaggataattaccatattctcaggattttttattattttattttttctaaatatccacttggatggaaatagtatatactagatgtatttttatcaacgaaatatcctaaatcagtatctattttaggaagaaaaacatatccagataaacctttattttttaatactgtaaatttattttcatcacctttgtattcatatactaagtttgggttcatatccattaataattttaaggcttcgtccatagttataggttgtgaagcagatatttgttcattagaaacaatttcttcagttttagtaacacattcatttgaattatcttctttaggtatattaatttgttcgttagaattagattctttagaatcaaaactttgttcattagtattatctaaattattagttgtatcttttgtttcttctaaattattattagatgtctctttagaatttatatcattagaagtattattttcttttactttaatatcttctatattagatttttcattagtgctgattaaattagtttcatcattagtttctaatgttttattaggtttagttttatctaaattatcattattactagatgtaactttattatttaatttttaataacgaataaaagctctctttaattaaagagagcttttattcgttattaaatattctatcaaaaaacatcaacataaatcctgcagaagtcctttgtgccaatggtagacattttgtacctaacatatagaacttattttttaaattagatacatttttatacattttatcataatttatagcatgggtagaattatataccgcatattcttctacactattttttctaattaaaccttcttttgctttaagtcttggtatagacatataattattttttatatataactcaaactgtctatgattgtctaataactttcctttagcatgttgaggtatcgttagatcttgtattatatgacatgctactccaaagtaaaaaaggcttaattcgaatttatccaaattaaaaaatttaacagctttattataatattttgttgatattgttagagcattttcttcatatccaaatttacctctttttaaatgaggattataaaaatgatggtaacttttaaaatcttgatcggcccatattaagcctttatttatttgtggtaaatagcttttgaaaaattcatattctttcaaatatccttcattttttagaatttctaatgcatttgcttgtataaatacatgtacttcacaatctgtagttataatacttttttttacaggattaactactttaaaagtacttgataaagcttttccataaacgttttctattttttttctcattataatcacctaatagttgtatttacaacttaattttaattccgatattaacaatatattactttttttaatatttgttaacctttatatttatttttaattaccattttctctatcttttaaatatatttctataccatctgctacactttgcatcatttttctttgatattctgggttagacatcattaaatcttcattatagttactcataaatcccatttcaatcaatactgctggtactttagaccagttaaatccagttaaatcacctctttcaaatataccatttaattgtatatttgcatcttccattttactttttatattcattgcacatttattactttcttcatatattccacttgtgtatttcccatctttttgaggtataagtatagatgctcccgtttttgatgagtttgttaaactatctgcatgtatccttattgccaaatctgcatttttttcatttgctaagatagccctttctgagttacttatatttacttcatgactttctcttgtcattataatactatatcctttattttctaatatatgtttaagaactatagccgcttctaaattaagtttatattctggttttttagttgctataccatttgttcctgatgataccctagcttttttagaacttgcacctggtcctattggctctaagtttgaatcacctttttcttgatgacctggatctatacatattatgtactttttatttttattttcatcttctttgttttctttgcttataaaattagttgatttatataaattcatcaatggatttgaagttcctataaatataatacctatagctataataccaacaactaataatttatattttttcatattttttctccttcctaaattttatatatataatttgagcaataggctttatttttatgtaaagtaattaatttatttttaggttgttattacttatcccttttcatatacatttatatataagtaatttggaggttaatatgtctaaagtacgtaaaactagagttattaatagaattgataataacaattcaaaactttgtcgttttggttatgtagactatattgttcttgcatctactttagctgtagcaatatctgatgaagttagtgtaacagatataagcatactttctactttttttgctgttttatcagatgaattagcattaataggatctgttaaaaactgtaatcaaaattctcaggataatatatttgtccctccagttcctgatactgcacttacaagatctaaaacaaaaactaaaaaaagaaaaaaaataaaaaagataaaaaagacaatttaaagcacttaaaataccaaatattttaggtgcttatttttattttttgaaaactatggttttattgtgtctgttttctatggattaaaattttcatcctgcacaatctattattaaagaagcaccaatacacatcatcatgattttatcagaaagaaggtgttttagtgaaattaaaaaaattcttggcaatttcgcttttattatattttttctctgtaggatttatttatgcagaagccaatataaaaaatgattcaaagtatttaattcctataggaaatataatgcaaatagatgctgaattgcaatctttaatggtacgaaatacttttaatgattctccatttaaaattggtgactcattaatatctgtaaatgatactaagataaataattacgctgatttttctaacttattaaattcattgccaaatgataattttgtaaaagtagaaatcaaaagaaataatgaaatctcaaatttaagtgtaagtaaggatatccttgaaaaagttaatttcaataatattatttctggatttgcaacattaacttatattaatcctataaataatacttttggtgcagtagcacaccctttaagtgttggattaaatagaagtttatctattaaaaatggttctgtgtcaacaacacacaatttaataattgacaaatcttataaaggtaatgttggatgtattaatggtcaaaaaagtgaatttataggtaatttcaaagataatacaaagtttgggattaaagggaaaattcatgcatcagatttttctaaatttaaaaaatataaagtagctcatttaaatgaaataaagccaggaaaagcatctatacttttgcaaatatcaaatgacgatgctaaagaatatgaaatatctatattaaatgtaaagaaacaaagaaatcctgaatctaaaacattcaagatagaaataaaagataaaaaattattatctatgactggtggaatagttcaaggaatgagtggtactccaataatacaaaatgataaaattataggtgctatttctcatgcagttgaaaatgatccatctataggatatggagtttatataggatggatgttagagggagaataactccctctttattttgattttattgtagtttcattaggtaatatatttgttatttcatctttaggaacattaacataactttgtggaacgtccccaactattacagtttcacatataggtatttgtattttcacttcttttgtagatgtagtaagaggaactactacctttacttgagttttagcttttaaatatattctatgtctagtttggtttattccagatgattcaaaatcagttccaaaatctacatatacagttcctattggttctatagatacttttatttttggaccatacttagctaataagggacttcctatagcagttcctattggtatatatgtagatgttgttttaatttttttcatctctgactgtatttccaaagcaacttttgatgctatttcattcataattatggaatttgcttgcatcataactatatttccatcttctcctgtttttacattaattaaattttcatactttatattattatctataacacttgaaacagctttattaatagacttattagcaagctcttcagctttagtctctgctatcaccgttatagtaggtctaagtttatcgtctatatatataaaactgcctattagtatagatagtataaaaatcagtataaatataaatatatttttctttattttatcttttcttttttttactaatatttttttcattaaaaagccccccttaacattttatgtaaggagggctttaaattacttcttaattattaattttgcaaattttctttttcctacttgtattatatcttcgtcttttaaagctactttatcaacttctaatttttcaccattaagctttattccgccttgttttaataatcttctagcttcacttgtagatggtgatagctttaatgaagtcactaccttaggtataaagaataatccttcttcagcatcttctatagaaatttccatttcagctatatcatctggcatatttcttttttggaatacagatttaaagtattgttctgcttctaatgctttttcttctccatgatataatttaactacttcttttgctaatttcatttttaaatctcttggattaactttatcttgttccatatctgatttcatagcttctattgaatcaggatgttcatccgtaactaattcaaagtatcttattataagttcatctggaatagacattgtcttaccatacatatcatttggttcttcacttattcctatatagtttcctaatgatttactcatttttttaactccatcagtaccttctattataggcattaataaagcaacttgtggttcttggtcatattctttttgaagtgttctacccattaatatattaaacttttgatctgttccacccatttcaatatcagcttttattgcaactgagtcatatccttgcattaatggatagaaaaactcatgtattgatattgactgatttgatgcaaatctctttttaaagtcatctctttctaacattctagctactgtatacttagatgctaaatttgctacatccataaaattcatagcttgtaaccattcactattaaacttaactatagttttttctctatctagtattttaaatatttgatcttgataagtttttgcattttctaaaacttgatcatgcgataattgttttctaactgctgattttcctgttggatctcctatcattcctgtagcatcacctattattataactacttgatgccctaaatcttgaaatgccttcatctttcttaatactacagtgtgtcctaaatggatgtctggagcagaagggtctaatcctaactttattgtaagtggtttgttttcttttgctgatttttctaattttttaataatatcttcttctgatataatttcagctacaccttttttaattattttcatttgttcatttatttcgatcatatgtacacctcacacatattttttttatacttgctaaaaataattaatattgtatcatagttaaatactaaattcaattaatggcacttatactatgttaattaattatttacataatattcatttttatctataaaatacaaaactatttacatatatggtataatatagtcttatagtaaggaggttaatttcatggtaaatgataataataacaaaaataaaattcgaagaaaaaaggttagttcctctagtactaagactactaactcatcaaaaaaaactactaagaatagtagtaaaaagagtactagtgggtctaataaaaaagataaatttaaagtactaagagcaattggtgtagctcttttagttatactggttttaggtgttgctgcttcatcggcattagtctttgtagctttaaaagatgtacaaccaataactaaagctgcacttgataaaaaagttgatacagtaaccgaacttttatataacgatggatcgttaatgggtaaccctcctacagataataaaaaggttcctatttctgtaaaagatatgcccataaaccttcagcatgcacttgtgtctatagaagatgagagattttatgatcataatggtgtagacttcaaagggcttgctagagccgctgtatcaaacctattaacatcttcttctcctggaggaagtacaatacctatgcaggtatctaagaacttattaacatctaaagaagtttctatagttcgtaaaattaaagatatctattatgctttagaaatggataagacccttacaaaagaacaaatattagaactttatttaaatagtgcttattttggaagtggtgcaataggagttgaagctgcagctaatgcatattttgataaacatgcaaaagatcttacaactgctgaaggtgcaatgattgttggtataactcaaaatccaaataaatatgcagcataccaaactactaaattagacggaactgaaactaaaaaagatttagaacaaaaactaaagttctatgtaaatagtaaagatgataattttgatgatcctactaaaactgagcttgatatgatagacaaactatatcaatggggacttttacctgatgatgattactacaaacaattaaaagatggtactatggtttgtagaaaggtagaattaaatcctgaatctaagaaaagacaagaaacagttttaatgaaaatgttagagcttggatatcttactcaagaagaacacgataaagctgttgctcaaaaaatagaaataaaattacctaagccaactaaaaagccagcctctacagttgaagaccttatagaaggtgatgttataaaaagccttatagctcaaggttatacagatgctgaagctcataacttatactttaatggtggcttaaagatacgtactacaatagataaagatatgcaaaaagacttagaaagtgaatttaataatagagataacttcccaggtcatataataggtccagatggagttcctcagccacaagctgcaatggttattttagactatagaactggacaaattaaatctttaatgggtggtagagaaataaaagctagaaaagttttaaatcgtgctacttcacctcatcaacctggttctactataaaacctttagcagtttatacacctgctattgataatggtaaaaatcaagctgatgtatttagtgattcacgtggcggttacaaatttgctgaaaataataaatgggatccaaaaactacaacatctggttctggatctatgacaatgcgtaaagcattagctatgtcttcaaatacaatagctgttaaagttgctgaaacacttggtaattcatataatgattcaatagatgttatgcttgattacttaaagaattttggtttatcagatcttaaagatggaccaggaggtgaggatagaaaattctccgcacttactttaggtggtatgacaaaaggagtttctcctcttgatatggctgctgcttatggtacgttagcaaatggaggaatttatgttgaacctattacatttacaactgttgaatcttctgatggacaagtattaatacaaaatacaccgtcagaacataaggtagttgaacctgaaattgcatatgttcttacagatatgatgaaagctgttattacagaaggtacaggtcgtgctgctagccttggtgatatgcctgtggctggtaaaacaggtactacaaatggtaataaagatgcttggtttgtaggatatactccttattatgtagggtctacttatataggagatgactatagaactatccctaaaacaaaagaaactttacctcgtagaggtgttgtaaaaggaagttcaacttctgcaaaattatgggctaatgtaatgaaaaaagttcatggtaatcttaaggctactgattttaaaaagcctagtaatatagaatttttcaatataaatttaataaatggtgaaattgtaagtaaaggtgcttacaactctgcaactgctgcttttataaaaggacatactccaagtagacatgctgttcattctgagccagttgctccagaaacaccttctacagaaaataataatcagaatacagagaatcaacctacggagaatcaaactcctgaaaatataaatccaggagataatgcaactggtggcaataatagtagtacccctaattcaggtactacttcacctaaccaaggcaatggtggtaatactggtgacacaacaactaatggttctgttggtacaggtcaaactaccccaactccaccagctacaaatactcaaccaactccaccatctactccaactccaccggctacaaatactcagccagctacaaatactcagccagctccaccggctgcataaaaagaagaactatatgatttatcatatagttcttttattttatggctttgcttttggagtaaatataacagccatcaaatatccaaagaatatagcagcggctattcctcctgctgtagcagttactcctcctgtaaacactcccataaatccatcttgttctatagcttttataacaccattatatagtgaatatccaaatccaattataggaacagtcgcacctgctgctccaaaatcaactatacgttcataaattcctagaaaacttaaaattactccagtagttacataagtgaccattatatatggtgtctgtaacttgaaataatccatcattatttgtgcaattagacatataatcccgcctactagaaatacttttagatagtctattatcataatacacacctcttattcattagctattattactgcatgggctacactcggtatactttctttttgcaacgtacttgttggtgacaataatgctccagttgaaactaacattactttattaaattttttatcctttaacattttatatatatatccattaaatacagatgctgaacatccacatccactaccgccacagtgaacatcttgattttccaaatcaaatatttcaactccacaatcagtatataccttagacatatcaatacctttttcttttaataaatctatagctatttgcataccaaccttgcctaaatcaccagtagcaatcatatcaaagctattaggatcatctttggtatcattaaaataagaatatatagtatctacggctgccggagccattgctgctcccatgttgttagcatcagttataccttcatctattacttttcctatggttatatattttacttttggaccatttcctttacttgacaatagagagcatccggatcctgtaactgtccactgagcggtcataggtttttgatttcctaattctaaaggaaatctaaattgtctttcggctgtacaataatgacttgatgtagatgctacaactaaatctgcaaatcctccatcaattaacatagatccaatagatagtgactgtgccattgtggaacatgccccatatacacctaaaaaaggtatactaacttccctggcagcaaatgaagttgataaaagttgatttaataaatctcctgctaccatataatttacatcgtttattgttttattagctttttttacagcatgttctacaacagtttgaaccattttactttctgcaaattcccaactcttttctccatataaatcatcatctagctttatatcaaaataatcttttaatggtccttgagcttctttaggccctactatagatgaagtagatattattacaggtccattttctaatttaacagtcctacttcctattctctttttagccaattaaataacccctttctatttgaaaaaattaatcacatagtatataaacccacataaaaccgaagaccctataccatatactaacaccggtccagcaactttaaataagttagctcctactcctagtacatatccttctcttttgtactccatagctggagatactatagaatttgcaaatccagttataggtataattgatccagctcctgctctttttccaagtaaatcatatataccaattcctgttaaaagagctcctataaaaatcaaagtcatagatgtagctcctgccgctttaagtttatctagaccgaaattcatgtaagcatcatttatagcttgcccaattacacaaattattcctccaactataaatgctaatacataatttttagcatacgtgggctttggacttattttatcaacatattctttataatttttgtccattttgtaacctcctataaaatacttttatataatgttattatttaacaaaacaaaaaaaataaacccccaattttaagggtttatttatcctatatatgattttaattttgataaaacttttttttctattctagaaacttgaacttgtgatatatttagtaattcacctatctcactttgagttttatcttcaaaatatctaagcattattatttgtctttctcttttatctaattttcccaatacctcttttaacaataagttatctataactttttgttcttcattttctccttttaaactgattttatcaattaagcatataggtgctccttcttcttcatgtatgactccatgtaaatactctactgcgaaattagattctagtgccataactaactcttctttatctacacctactaccttagctaattcgtctattgtaggttccctacctagtttttttgttaaaatctcagtttgtgttttagcttttatcgcaacctgtttcaaagatcttgatacctttatcattccatcatctcttaagtacctttttatttctcctaaaatcataggtacagcatatgtagaaaatttcacgttaaactttggatcaaatttatatatagactttataagtcctatagatcctaattgaaataagtcgtctctttcatatcctatatttaaaaatttagatacaacactcctaaccaatcctaaattactttctattagaatttcttttgcttgttcatctccattttgcacaagttgtattaatcttaaagtctcttcatggctaagcaatccctttctttcttctttattggtagttatccccataataaaacctctattctatattagatgaatctattttctttttcataattaccttagttccttctccctttttagagaaaacttctatgttgtccataaagctttccataacagtaaatcccataccagatctttctaactcaggtttagacgtatataatggttgcattgccatatctaaatcttctattccatttccgaagtcttcaactgaaatagtaatagttttatcttctatttcacatcttatattaacaaatttagtttcatcttcatcatatccatgtattattgagtttgtaaccgcttccgaaacagcagtttttatatctgcaatctcatctaatgtaggatctaatttagatgcaaaagatgcaactatgactcttgcaaaactttcattttctgattttgctgaaaatttcacttccataatattactcatttgctacacctcctaaaaaagaacctaaagcatcttcataagtgttgtgaatttctataattttactcattcctgataagtcaaaaatcttttttacccttggatttatatttattacagctactttgccaccctcgctagatactcttttatatcttccaattacaaccccaattcctgaagaatccataaagttcatattcttaaaatcaaaaattatattttttatttgtttttcctgtattatataatctatttcttctcttacttcatttgatatatgatgatctaattccttacttagaaactcaacttttaagtttttattatccaatgaaaaatttatcattagttcccctcctaacagttttaaaaataatactttgtattcaattctataaattaaattattatccttcaataatatttaaatagttttgttttattgtatcaaaaagttacacatttaaatattatgtactatactaaattaaatttggaggaataataatggattttatagacaacaaagtttctaatcgacttggggggccatcattttttgaagataacaataaactttataaatttgaaaaagtaaaaaaaataaccaaagaagttcaatctaagtttccagacataaaacttattgatatgggcgtaggagagcctgataaaatggctcataaatctcttgtagatatactatcaatcgaagctggtaaaccagaaaataggttttattcagataatggcattatagaattccaagaagctgcttgtaaatatctagaaaatatatataatttaaaaaatattactactgaaaatatagtacacggtataggttcaaaaccagttttagctatgcttccactttgttttataaatccaggagatatatgccttatgccatcacctgcatatcaagttcttggcacatattcaaaatatataggtggagaaacctataacttacctctatgtcctgaaaataatttctacccagacttagataatatccctaatgaaataaaaaaaagagctaaattattatatttaaattatcctaataaccctactggtcaagttgcaactaaagaattttatgaatatgctgttaaatttgcaaaagataatgatatcttaataatatctgatttagcttatggtcctttaacttatggtgattgtaagccccttagtattctaagtatagaaggagctatagatgtttgtatagagattcattctttatctaaggcctttaatatgactggatggagattagcctttgttgttggttctaaaaaagcaatgaaagtttatagcactgttaaaggccatacagattctggtcaatttagagctattcaaaaatctggagcttatgctcttaaccattttaatttaatagaattaaataaagatagatatttaagacgatttaatcttttaatcgatgttttaagacaagttgggtttaaaattgataaacctaaaggtggattttattcttacgtaccaatacctattggcgttaaagatggaataaggtttaaaaatgcagaggaagctagcctttatatactttcaaatgcattaatatcaacagttccttgggatgattgtggtagctttttaagattttctgttacttatgatgctaattctttatctgatgaacttaaagttatggatgacttaaaaaacagacttttatctcttaatttggaatttgaataaattaaaagaggatatctttaaagatatcctcttttaatttattatttttttctcttagaattcgctctttctatattaactttatttccttttatttttatgtttttcattttgtctagaacttttctagtatgtttctttggaacttcaacaaatgtatatttatcatatatatctatagttccaactaactttccaggtattccaacttctccagctatagctccaactatatctctagcttgaactttttgttttctacctacatttataaatagtctagtcattcctgattcagcgcctgtatcatatgattcttctactatttcttctttctcttcatcacctagagctaatttaactaaagctgctgctatatctagagtatcataatcttcttctttgcagaagttttctaaccattggacttgctttgttaaatgaccttcttgtatagtagatttaacttgttcaaagaatacactcacttttttctcttctacatctgatattgatggtatactgtgtttttctaatttagatttagtatatctttctatatctttcatttttctcttttctttcccgaatacgaaagagaatgaaactccagttctaccagctctacctgttctacctattctgtgtacatagtactcttcatcttgtggtaagtcatagttaaatactgcttcaacatcatcaacatctattcctcttgcagctacatctgtagcaactaatatatctattgttccatttctaaacttatccattactatgtctctttgagtttgctttaaatctccatgtaatgcatctgcaaagtatcctctagcttgtaaatcgctaactaattcatctgcacctcttttagtattacaaaatactactgataacttaggattatatacatctattaatctacataatacttctaacttgttagccgacttagtttctatataatattgttttatattcggaactgtaagttcttttctaactatctttacatgctcagggtctttttggaatttttttgttaaatctaaaattccttttggcatagtagcagagaagaaagttgtttgtctatcttctggagtcttatctaaaatcatctctatatcttctctaaatcccatatctaacatttcatccgcttcatctaatataaccattttaactttatccatctttaaagtcttacgatttatatgatctataatacgacctggagttcctataactatttgtactccactttttaaagatcttatttgtctatctataggttgtcctccgtatacaggtaaagtttttatcccgtgcatgtacttacctatttttcttatttcacttgatacttgtattgctaattctcttgttggacataaaactactgcttgtagactcttatcatctgggtctaccatttctaatataggtatactaaatgctgctgttttccccgtaccagtttgagcttgccctataatatctactcctgtaattatttttggtattgcttgagcttgtattggagatggttcttcaaatcccatttctaatacagctttttttatgttttcatttattggtaaatcatcgaatttaactatattcatatattgtttcctttccgtaatcaatttatattaactttatcaattatatatttatttcatatattatgcaattaatattttatcctaatggtaaataaggtattcagtataaatcaaaaataaggcatgtttaaaacataccttattttaatctatatatgtaaagtataaagttgatatatatattatatatgtaagtatcataagtaaaccttgaagtctataaatcttttgcttaataaatgtaggtattataagtattaataaaagtagtatcataaatggaaaatctaccatagaagtttgcttaagtataggtatgtcatttataaatgatgataatccaataactgaaactatatttaatatattagcccctaatatattcccaacagaaattgcgttatggctttttcttatagcagtcaaacacgataccaattcaggaagcgatgttccaagtgctattacagttaaacttataacagcttgtggtactcctaaaacttctgcaattttaattccattgttaaccaataaccttgaacctataatcatcattgttataccaattacaaacataactactaattttatcatgtctgatgatttgctatattctatgtttgtagcattgctagttcttcttgaccctgtttttggaatactattataattatttatcatgtaaataactaataaaccaattaaagccatagcatctattcttcctattgttttatccatacctaaaataatcaagactatcacagatataattaacagtatagcctttgaattaaaaatcttcttgtctaccttaaaaggtttaatcattgctactaacccaagtgctaatcctgtattgcatattatagaacctattgcatttcccaaactcattgtagtatgcccttgtatagacgcgaaagctgatacagttaattctgggaacgtagtcgctaaactaactatagttgcgcctaaaactatttctggtatatttgttttttttgctacagatatagtagattctataaaaatatccgcacctttagttattaatacaaatcccaataaaaataagataattgtaaatatcattttatcccccctaataatatacatattcagtttacttatttatttatgtatatttaatctatttaaaaataatttaaattattcttaaaattcatgtttatcgcacttttgtctgggtattatatgaatatacaaaagatgtcaaaataaaacattattcaaaattttgatttaaaattttgtatacaaaatactaattctgtgttatgattatattgtttaaaaaatatctagctagattttataaatataaattaatttgaacacacataaaacttaaggaggctatcaacatgaatgcatggcaaggattcaaaactggtagatggactaaagaaataaacgttagagagttcatacaattaaactacactccatatgaaggaaatgattctttcttagctggagcaactgaaaatactaaaaaattatggaaccaagctcttgatcttttcaagaaagaaagagaaaacaatggtacattagatgtagacactgatacagtatctttaatagatgcttacggtcctggatatatagaaaaggacttagaaacaatagttggggttcaaactgacgctcctttaaaaagagctgtaatgccatttggtggaataagaatggttgaaacttcttgtgacgcttatggatacaaattaaatcctgaaataagtgaaatattcactaaatatagaaaaactcataaccaaggtgtattcgatgcttacactcctgacatgagagctgctagaagtgctggtataataactggattaccagatgcttacggtagaggtagaataataggtgactacagaagagttgctttatacggtgttgataaattaatacaagataaattagatcaaaaagcttcattagaagttagatgtatagatgaagaagtaataagattaagagaagaaatatctgatcaaataaaagctttagaagctttaaagagaatggctgcatcttacggattcgacatatctcaaccagctactaatgcaaaagaagctgttcaatggacttacttcggatacttaggagctgttaaagatcaaaacggagctgcaatgtctttaggtagagtttctactttcttagatatatacttcgaaagagatttagctgctggtatattaactgaagagcaagctcaagaaataatggaccacttcgttatgaagttaagaatggttagattcttaagaactcctgaatacaacgatttattctctggagacccaacttgggtaactgagtctataggtggtatgggattagatggtagaacattagtaactaaaaactcattcagaatgttaaatactttatatactcttggaccatctccagagccaaacttaacagtattatggtctactcaattaccagaaggattcaaaaacttctgttctaaagtatcaatagacacaagttctgttcaatacgagaacgatgatttaatgaaaccttactggggagacgactacggtatagcttgttgtgtatctgcaatgagaataggtaagcaaatgcaattcttcggagctagagttaacttagctaagactttattatacgctataaacggtggtatagatgagaagaaattaaagcaagttggaccaagatttgagccaataacttctgaatacttagactacgatgaagttatggaaaaattcgatatgtttactgattggttagctaacttatatgtaaacacattaaatgtaatccactacatgcatgataagtattcttatgaagcattagaaatggctttacatgatagagacgtattcagaactatggcttgtggtatagctggtttatcagtatgtgctgactcattatctgctataaaatacgctaaagttaaaactataagaaatgaacaaggtgttgttgttgacttcgaagttgaaggagaattccctaaatacggaaacaacgatgacagagttgacgatatagctgttcaattagttgaaaacttcatgaacaagataagaaagaacaaaacttacagaaattcttatcatactcaatcaatacttactataacttcaaacgttgtttatggtaagaaaactggtaacactcctgacggaagaaaagctggtgagccatttgctccaggagctaacccaatgcacggaagagataacagcggtgctttagcttcattagcatcagttgctaaattaccatacgagcatgctcaagatggtatatcaaatactttctctatagtaccaggtgctttaggaaaagatatgactgaaagaataaacaacttatcatcaatgatggatggatacttctctcaaggagctcatcacttaaacgttaacgtatttgatagatctactttagaagatgctatggaacatccagaaaaataccctcaattaactataagagtttcaggatacgctgtaaacttcatcaagttaactagagaacaacaattagacgttataaacagaacattccacggaaaaatgtgctagtatataacttgttaaaattgtaaacatattataaaacaatcatttatcaaagtatattcagagtgcaaacctcatcagtttgcactctttttttattaaaacttacattaaattctatttaaatagacattataagtttaatggattataataagggtataaagtataatgtatacataagattaaaaatgataaatgaaattttagtataaatttttataattgaagaggtggataaaatgttaaaaggtagagttcattcaatagaaacatttggtactgtagatggtcctggtataagatttatattatttatgcaaggctgtccattaagatgtaaatactgtcataatagagatacttgggatgtaaaaggtggtaaagaatatacagtagatgaaataatgactgaagttaataaatatgcaccttatatgaagttttcaggtggtggcttaacagtttctggtggcgaagctactcttcaaccagaattcttagaggaattatttaaaagagcaaaaaaagatggtgtgcatacatgcttagatacatctggatttgtaaatatagatactatcgacccaatacttgattatactgacttagttttacttgatttaaaacacatggtttcatctaaagctaaagatttaacaggagttggaattgaaaaaacactaaaattagctaaacatttaagtgatagaaatatacctgtttggataagacacgttcttgttcctggtgtaacagatgatagagaaaacttagaacttatgggtaaatttatatctactctaaaaaatgtagacagagttgaacttttaccttatcatactctaggtgttcataagtgggaaaacttaggatttgaatatgaattaaaaggtgttcctgatgcaacaaaagaagacgttgaaaaagcagctaaagtattagctgaatttggagttaaagttcatagtaaataaataaaaaagtcgtagttatattactacgacttttttatttagaattcaaatacttcaacttccatattatctatagcatcttgtattaatttttctacatctaatgatgattctgatttctctattctatctagcttaggctttgtaacaggattttttggtgagaacactgtacaacagtcttcttcaggtataacagaagtttcaaacgtacctatactttgtgctatttttattatttcagatttatccatagctattaaaggtctaaatacaggtaaagtaatagctgcatttgtacatgttaacccttgtattgtttgagatgcaacttgtcctatactttctccagtaactaatgcatcacaaaatctcatttctcctactctctgagctattttcatcataaatcttcttgatataatagtcatctcttcttccttacatgacatacctatagctttttgtatttctaatatattaactttatgaagtcttactttcccacagtacttagctaatatttgtgctaaatctcttactttttcttgtgacttttcacttgtgaatgggtaactgtgaaaatgaatagcttctatttcaactcctctttttgcaaccatccatgatgcaacaggactatctattcctcctgatagtaaagacatagctctaccatttgttccaactggaagtcctccataacctggaactgtatcactatataccataacatgattttgtctatattcacagtgtatagttgtttctggatttctaacatcaacttttattctatctttaacattaaatactaaaaatcctgctatatctctactcatttcttgagatgttaattcaagacttttgtctcctcttctagaactaactttaaatgattttgaaccttcttctattttttcttctaataattttaaagctaattcttttaatttatcatagtctttttcagctcttatacctggacaaacacctacaactccaaatactttttttatctcttctaatacttcttcgtaatcttctgaatactctcctaagtctacatatattcttccgtattctttataaacattaaattttcctataggagataacatattttttatattttttataagtttattttcgaatatatatctattctttccttttactcctatttctccgtactttacaattgctatattatacaaatttatcacctcttgattatcttctttttattatcattctaagttcttctactgattttttaattatctcacatgcttgatttatttcatctcttgttgtcatatcagataaactaaatcttatagctccatctatttcttcaggtgtaagtccaatcgcatttaaaacatgacttccttttttcttagaagaacaagcagaccctgtagacacaaatataccttgctgagctaaatgatgtaataacacttctcctctaactcctctaaaagatatatttaatatatgacatacaccgtcttctggagaatttacttttatatcatctatattatttactatatagtcttttaataaattttttaactcatttatattgtctattttagaatttaaatctgacattattatattaacagcttctcctaatccgtatataccagctacattctcagtaccagatctaattccaatttcttgacctcctccagtaagcataggttttattttgttactatcttttatgtacataaatcctataccctttggtccatgtaacttatgtccactaacactcataaaatctatattatatctagatggcttaaaattaatttttgcaaatgactgaactgcatccacatgtaagtatactttttcctttaaagtacttaagtattttccaacttcttttataggttgtatgctaccaatttcattattaacatgcatcatactaattaatatagtagtatcttttattgcattttttacatcatttatatctactatacctttatcattaacttttaagtaagtaacttcaaatccttgatcttctaaatcttccatagttcttaaaactgatggatgctctatatttgtagttattatatgattttttctttttttatgaagatttgcaacgcctcttattatagtattgtttgcttctgtacctccagatgtaaatattatttctttatctttacacccaatacttttagcaatttcttgtcttaccttttttatatttttttcaacttctacaccctttttatgaacagctgaagggtttgcatagtctatagtaagtgcatataccatcttatctacaacttctttgtatggcttagttgtggcactattatctaagtatatatccatactaatacaccaactttcttttatttaaattcttttgttatattctttattttattgtcccaattaacactataaattatcatataaatttagtgaaacttttactattataccactatttgagctttttttatatactaaagccgtgataatccaatactgactatagtataatctagtttttatatattattttgacttaaatcaatattttttaaatttttttgtcaaaattattgatttttctgtcgaatcttgttattatatatatatggttatccccctgataaccttaattaaaatctctattcccaataccccttttaaatgaatatactacattcatttaagtcctacttcttaacggaaaagaagtaggtttttttatgcttaaaataaattattaattttaattaaatatattttcgaaaactattgatttttctgtcgaatcttgttattatatatacatggttatccccctgataaccttaattaaaatctctattcccaataccccttttgaacggatagactttatatccaatattaaactaacaacggaagttagtttaatgcaaaaagagcttccccaagctcttttttttatgcttaattctacatttatctatgtttttttgatataatttaatatatataataaatttagggggtcaataatatgcacaataagaaaaaagtagctatagtgtttacaggcggtactatttcaatgactgtagacgaaaaaataggcgctgctataccatctttatctggggagcaaataatgtctatggtaactaatatagacaaagttgctgatatcgaggtatacaattttgatgaaattccaggacctcatatgactccagaaaaaatgttaaacttaagaaattttataaatgacatacttttaagtgatgatatttcaggtgttgttgttacacacggtactgatagtttagaagaaactgcatacttcttagatttaacattagattcacctaaacctgtaatagttacaggagctatgagaagcagtgatgaacttggttatgatggtcctagcaatcttgcagcagctgtttgtactgctatatctgatgaagcttataataaaggtgtcttagttgttttaagtaatgaagttttattagcatcagaagctactaaaactaatacacttactttaaataccttcaagtctttaacatgtggtcctttaggtataatagattgtgataaacttgtactatctagagatattgttaatagacaaactatagttgtagataaggttgaacctgatgttgcacttataaaatctggtgtaggaatggatgaatcttttattaaatttgcagctgataaaggatgcaaaggtataattatcgaagctatgggtagaggtaatatacctccaggaatgcttaaaggtgtagaatatgctagaggcaaaaatataccagttgttatagctactagatgtcattcaggtagagtctttgacagttatggttatttaggctctggtagagatttaagaaatttaggatgtatatttgcaggagatttaccaggtcaaaaagctagaatcaaattaatggttgcattaggtaagactaatgatttaaatgaattgaaagatatattcgaaaaaggtatttattattaaaatttataaactatctaaagttttacattttataataacctttagttatttatataaataaaagagatatattaaatatatctctttttatttactatgatttatttataatcccatttttaaaacaaatagaataatctaagtcttttgtcccgcacttaaacttaacttctatcatttttccatccttgcctgttataactccattaccaaatttcctatgaactatattatcacctatttttatagctttaatatcttcttttgtaggagatttaatatcatctatgaatctagattgaaatactttacgcccatatttatttttaggagaacttatataaagctcatcttgtgctctagttattcccacatataataatcttctttcctcttctatagctgattttcttttatcttcatcttctatatcataagatttttcatgaggtattgtaccttcatttgcacctattatatatacatatggaaattctaaacctttagcactatgcatagttgtaaatattacaccttctgaatttttattgtttctattttcaactatttctgatttgactttttctatatgttctaaataatcatttatagtattgaaatgtgtagaagaactttctaattcatttaatatttcaattaatccatttggttttatttttctattactacagtaatctaatacatatctatcgtagtctagactagttcttatatatgatattgcatttttgggcgataatgtttttaaataacttaaatctatttctaaatcatttaacgtttttatttgtttaggatgtaaacctcctttatttattaaagctcctataaaatctctatcttcactagctaattttatactttctttagatatatatctaaatggtttatttataattcttatccaatcttcatttaaagttgtatctattcccaatcttaaatatgctaataaatctttagcaacccaatggtcatatattgtaactatagaatctctaactacaaaaggtatatgcatatccataaatacatcaactaaagctctagattgtatattagttctatatataacagcaaaatcatcatagttaacacaattatcttcacatttatttaatatatcttttgctataaactttgcttcttcttctgaatcttctgtacttatatatttcactattcccttttcacctctatcgcactttattgacttttcatatctattttcattattttgtattagcttattagctatatctgttattccttttttagatctataatttatatctaatatatactttttactatttttaaaatactgttcaaattctaataaaaaatctggtctagatcctctaaatccatatatactttgatcttcatctcctactacaaatatattattattaggacttgaaattagttttagaacctcaaactgtactttatttatatcttgaaattcatctactaaaatatatctatatacatttcttactctatccaaaactcttttattattttttaataagtaatatgtttttataagcatatcatcaaagtcaattttgtttaaactttctttatactcctcatacatattgtaagtttttataaactcatccttgctaagtatctcagaatcaaaatcagatttatccattagctcatttttcacataagatatttcatttataacacttagtatagtatcatcatcttctgcattttctacgtttaaattttttaaaattccttttatagcaaacttcttactcttttcatccagtatacaatctaactcatatttttcaaagaatcttagtattctaaaaaatacagaatggaatgttccatagtttacactgtttaatctaacatcattacttaaactaatagctctgtttttcatttctgtagatgatgcttttgtaaaactaatagctaaaatagttttaggatttatattattatttaaaaccatattaactattctatatgttatcaccctagtttttcccgatcctggtccagctaaaaccatacaaggtccgtctatatgcataacagcacttttttgattgtcatttaatttatttatatctatcataatttatcaccttgaactatctttatattattttataattaatattatatatcatattttttaaaaaggagtagcactatgcaagttattactaaaactttagatgatttaatagatatacctgaaaatcacttcgtattcgatatagaaactacaggattaagtcctaaattttctaaagtaattttaataggtatcctttataatcataaaaataaaactataataaaacaatactttgcttcatcagaggaaaaagaaaaagatatattattaactttcatagaagatataaaaaatttcaaaggacatgtaaccttcaatggaatttcttttgatataccttttttaaactctagatttgaaaaacataaaattgattataatatggataaatctaaagatattgatattttacgccttataaagccttataaggaaaaactatctctatctgattgtaaactaaaaactatagaaaaatacctaggtatagaaagagaagatactatatcgggaaaagaaagtgttaaattatataaagaatttgttttaactaaagataagttattaaaaaagaaaatattactacataattatgaggatattttttatttaggtaaaatatttaaaattagagatgttttagatgaaaaacttgatattaataatatatttggatatattttaagtttaataaaaagtttatattataaatttgtaaaaatataaatatcaaaaataatagacgggtaaatacccgtcttataaaaggagaatgataaatgctaagttattaaaatgcaatataactagttatagtttagacagtaaatttaaaaatatacataatgtatagattataaaaagtagaagtgttataatattcaaaatataagataaatcgtaaataaaggggaatcatatgaaaaaaataattaaaacaattataatagctatatctattgtgactttaggtttaatgataggatgttctaagaagtctataagtagtaaagaagctacgaatgaacctctagaccctcccaaagaattacccatagctactataaaagtaaaagactatggaatcatagaagctgaattatatcctcatttaacacctaatactgtaaataactttatagaattagcaaataataagttttatgacggtttgatatttcatagggtagtaagaaattttgttatacaaggtggagatcctgaaggaactggaatcggtggacctggatattctattaaaggagagtttgaagacaatgcatttaaaaatgatataaaacatgaaagaggagtgttgtctatggctaggagtcaacatccagattcagcaggtagccagttttttatagtaactaaagattcaccaagtttaaataagaaatatgctgcttttggaaaagttataaagggtatggatgtagtagataaaatagaaagtgtaaaagttagtgatcaagagaaaccaattaaaaatattgttatagaaagtataagagttgacacaaaaggaattaattacaaaaaagctgaaaaaataaaataataaaacaagggcattttatatgcccttgttttatttaataatataagtaaaacgaaaaagtattgaaaatacattgataaatagtatactatagaagaataatttaaattattaggagaaatagtatggatatattaagtaaaagacaaaaagatatattacaatatacctttttattatttttaatagtattaactacttatattgtatcaactacattagacataannnnnnnnnntaccagatattataaaaataatagattttaaatacatattattgggatttggattagttttattatatatattattggaaggatatattataaaaataatattaaattctatacacaatacaaaatgtaaatttttaggatttaaggttggaacaataggtttatattacaacttagtaactccattagcatctggaagtcaacctatgcaagtttatgtacttaataaattcaacgtacctattagtaaagcaatagctgtgatagttaataagactgtagtgtttcaaactatagtcactgtatatacggggatattattacttataaattgtatttatttaaaaaatcaaatgaattctataatgttattgatatctacaggaatgattatgaatataataatgctaagctttggatttttaataatatataatcctaaaaaaactaaatttatagttaatttaattttagacatattaaaaaaaataaagattttaaaaaaattagaaaataaaagaaataatattgataaatttatagatgaatactattattctgtgaggctatttttaaaagacaaaaaaaatttaataaaagcattaacgcttactattattcaattaactttccactttagtatagcttattgtatatacaaatcttttaacttaacgtcagcatcatttatacaaatggtagcactacaagcttttttatatatggctgtatcaccagttccaactcctggaaatgtaggagctaatgaaattgtattttttacaatttttaaaggtatattcccaaaagacttaatagggtattctgtatttgtatatggaatatttgtatattactttatattactattttgtggtatatgtacgattataattcattataaaatgaaaaaatgcaaggcaagttatagtaaatatatatattaatatttaaaaagaaaagtatttaaaaatacttttctttttaaatatagaaaaaattataagtttaaaataaacatcatatggacattctagtattaaatgatataaaaaggaaggtaattatatgtccaataaaaaaaatgttgatataaaaaaagaagaaatagataataatgtaaaagtaaaagaattattaaaagaaaacaatagtacagaagaaatagcaaatgaaatatcacaaaataaaaagatagcagatatattaggaaatagattagcaagtaagaatttttttcctccatgctaaatcaattttaaggagtgaagcatatgacagaaaatagatttaaaaaaggacaatatgatgatgctttacaatatacaaaagatattttaagtaatagttcatctataaatgagataataagtaaaaataacataaaagaacatgttagtaaaagtttaaaaatcaatataaacaataaaaaatagataaaaagctcttacatatttataatgtaagagctttttaatttaaatccgtactatttattaaaaaaatagaaaaaaattcgtattttatattgataaaaacttaaaaactgttataattaacttataaatacgaatattaattattgaattgactattaatatacgataaataagggggagaaattaatttatgaatgataaaaattcagttatctatcaattagacggtaggcctagattaaaagaggctataccactagggttacagcatgtgcttgcaatgtttgttggaaatgtaacaccactaataataatttctggagctcttggtcttagtttagaagataaaactatgctggttcaatgtgctatgttagtatcgggattggtaacattagttcaatgttataggataggtccatttggagcaaaacttcctatagttatgggaactagttttggatttgtatcagttgcaactgcagtaggaagtaaatatggatatgaaggtatattaggggcttgtttagctggaagtatgattgagatattatttggtacatatgtaaaaaaaataagaaagtttttccctccagttgtaacaggtactgtagtattagcaattggaatatctttactacctacaggaattaattatttcgcaggcggggttggagcaagtgattttggatctatgtctaacttattgttaggaagcatagtattgataacggtgttattttgtaagcagtatacaaaagggataactagtattgcatcaatattaataggacttttagtaggatatatagtagctatacctatgggtaaaatagatttttctcaaatatcacaaatgtctttagtttctatacctacaccactacaatttgggtttgaatttcatatagatgctatatttgcatttgtatgtatgtttatagtatcaggggttgaaactgttggagatataacagctatagctcattctggaataggacgtgatgctaaggatgaggaaatatcaggaggagtaatggctgatggatttggaagtatgatatcagcactatttaattctatgccaactacatcatttgggcaaaatgtaggacttatagctatgactaaagttataaatagacatgtagttgcaacaggagctatatttttaatactagctgcaatatttcctaaatttggagctataatatctttaatgccatcaagtgtattaggaggggcaagtgtaatgatgtttgctatgattgcagtaagtggaataaagcttataacatcagagcctttgaataacagaaatagtacaatagttgcagtagcactaggtattggggttggattatctttagttcctgatgtattatctaaaatgccagaatctataaaacttatatttggagattcgggacttatagtagttgctattatagctatacttttaaatatagtattacctaaagaaaatacagaattaaaaacgaaaatagaagttggaaattctaatacacaagtttcataaaataaagtttaaacgttaaattgtaaaataatattaacgaacctcctaaaatttatttcatatatttaagtaaaaataaattttaggggggttttttatggaaacatctattcatactatagctagtaataatttgctaatattattttcaatagttgctatgacgggaatagtatgtagtaagttaagtgaaaaaataaatatacctgatgtagtattatttcttattgcaggtatatttataggaccgtcagttttcaaatttatagatataagtgcataccaaattgaaaatcaattaatacttacctttggatctgcatttattttatatttaggaggaaaagaaatcagcttaaaagtattgaaaaatgttaggataacagtattgttattatctacattaggagtaatagtttctacctttatgatgaaagaagtagtaggattaacatttgaagtaagttctatgactgcattattatcaggagctataattgcatctacagatcctgctactttagtaccaatttttaatagtattaaaattaaagacaaggttaagcaaactgttataagtgagtctgcatttaatgatgcaacaggagcgatattaacatctgctgtactagctataatattatctggaaaattttcaattaaagaaaatttatatagtttaagtacgatggttattgtaggaataataattggtataatgacaggaattttattattgaagctagtaaatgataaaccttatggcatattaaaagactttgctcctataatttcaataatatctgttataatttcatatgagttatctactaaattaggtggtagtgggtatatgtcatgttttatagttggtattataaatggaaataagaaaaactttaatatatggttaactcaaaaatcatatgatgcagatgtacatgttgtagaaacattaggaactatttgtagaatgatgatttttataatattgggtagtcaagttgacttacaaattttaataaaatattttgttccatctgtagtttctgttatatgtcttatttttatagttagacctgtcagtgtaatactatgtacgatatttgataaaaatgccaattggagtaaaaaagaaattttatttatgatgtgggtaagagaaacaggggtaattcctgcagcactttgtggtataattacatctatgaaaataccaggatatgaagtaatatcatcagttgtatttatgactatattaataacattaataattcaaggtagtactactaaatatatagcaaataaattagggttattagaattagataatgagtaaatatataaatttttccttatatatttgttttatcaaatatataaggaaaagtattaagtatgttataattaatgaaaaattatatatataaaatggacaattaagagggaggaagagtatgtttacacttactgaaatagtacagccaagcacattagaagaagcctactcaatattagttaaaagaaagactaatcaaattcttggaggaacagcttttttaagaatgggtaataaaagaatagggacaggtatagaactttcaaatttaaatctagattatataagagaagatgacaaatttgtggaaataggctctatgactacacttagaagtttagaaactagtgatattataaataataattttagtatattaaaagatgctgttagagatataattggggttcaatttagaaatgtagtaacagtaggtgggagtgtattctcaaagtatggcttttctgatttaatagtagcactactttgcttagacacagaagttgaaacttataaaggtggaaggatatctttagatgagtttttaaataaagaatatgaaaaagatatattaactaaaatatacataaagaaaaataataaaaaagcagtgtataaatctatgagaaatgctaaaagtgattatccaatacttaatgtgtctgtatctaaaatagacaataactttaaaatatgtgtaggtgcaagaccacaaagagctaaagtagcaataaaaactagtggatttttatcaaacaacgaaataaatgataaaaatattgatattgctttagatatgatggtagatgaaattagatttggttctaatatgagagcatcaaaagaatataggctacaaataagtaaagtattagttaaaagagcaatcatggaggttacaaaatgctagtagaacttgaagtaaatggaaaattaagaaagcttgatatagagccagaagagtatttagtagatagcttaagaaaactagggaacttaagtgtaaaaagaggttgtgatacaggatgttgtgggctttgttctatttggatagataaaaaacctacattatcttgtgcaacattaacagttagagctttaaataaagagataacaactatagaaggattagaaaaagaagctagtgaatttgctgaaattttagttaatgaaggcgcagaacaatgtggtttttgttcgccaggatttataatgacagttttagctatgaaagaagaacttaacaatcctacagaagaagagataatacattacttaactggaaatttatgtagatgtacagggtatatgggacaattaagagcaatcaaaagatatctgggggtaaagtaaatgaaaatagttggaaaaggaatacataaaatagatggaatggctatagctacaggaaaaccagtttatactgacgatttagcagctaaagatgctttagtagtgaaaatattaagaagcccacatgcatatgcaaaaataaaaaatatagatacttcaagagcattaaaaatagatggagttgaatgtgttttaacgtataaagatgtgcccaataatagatttacactagcaggacaatcctatccagaaccatctccttatgatagattaatacttgaagatactgttagatatattggagatgaagttgctatagttgcggcaatagatgaaaaaactgctgtaaaagctatgaaaatgataaaggttgaatacgaagtattaaaacctgtaatagatatggaaaaagctatagataatgaagtagtagtacatgatgaagatgtccactgtaattttgatataggtatggaaagaacaagaaatatagtggcaaaacacttatatgaaaaaggtaatatagaagaagaattagaaaaatgtgatttagtagttgaagaaacatattatactcaagctcaagcccatgctatgatggaaacttatagagcatataactatttagatcataatggcagattagtagtagttagttctactcaaattccatttcatgtaagaagacatctatctagagctttaaatataccttcaagtaaaataagagttataaagccgagaataggaggaggatttggtggtaagcaaactgcttgtgttgaaatattctcagctatagtaacgcttaagacaggtaaacctgcaaaattaatatatgatagaaaagaaacttttaactgctctacaagtagacatgcaatgaaattaactgtaagaatgggagctactaaagaaggagtaataaaagttatagatatagatgcattatctgatacaggagcatatggagaacatgcttcaactacatttggtttagttggagaaaaaactatgccaatgtataataagttaactgcatcaagatttaaaggtaatgtagtatacacaaacaaaatgccagctggagcacttagaggttatggtgcaactcaaggatgttttgctgtagaatcaactataaatgttttagctcataagttaaatatggatccaactgaaataagacttaaaaatatagttaaagaaggggaaactagttttgcttataataaaacattaaatagtgtagatttagtaaattgtataaaaaaaggtaaagaacttataaaatgggatgaaaaatatccttctaaaaaaatgaataatggcaaaattagaagtgtaggaatggcgctaactatgcaagggtctggtattgcaggaatagatactgccagtgcagaaattaggttaaatgatgatggaaactatacattattaataggatcaacagatatgggaacgggaagtgacacaatactttctcagatggcttgtgaaatacttgaaacttctatggagaaaataaatgttatatcggcagacactgatgtagttccatatgatccaggttcatatgcatcatctactacatatgtaacaggtatggcagttgttaaagcagctactaagcttcgtgaaaagataatcgaagttggagctaaaagactgggcatagataaagaatatgctgaatttgatggagagtatgtgcacagtgaatgcaataaaatatctgtgtttgatatagctgttgactttacagttggcccagaaaaagagcaattaataggttatgcttctcatggaagtgaagtgtctccaccaccttttatagcaggatttgttgaaactgaaatggatatagaaacaggaaaatataagatattagattatgtagcagttgtagattgcggaacagttataaataaaaaattagctaaaattcaagttgaaggtggaatagttcaaggtataggaatggctatgtttgaagaagttagacatacggataacggacaaatggatacaaatacatttatgcagtataaaatacctgctagatgtgatgttggtaatgtaatagttgattttgtagaaactcatgagccaacaggtccatttggagctaaatctgtaggagaggtagttataaatacaccattaccagctatacaagaagctgtttataatgcttgcaaagttagggtaaataaactacctataacacctgagaaagtatttttaggaatgcataaataatataaaaaagttaggatatatatcctaacttttttattaacagtcaatccaagtagatttacctgtatatataaattctgtatgcttacacttagggcatacatatatttcaaacattaagtgctcttccacatcaaatatagcttttaaaaaacctctattagcttcttgtgaatcaaatctatactcttttaagaatttaatttcagtattacatcttagacatttcatatgattaccccctaaataattgttaaaataattataaactatatatttgtgtaattggtttcaatatagttacatataattaaaagataaaatagaggattgtagataaatttgtagtatataaaattctaataaatacatattttcaaatttaattttatataaattgaaaagagggatattatgagtagagaacatgatgtagttaagtcaagtcatagagcatacactaaaaattcattgataaaagattttaaaagtatgggtattaaaaaagggatgactataatagttcactcatcacttagttctatagggtgggtttgtggaggtcctatagctgttatagatgcacttatagaggttataggagaagatggaaatatagttatgcctagtcatagtggagattactctgagccttcttattggtgtaatcctgaagtaccaaaaaaatggtatgaaattattagagaagagatgccagcatttaacccaaaaacaactccatgtagaggtatgggaataatagccgagacttttattaaatatgaaggagttaagagaagtcaccatccacaagtatcatttagtgcttatggcaaggataaaaattttataattgaaaatcatagtttggaatatggattgtcagaaaattcaccaattgctagactatatgatttagattcatatgtattattacttggagtaccatatgataacaatacatcgtttcatttaagtgaatatagaagtgaatgtagagaaaaatttatatctggagctcctatagttgagaatggtaaaagagtttggaaagagttttatgacttggaattagattctgatggttttgggtacataggagagttatttgaaaaaaattataaagttgtaaattataaaataggcaatgctaattgtaagctattttctcaaagagaatgtgtagattttgcaacaaaatttttatcgcaaaaaagttaaaagattatgaaaattatgggaattaagatatagaaatggttaaatttatgttatacttataataatatagggaaatggggggatattaatgaaaaatatagatttaagtaaactaagtatagtggatgatttcaatttaattaatagtcttgttgcaatgactaaagtttataaaaatatagaaaataaggatatacctagaattgaagaatatatacaaaataaatttacagataaagaattacttgaaataggtttagatatagtgaaaaataaacaaaataatatgagttatgaagatatagaatatatagctaaaaaaaagttaaatgaatatatggataaaaaggatgcacaaagataagcattaaaagtttaaatattatataaatctaataaaaaataaataaaagctatacgaaagattagattttcgtatagcttttatttattttttatatttctgtagtattaactttattatcatcatagcttacccagtcactaaaactaccagtataaagcttatgtttaatacctgcctcactaagtgctaaactattagggcaagctgttacaccagaaccacagtaaactataacttcattataatcatttaatttactaaaatgtttttttaattcatctacagattttaatttaaaactatcatcttttttatctaatatatccatccagaagtaatttaaggcacttggaatatgacctgctcttttgtcaactggttcaaactctcctaaatatcttttatgctctctagaatcaactatagctacatcatctttatataatctttcttttacataattcatatcaactctcatagagtcatttaccctaacttcaaaagaaccttttttaatctcgggtattttatcatcagtaataccaccaatttttataaactcatttattccaccgtttaatacatagacttcactgtggcctaaatactttaatatccaccataatctagaaggaccagctaaatcaccttcatcataacaaactattaaagaatcattatttatacctaagttttcaaatgtattttttaagctttctgaacctgggattggatgtctaccaccatgagctttgacttcgctagatagttcagtttctaaatctactcttactgcaccttttatatgatttttttcataacttctttttccatattctttatccattaaatcaaatctacaatcgactataactaaattttcattatttaaattttctttcaaccatttagcattaactaagtttgtcataaaatttcctcctaagtatatattaattaggtaatggttttcatatcattacctaattaatatatacttagattgaagaaatttcaatacattataaaatttacttaaaatactgaaaataataacttttttagatttctaaaaaaacgtttaacttattggaataatatgttagaatgtttacaagaaaagaaaccttgtatactaaatacagcaaaatactattcgtgacaattaggaggttaagagatgaaattttcttcaagaataaaatcagtagaagcttcaactataatggagctattaacttatgcagcacaagctaaaaaacaaggaaaaaaagtatatcatttaaatataggtcaaccagatataaagactccagaaaacttttttgaagctatatctaatgacagggaaaacgtattagagtatgctttatcagaagggttaccagaacttagagaagctatacaaaagtattataaagaatacgatataaactttgatatagaagatatattaatattaaatggtggtagtgaagctttatttttcactatgataacattatgtaatgaaggggataacatattagtacctgaaccattttactcaaactataacagctttgcaaatgcagttggagttgaaataaaacctataactacacttgcagaaaacggattccacttacctgctaaagaggaaatcgtatctaagatagattcaaatactcgtgctatattattctcaaatccaggaaatccaactggagtagtttacactaaagaagagataaaaatgatatctgatatagctaaggaaaatgatttatggataatagcagatgaagtttacagagagtttgtttatgaaggtgaatatactagtttaggtaatgttaaagaagtagaagatagagttataatagtagacagtgtatctaaaagatatagtgcatgtggagctagaataggttcgctagcttctaaaaataaagaatttatgggcgaaatattaaaactttgccaagctagattatcagttcctacattagagcaagtgggagcagtagaactttataaaactccaaactcttatttaaaagaagtaaatgaagagtatagagaaagaagagatgtattatataatgagcttataaaagtacctggagttatatgtaaaaaaccaacaggggcattttatatagttgctaaattaccagtaaaaagtgctgatgattttgttaaatggatgttaagtgacttcgaaatagatggagaaactgtaatgccttgtccagcagaaggattctataaaacagaaggtcttggagttgatgagataagacttgcttacatactaaataaagaagacttatctaaagcagctaagatattaaaagaaggattagaagcttacttaaatttaaataaataaattataaaagacttatacatttgtataagtctttttaatataggaaaatactatgatataacaaaatatgtgtcttatacaatttgattgtgtataagaattcattttttgaatagatttgatatggggtgattttttgaatattgaactatttttacaattatcatgtggtattttctggattatgacttatataataataatctataaaagttttaaagataaaacttgcggaatgcctttatttgcattagctcttaatttagcttgggaatttacatttagctttatatatccaccagaaaatttactaatggctagaattatgttcattttatggttaattcttgatttaataatattatatacattttttaaatatggatatgaaaatttaaaatataaaaatcttataactaagaaagaactaaatatatttgctatactagatatattatttttaataatatttataattttatttgttaatgatatttcaattttatatgaaaatagtatagttcaagcatcaggatttattgcaaacttacaaaatttaattatgtctatattatttgtcaacatgattttaaatagaggaaatactttaggtcaatcaatatttatagcaatctttaagtggattggaactttagctatagctattttaaaattttctaatatgttaccatcaacaaatacagaattacttattataatgttaattcaagtgtttgacataatttatatacatctaacttataaaatttctaatagaaaatgcaattgaaaatttagacatattaatataaaatctaaaatatataaaatatgctttgggggaggaaattatatgtctaatgaagtttttaataagggagtaaatcgaatagggacaaattcagttaaatatgataaatataaagaaaattttaatacagatagagatgatataattcctatgtggattgctgatatggactttgaaacttgcgatgaaataacaaaagctttaattaaaaaagtatcaactggaaatcttggatacgatacagtaaaaggttataaagaagcagtcgttaattggatgaaaaaaagacacgatttagatataaatacagaagatatagtatatacacctggagttgtgacagctataaactttttacttaaaattcttgtaaaagaaaatgataaagtattagtacaatcacccgtatatcattctttctttagagtattaaatgaaaataaatgtgatataattcaaagtgaattagtaataaatgataacagatatgagatagattttaatgaatttgaaagaaaaatagctacaggggttaaggtatttatattatgtaaccctcacaaccctataggtagggtatggacgttagaggaacttgaaagaatagtagaaatatgtgaaagctacaaagtatttataataagtgatgaaatacattctgacttgatatttaaaggatataaacataattctttaacaaaagtagctccatattataaagataatatagttacgttaacagcacctagcaaaacgtttaacttagctggattatacacatcaaatgctattataactaatgaaagtttgagaaatgaatataaaaaattattttcaacagaacctaatgtacttggtgctgaagctttaatagcagcatataataaaggcgagtcttggcttgatagacttcttatctacattgaaaataattataattatgtagttaaatatataagtgaaaatatacctaagattaaagtaataaaacaagaaggaactttcttaacttggctagattgtagaaatttaggtctagatgatgaagatttagcaagattttttatagataaagcaggattagcattaagtagtggaataggatttggaaatggtggaagtggatttatgagaatgaatataggttgtcctatatcaactattaaagaagctttaaatagaattaaagaagcagtagatgctatataaatactggaggagtatatgctaaaaaaattactagagataaaagaaaaagatattataactgttgttggagcaggaggaaaaacttctttgataacctatttaactaaagaattctctagtgattataaagttttattaactactacaactaagatatatttacctaagaaaagtgattacaataatattatattaattgacgagagtaatacccttattattaataagggtattactctttgtggtaaatatataaataaagaaaaaaaggtagtaggtttaaattttaatgaactagataatatattaaataaatttgatataagttttatagaaggtgatggttctaaaagaaaaaagctaaaaggatggagagaggatgaaccactagtacatcccatgacaactaaaaatataggtatagtagatataagttcatttaatatggatataaataatgaaaatatacataggctagataaatttttaagtatatgcggtaattatactgataaagttaacttagaaaaccttaaaaatataattttaaataaagatggtttatttaaaaattcagtaggagaaaaaatattatttataaataaggttgatgatagatttaaagaggttttagctaaagatttaataaaacttattagaaaggaagatgacagtataaaaataatatatggtagcttaattaaaaattattacacgaaaggataattatgataaatgcaatagtaatggcatcaggtttttcaactagaatgggtaataataaattattactggagtatagaggaaaaactattattgaaaatactttagatatattgaaaaaaagtaattttaaagaaattatagtagtaagtcaatatgaagaagttttaagcatagcaagtaaatatagttttaaaacagtattaaataaaaaagcttacttaggtcaaagtgaatctataaagttaggaataaaaaatagtagtgaatgtgagggatatatgttttttgtaggagaccaaccactgctaaataaaatggatatagataatcttataagatgttttaaagataacaataaatatataataattcctaagtatgaaaataagacagggaatccagttatatttcctaaatgcttaaaaaataaattactaatgttaaaaaatgacgaaaaaggtaagaaagtaataagtgagtatgataaaataaaatatatatatgtaaaaagagaaactttattagatatagatactaaaaaagattatgagaacttaataaatatatacaacagttagtggaggggttatgaaaaaaataaagacagtagattctgtaggccatgtattatgtcatgatataacgcagataatacctggagaatttaaaggaagagcatttaaaaaaggacatgtagtaaaagaagaagatattaaaaaacttctatcattaggtaaagaccatttatatgtttttgaaaaagaagaaggtatggttcatgaaaatgatggtgctatatttttaaaagatataactgctggtaaaaatttagaatttagtgaaataaaagaaggtaaaatagattttatatctaaggtagatggacttttaaaagtagatgttgaaaaattatttaagttaaattgtattgatgacataatgatggcaactcttcataataattatatagttcataaagggcttaaggttgcaggaacaagagtaatacctttaatggtagaacaagaaaaattggataaagcaaaagaagttgtaggagaagaaaaaataataaatgtagttccttttaagaaaaagaaagtaggaatcgtaactactggaaatgaagtataccataaaagaatcgtagataaatttgggcctgtcatgaaagaaaaaatgaaagcttatgattgtgagatactaggacaaattatatgtccagatgatacttttataataaaagaagctatagataactttttaagtcaaggtgctgaaataatactttgtacaggtggaatgagtgtagatcctgatgatttaactccagctgctataaagatgtctggagcagatataataacttatggatctccaatactacctggagctatgtttttattagcttataataaaaatgctaccatacttgggataccggggtgtgcaatgtattctaaaacaactgttttagacgttatacttccaagaatattaatagatgaaaaattaactaaagaagatatagcaagatatggacatggtggtctttgcatgaactgtgaggtttgtacttacccagcctgtaattttgctaagtagttgactaagtcataaatttattatattattagaagagttgtaaaattttataaattttagtagttagaaaggaaataagcgaatgttacaagttactaatgttggtcttagatttggggataaagagttattcaaagacgttaacttaaaattcactaaaggaaattgttacgggataataggagctaatggagcaggaaaatctactttccttaaaatattagctggtgatatagaagcaaatactggaagtgtatctataactgaaaaagaaagaatgtcagttcttagacaggaccacttcaaatacgaagaagatactgttttagatgttgttataatgggacatactagactttatgaaataatgaaagaaaaagatgcattatatatgaaaccagatttttctgaagaagatggtataaaagctgctgaacttgaaggagaatttgctgaacttgatggatgggatgcggaaactaatgcagaaaaattattaatgggtcttggtataacaaaagacttacactacaagcaaatgaaagaattaacgggtggagataaagttaaggtattattagctcaagctttatttggtaagccagaaatactaataatggacgaacctacaaaccacttagatttccaatcaataaattggttaaataacttcataatggatttagaagattctatagtaatagttgtatcacatgatagacacttcttaaaccaaatatgtacaaatatagttgatgttgactttggtaagatacaaatgtatgttggtaactatgacttctggtatgagtcaagccaattagcattacaattagctaaagatcaaaataagaaagctgaagaaaaaatagctcaattaaaagagttcatcgcaagattcagctcaaatgcttctaaagcaaagcaagcaacttctagaaagaaacaattagaaaaattagaagtagaagatatacaaccatcaagaagaagatatccatatgttggatttacacctgaaagagaaattggaaatgaagttttagaagtaaacaatttaactaagactgtagatggtgttaaagttttagataatgtaactttcagattagatagagatgataaagtagcattcttaggagatgagatagctataactacattatttaatataataatgggtgaagatactcctgatagtggagatttcaaatggggagtaacaacttctcaaagttatcttcctaaaaaccacaataaatactttgatggtgtagagtattcactagttgactggttaagacaatattcagaagaaaaaagtgaaagtttcataagaggtttcttaggtagaatgttgttctctggagaagaagctttaaaacaagctcaagttttatctggaggagaaaaagttagatgtatgttatctaagttaatgttatctaatgctaacgtattagttttagatgacccaactaaccacttagacctagaatctataacttctgtaaacaaaggtttagaaaagttcccaggagtattaatatttaactctcatgaccacgagatgatacaaactcttgcaaatagaataatagaaataactccaaatggaataatggatagaaaaactactcttgatgaatacttagaaaataaagatatacaagctcaattaaaagaaatgtacggagactctaaaaaataattgctaataatgtatatataataaattaaaacttaataatataggttttggaataccttttatattcgataagatgaagaacgtctatgttctactttttcaaatataggaggtatttttttatgcaattaatagatgcaataacagagtatatagataaattagaaataacagatacaagtaaagaaacaataaggtcttataaaaattccttaaatatatttagtaaatttataaaagaaaatacagatgtgaaaaaaataagtatatctgatattaagtcatttcatcaatttaataaagaaagaggtctaaaacaaaagactttgaatacttacatatctgcattaagaggaatgtttaactaccttatagatgaacaaataattaaaaaaaatccagctatgagcataaaactagaaagagtaaaagataaaaagattatagaagtatttactaatgaggaagtaaaacgactagtagattggaataagaggtctagaaagtttttagatgtaagagataatttaataatttcatttttgatagaaactggatgtagaaaccattagctgagctatctcaaggaatctgatatacatgatggatttgtttattttaaagtaactaaaaatagtaaacctagggtagtacctataagcaagttattagaaaagcaaatgagaagatacaaaagaattaaagaagagtactttaagaaattaaaaaaagaaagtattatagaagatttttatatactttcaaaaagtggaaatagaatgtggcaacaaaatataggacaggttgttaatagagtatgtaaagattgtaatatacctgagcaaaaagcttacccacataattttagacatacttacgtagtaatgatgctaaagaatactgggaatgtacatttagtatctaagttattaggtcattgtaacttaagtataacagaggagtatcttcgaggattaactaaagacgatgttatagaaatggctaaaggaagttcaatacttgaaagtttaagatgaataaaatgttatactacatatatctctttgcatataaaattatactcaatctaataatactggaacaaattatagtagattttaaatactatttatagtattaagctttatacaaaataacttataaagctattaattttttagacttagtgtaaaattatggtataatattggttagaaaattatagaaagaggtaatgttcttgattttgtgctatactggtaatatggtagaactttcaaaactgtaaaatattcaaccaatcgccaactgtatgtggagcgaaaactaaggcatgaaacatacagagttgtttctattcacaagccaattaggggggctgggaacggaaactgaaggttaatttaagtggagagtagttcgcagataaaaaaatatttaaagaaaaaagggggatttaacttggctaaaattgtaattaaaagtgaaatcttagaaatgatgctttatatttgggattcagtacatcaaaaggaaaagatagcagattcattttttgtagaactatcggatcaaacggatatgaaatatctatatgatgaagactttacaaaggaatctgtaagaaaggtactttccgcaatgtcaaacagagaacttttaaataaaccaacaaaaaaggaaagtagatactggaataaaaatatgtggatgcttgaagatttggaatttacaaatatgatgatagcaccagtaaagcagcttaatttagactatatggaagataaattaagtaaggaagaatatgaggtaatatttattccaggacatatggatgaatattatattgatgaaaataaattaataatcaatttctttaatattacagtagatttatttggggaaggcccagtaacaatagcaggtaaaccatttaaggaatatatagaagaaaagcttcttagtatataactaggagcgataaacagttaaaataaatttattaaaagtgtatataataaaaaagattacctaaatattcataaggttatataggtaatctttttatctattagattaacaaggttagattttttaatagcttctttagacggcccaactaaccacttagacctagaatctataacttctgtaaataaaggtttagaaaagttcccaggagtattaatatttaactctcattaccacgagatgatacaaactcttgcaaatagaataatagaaataactccaaatggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgagatgatacaaactcttgcaaatagaataatagaaataactccaaatggagtaatggatagaaaaactactcttgatgagtatttagaaaacaaagacatacaaaatcaattaaaagaaatgtatggagattctaaaagtaattaagaagtctttaaagcactaacttatttaaaataagtagtgcttttttatttgtcaagttttgtaaaaaaatataaaaatattggggtatagtgtaaacaaaatatatataaagaatattatatatattaagggctggttataactagttctatttaaggaggtatataataatgagtgaattttataataaattttgttgtgaagataatactaattcagattgggatgatgtaaaaaataagattagtagtgtttgttgtaatcctgattcatttattaaagaacaatttactttaagaacaactgctacaacaggagttaaaacagtttatgtagcaaatccaggaactgcttttgtaagaggtacagtaatcctgagaaatttatcaagagcaactataaattttgtagtagatggttcaaatatagttgtagaagcaaatgatgaggcagcaatttctgtagctgctttaaatgctgtaacagttcaaattctttcaggagctcaaacagctagagttttattgttctttgatatagaatatccttcaatttaaatctaaatttgatatgatatagtattttaggcagagatttaatctctgccttttttattatagtagtctgttcctacaattacgaatactagtagtagtgttaataaatctacttggttagatttactaattccagttttgcaccataatccaaaatgttcacaattattaaatactaaattgaaatttttttcccctaaacgtgatttagctctatttactacatcacgggaagttatattacaatttttatcattatatactttaaaactatttttgccagctaaaaatctatccatattagtttgacgaatgcacatatgtcttagaaacttatcatcaattttaccatcataatgtataacgcaatcatcgtttatatatatgccaaaatgcttatataatccatgatcaacaaaaattaaatctccatattgagcattagacataaaaattcctcctaaaatcatgtatataaatataaattatgattttaagaggataatgttgctaagctatagctttaaaaccttcacctaaaacttcatgaacatcagtgacaattataaatgcagaaggatctatatttttaatgactttctttaaatgaacttcttcatttttagaaacaacaactaataatacatttttatcttcgttggtatacccccctttgccttgaagaaaagtaacacctcttttaatttctttattaataccatctcttaaggcatttggttcattagatataatcataaatgctttagaatagttaaagtcagaaactatagcatctacaacttttactataatataaagtgcaacacctgaataaagtgcagtttctaagtttttgctagctaaacctgcagatatgacaaccattccatctaacataatcataaatttagaaagtggtatatttggaaaaattttatttagcattaaagctataagatctgttcctcctgttgaagcatccattttaagaacaattccaagtccaactcctaaacaaagtgcaccagacactgcacataataatacatcctcagttacatgtgcattagatagtttggatgtaagacttaatattgctgagaatatactcatgcctataagggttttgattgaatcttttatgcctaatatctttattgaaaatattactagaggaatacctattcctaacataactaccgatatagggagacctgttaacttccctaaaactacagataaaccgctaagtcctccaggagctatagtataaggttttaaaaacatatttatacctatactcataaaaatacatcctaaaattaatcctatagattcaaataaaaattttttaaaaatgttttctttcatataacacctcacacactatttattataatttcgcaaaatatagtataacaaatttgtgtatgtgttgggaatatgatttccttatgatagaattttcgaataatttctaataatagataaatagagaaaataatgaaaaaataatattttgtaaaaaatattaaaattcacataggaaaaggttgacacatgtaaaaagatactataatatgaataatcgaggggggaattggttaaataaataactagtttcagaaattataatattatacataatggaggaccaatatgggggaaagttcatttttatcacaatttttaatggtaacagacattaaaacagtactttttatgattgttttattaggaacattttttatagtaaaacagtttgaaaagaaaaaagtaaagttctcaacgagaacaatttatgcaacaattatagggcttgcattaggagttataattcaattagtagcaggacttccagaagatccaacaaaagtagtttggttacaagaagtaactaaatggtatggattatttggatatggatttatggatttattaaaaatgttagttgtacctatggtatttgtatcaattataagagttataattaatatgaaagaaggggacaatttacaagcactaacatttagatcattaggtatgttgcttggaactacagcattagcagctattataggtatagtagttggtaatgtaatgcaattaggtgttggaacacaagtggcaggaattgaagctcctgaaatgagagaaataacacctctagttgatactttaagaagtttattaccatcaaaccctgtaggggctatggcagagggtaatatagttgctataatagtatttgctactttcttaggacttgcaacaaatagaatgaagaaaaagtatatggatgttgtaaagccatttataaacttagtagaagctttctacaagataatagtaagcgttgctatgacagttataaagtttatgccttatgcagtagttgcattacttgcaaatacaataactgcaagaggtatatcatctatgatatcagtggttgagtttgtagtagctttatatgttgcaacagctatattatttgtagtgcatttagttatagtaactttaaatggattaaatccaataacttacataaaaaatgctgcagaacctttattattagcatttacatctcgttcaagtttaggtacacttcctgtgactatagaagcacttgttaaaaatcaaggagttgacgaaggtgtatcaagtttcactgcaagtttaggagctaatatggggatgaatggttgtgctggtatataccctgcgttaatggctataactatagctaatatggctggagtagataaagacataagtttttatgttatgcttttagtagttataacaatatcttcacttggtatagcaggtcttccaggaacagctacaatggcagtttcagtagttgtgtcaggtgtaggattaggtgcatatttcccactagctggaggaatacttgctatagatccaattcttgatatgggtagaactatgataaacgtaaacggtgctactacatcatctatagtagtcggtaattcactaggaaaattagataaagaaatatttaattcaaaaaatgattaaataaaaaagctttgttcactataatggacaaagctttttttattatatattctcatatttaattgtataaatatgagaatatataatattagaataggaaaactataaatgcctattaaaattttagccaaaagtataaattcgtgagttaggcaggtgttaatatatggagcaaataatatataacttgcaagattataaattattagtggctgtgatagggtttgtaataataataatagagacttttataccagctttaccacttgttgcaataattggagctaatgcttttgttttaggtgtatggatgggtttttttatatcttgggtaggatcagttttagggtctattgcattatttttattaagtagcaaattttctgaatgcaaatttataaaaaaaataaataatcaaaaagtagataactttaaagcttgggttaaaaagcaagggtttagtatgatatttataacatatttatgtccttttataccagattttttggttactataacatcaggcatatcaaaaatgaaattaagtaattttgttccgggtatgatattaggaaagtttataatgtttttagtgataagttatataggcaatgatatagaaaactttataaaaagtcctataaaagttacatttttaatagtattaataataatattttggatattaggaaataaaataaataaaaaaattaatgataaaaaataagattatacttaagtataatcttattttttatttgataaacaatttggacataagttagatttaaaatttttaatatttgtatttatttcaaaataattagaataagataaaccatttagtttacaaatataatttattaactgacttatttaaaagatcaagtgatgattttttttcgcaaataattatatcattaggtaggtcagttaaaattgttccgtatttttcaaaagataaacaagtagtttgtttaaacaatgtataatccccctaaaactatgaaatctatttcctaatattattttacaaaaaaatttattaaaaatcaaaaactaattacaattttaatctaaattcgatgtataaaagtataaaacttttatacaaaagtgcaaatacatatactatataaagtattaaaatataattaaacaaagtatagaggggttaaattcaagggggtattaattaatgaaaaagattacagttgcaataattggagctggagcaagaggtatgcatgcttatgcaccatattttaaacaacatgaggagttaggaaaagtagttgctgtagcagaacctcatgatataagaagagatatatgtgttaaagaacataatatagattctgaaaatgtatttaaaacatgggaagagttattagaaaaagatagattagcagatgcgataataatagctaataatgatgaatctcattatgaaccgactaaaatagctcttgaaaaagggtatcatgtattacttgaaaaaccgatgtcaaataagttagaagatatagtaaaattaggagaattagcaaaaaaatatcctaaccaagtatttatgatatgtcatgtacttagatatacaacattcttctctaaattaaaagaaatagtagacagtaaagaattaggggaactagtaagtatacaacacaatgaaaatataggatactggcactttgcacattcttttactagaggaaactggagaaatagtgatgagacaagtccattaatattagctaagagctgtcatgatatggatatattactatggttgactggaaagaaatgtaacaatatatcagcatttggacatttaactcatatgagagatgaaaattttaaagaaggtatggcagatagatgtttagattgtaaggttgaagagaaatgtccatattctgctaaaaaattatacttatcagataaacctatatttgcaaaggttgtacatccagttccaactaaagaaaatttagaagaagctttaagaacaggtccatacggaagatgtgtatataagtgtgataataatgtagttgatcacatggtaactatacttgagtttgaagatgatataacagctacatttaatttatctgcatttactgaagaatgcaacagaactataaagctaatgtttactcatggtgaagttggaggaaaccatgttaaaaatactatagaagttaaaaagtttgaacaatttggtaaaaatactatagaaactataacaccagaagaagttgaagggggccatggtggaggagactatggaataatgcaagattttgttaagctagtagctgaaaatggtggagaaggtagaactagtgctacaaaatctgttgaaagccatataatggcatttgcagctgaacactctaggctaaataaagaagtagttaatatagataagttctggaatgaagctatcgaaaaattgcaagttaaagcttagaaaaaatcttaatacacaaaattgtaaaaaaagtggataaaattacaaatacaaatcaaattagtttgttatactatattattaagaaaatcgtaaaatattcaaaaaaacgtttttaaggacgtattttaactatggaaggggattgttatgtttttaaaaaggggaatcataacaggagcaattttaactttagtattagggttaacgggatgcagctcatctgggggagatagtgcaaatggaaagatcgaattaaggtatgctatatgggataaaactcatatggaagcagttgaaacattaatagatgaatatgaagaaaaaaatccaaatatagacatcaaggtagaacaatattcttttgcagattactggactaaaatggaaacagcagcagcaggaggatcagcaccagatatatactggatgaatgctgtaaactttaataaatatgcagataatggaatgctagttagcatgaaggattatataaaagataaaaatgtcgatatgagtcaatatctagaaagtataagtagtttatataattataaaggtgagcaatacggcatgccaactttctgggataacaacatattaatgataaacactaaacttatgaaagagtataatatacctgagccaaaagaaggatggaactgggatgaaatgatagcatggctaaaagatgctaaaactaagttaccaaaagatatttatccatttacttcatatccaacagaaagtactcaatcaggagtatttaacgaagttgcatcagctggaggtaaggtaataagcgatgataaaacaaagacgatgctaactacaacagaaactaaagaaggatttaaaaagtattttgacttagttaaaagtgatttacacagtccaagtgatgtaactttagaagttggagctggaacattatttaaatcagaaaaagcattagttttacaagctggttcatatggattattaccatattccgataaagaacaagcaaaggttgctggaaactttaaattatatgaaataccaactataaaagaaggtaataaatctaagactgtaatacatggtttaggaaacgttatatcttcaaactctaaacatccagaagaagcatttgattttataaattatatatcaagtgaagaatccatgaaaaaatatactgaattagcattagttccacaagcacataaaaatgtccaagaattgtttggaaaagttatgaaagaaaaaactggtatagatactgcagttatgtctaaagttgctgaaaatgctatgccacttcctaatagttttgaaacatcaaaatgggataaagtgataatggataatatgactaagtttatgcaagatgaaatatctttagataaagcacttgaaaattctcaaaatgaaatgcagtctatattagataaagagaaaaaatagaaactaaaagaggatgtctgaaagtaattaggcatcctcttgaaatacataaatggggggatttaatttgcaaacagaagtttataaagaaaagcccgaaagtaaaaaagtaaaaaataagaaaaaaagagctttaaaacgtaatatgactggatatatgtttatacttccactacttataggtgttttagtatttaactttataccatttatgcttaacttattttatagcttaactgatttaaatgcttttggaggttggaattttgtaggaggtgaaaacttctcaagaatttttaaagatccattgttttataaagctgtaggtaacacatttttatatgttattataacagtaccacctatggtaataatatctgtatgtatagcaaacttacttaacaaaaacataaaaggaaaaggaatatatagaactatatactttttaccagttgtaactatggcatcagcttctacattagtatttcaatggatgtttaactcaagatttggattagttaatcaattcttagaaggtataggacttgaaggtcagttatggtttacagatccaaacttagctagagttgtaataatagtatttataatatggagtggacttggatataaaataatgatatttttaggaggacttcaatctataccagaatcttactatgaggcagcatccatagatggagcttcatcatttaaacaatttactcatataacaataccgcttttaacgcctagtatattctttattgttatatggtcattaattggatcattccaattatttgatgtagtgtttatgctcataaagcaaggaagtccagcttatgagtctacaataactatgacaagatatttctatgatttaggatttacattaggagataaaggatatgcatctgcagtagccgtaatattattcttgattataatgacggtaacgataatccaatttaaattacaaaataaatgggttcattattcagatgaataagacttgggaggtagagtaatatggaaatgaaaaaaagtgccaagatactaacacatgtagggcttatacttatggcagcatttatagcattaccatttatatggatgatattaacgtctataaaaacattagcagaagcagaagctattccgcctaaaatatttccagaatctataagaatagaaaactatactcaaatatttaaggaattcccttttgcaaagtattatataaatactataatagttacagttgcttctgtagtatttcaattaattataataactccagcagcatatgcatttgctagacttgattttaaatttaaagaggcaatatttttaattcttatggcagctatgatggttcctggtcaaatgtatttaataccacaatatcaaattatacaagatatgggacttttaaatacattaacagctatagttttaccaggaatttttagtatatattatacattcttattacgccagcattttaaatctattccaagagacatggaagaagctgcaataatagatggagcttcacagtttacaatattttttaaactaatggtaccaatagttagaccagcacttggaacagtagctatacttggaggtcttggggcatggaatagtttcttatggcctttaatagtaaactctacacctgagaaattaacattagctgcaggattaagagtatttgtaggacaatatggaacacattatcctagaatgatggcaggagcagtactttctataattcctatggttataatatttagtatattccaaaagaaatttatatcaagtattgcagtatctgcaggtaaagaataataaaaaaggatttatcgaaatagattatttaaaaatctattttgatacaatcctttttatttttataaaataattttatttaaaatttatagtaaaaataattttagcaggtttgttaaatggattttcccatctatgattagttccaggtggtatagttacactatctccggcctctagtataaactcatctttttctatataaattttaatttttccttctaaaacataagctaattctattgatttatgagacataagttcatttgaaatagtagaattttttactaagtttactattgcaaattctactgaatttgcagattctggagataaaatctcaaatacgatatcattattttttgggaaaattactttttttctattatcttttcttactataagatctttattatcaacttcatcaataaaaaatgtaaataaaggtacatctaacgctttagatatagcttttatagtgtttaaagatggatttgataaccctctttctaattgactaagtagagaaggtgttacatctgctaattttgctaaatctcttatacttaaattcttttcttttcttatatgggaaattttttgacctacatctatattatccatttataaatcctttcttaacagtttagtatatttagattatatcaaaaaaatatgattgacacaaaatggtaatgttgttatattatatttaacaaaattaaaatatatttaacataaattggggattgggggaattaaaatggacattagggtaagtacttttggagctattattggattgtttttagcaataatattaattattagaaaaattcaacctgtatatagcttaatgttaggggcacttataggaggaatagtaggaggacttgatttagttcaaactgtagatttaatgatggatggagcaaaagatatatctccttctatacttagagtattaacatctggggtattggcaggagttcttataaaaacaggtgctgttgataagatatctgaagaaataataaggatattaggtaaaaagcatgctatgttagcactagctttatctgctatgattttagctggagtaggagtaaatttagatgtagcaataattacagtatcaccaatagcattatctataggaaaaaaattaaattattctaaattgtctatattattagctatggtaggtggtggaaaagcaggcaatataatatctcctaatccaaatacaattgctgtttcagaaaattttaatgtagatttagctaaattaatgtttgcaaatataattccagctattgttggtattatcataactataatattatcaaatatgttaattaataaaggtgaaaatataaaagaagaagatttgcaaaatcaaagagaagatttaccaagcttttttgcatctataatagggcctttaagtgctatatttttattatcgcttcaaacatttacaaaaataaatgtagatccactaatagcacttcctttgggaggatttatagggttagtttttatgaataagttaaaatactttaatgaatatatgggctatggattaagtaagatgtctggagtagcgatacttttactagggactggaactttagctggaataataaaaaactctgaacttcaacaaacaactatacaaattatgaatatgcttagtatgccagagtttttactagcaccaatatcaggaatacttatgtctttatcaacagcatcctcaacagcaggggctactatagcatcagcaacatttgcagatactataatgaaagtaggtataactcctgtaggtggaggagctatgataaatgcaggatctagtgtttttgaacaactacctcatggatcactatttcattcaagtgcaggcggtataaatatgaatattagagaaaggtttaaattaataccttatgagattatagcaggttttataatgacagtagtaagtacaattatatatggattaatttaataatatcaaaggatatgttgaaaataataatttatatatttttaatatatccttttctaaattttaaaatttcagaaaatcatataaataataaaaaattcaaaaaagttgaaataaatagtaaaatatagtacaattaaaaaaagattattaaaaatttgtttatatctgtttgttaaatataaaacaaattttaaattttattttaaaaattattttattatttttatatgatttaaggagggaataaaatggagattggaaataatagggaattggacataattaatgaagaaatttctagtaaaaaaagaaaagtcaaggctgtaagtacagaaacatttgtattcatagcggtattactaataggatttggatttgttggtagtaaaatggggcttggtataatgtttaaatctattatgaatacagctcatgatttattattaaacacagtatttttaataatggcattagccgtacttgcaggagcattaagtgcattactttctgaatttggagtaacatctttattaaacaaagtatttgcgatgtttatgaaaccgctatacaatatgccaggggcaagtatagcaggagcagtaacaacttatttatcagataatccagctataatagcatttgcaaatgataaaagttttacaaagtattttaaaaaatatcaaataccagcactatgtaacttaggtacatcttttggtatgggacttatagttacaacatttatgatgactcaaggtgctgagtatgttggtcctgcaataataggaaatgttgcagcaatcataggtagtataataagtgtaagaataatgcttatgtttactaaaaagtattataattatgacccaaagagtgaagttaagacatctggaaaagtggaggctatggaatatagagagataagagaaggtagcttatttcaaagaatattagactcaatgctagaaggtggtaaaaatggtgttgacttaggtatggcaataattccaggcgttttagttgtatgtacattggttatgctattaacatttgggccatcagtagatcctaaaacaggagcagaagtttatacaggagcagcttatgagggtataggtttacttccagcattaggtgataaattaatgtttatattaggaccattatttggatttactgatcctcaggctatggcatttcctataacttctttaggtgccgttggagctgcaatgtctttagttccaagatttataactgaaggtgttataacaccaaatgatatagctgtatttactgctatgggtatgtgttggagtggatacttaagtacacatgtaggtatgatggatgcattaaatgcaagagaacttacaagtaaagctataatatcacatacaataggtggtttatttgcaggtatatcagcacactttatatatatgttaatattttaaataaataacaaatttaaattataattaataaaaaaatagcttgtattatttttaataatacaagctatttttttatttttaaatatttatagaatatttaaaatagttgtttaaatacattagtagaaggtatatatccaatataagttaaataataaataaacaaataagtaaataatggaggggtattatgaaattaaaatcacttaaattaaaaaatgatttatactgggtaggctcactagaccctaacttaagagtatttgatataataatgtatacaccatatggaacaacttacaattcatatgttttaaaagctggggataaaactatactatttgaaactgtaaaagctaaacactttgataattatttagaaagacttaaagatttaaatatagatttagaaaaaatagattatatagttgtaagtcatacagaaccagatcatgcaggtagtgtagagagaatactaaaactttctccaaatgctaaagttatagcgtcacaaaatgcagttaactatttaaaagaaattgttaatagagattttgattatatattagtagaagataatgatgaaataaaaatagaaaacaaaactttaaaattttattcagttccactacttcactggccagataccatatacacatatataaaagaagataacacgttaattacttgtgactcgtttggaagtcattacagttgtgatggagtagtaaacactaaaatagaaaataaagaacattatatggatgcgctaagatattattatgactgtataatgggtccatttaaaccatatgtattaaaagctatagataaaataagagacttaaaattagatatgatatgcccaggacatggtccagtacttattgaaaatccaagagaaatagttgatatatatgaaaaatggagtagtaaagaaattatagttcctaaaaaagatataactatatgttatgtaagtgcttatggatatactaaagaaatagctgaaaacataaaaaaaggaatagaagaaaatagtgattacaacgtaaaaatgtatgatgttataaatcatactatggatgaaatattaaattctataacatattcacaaggtgtattatttggaacacctacaataaatggagatgcactaaagcctatatgggatatactagtaaacttaaatcctatagtacatggaactaaggtagctactgcttttggatcatatgggtggagtggagaaggtataccaaatgttatggaaagattaactcaacttcgtatgaaaacaatggatcctttagttgtaaactttaagccaactgaaaaagatttatatgaagctcaaaatttaggtaaaagatttgtagaaaaaactataagagcctatactagaaaagaaggaactaaaaaatggaaatgtgtaatatgttctgaaatatttgatggagatgaagctccagatgtatgcccagtttgtggagctaagcatgatcaatttgtagaagttatagaagaaaatgttatatttagaaatgatacaaaagaaaactttgtaatagttggaaatggtgcagcaggattttatgcagcagatgctataagaaaaagaaacaaaacttgtaaaataactatgctaactaatgaaaatgaattaacttattatagaccagcgctttctgattttataaatgaagatattaaaaaagaagatttttatattgtagatgaaacttggtataaggaaaataatatagatgtagtacttgaagttaatgtagataaagtaaatgaaaaagctaaagaaattaaattagacaatgataatgtaataaaatatgataagttaatattagctaacggaagctcaaatttcattccacctataaaaggatatgatttagatggagtatatactttaagaaataaaaaagatttagataatataaaaaataatttacaaaaatctaaaaaagtagtagtaataggtggtggattattaggacttgaagcagcttatgagataaaactagccaataaagatgtaacagttgtagaagctatgccaaatttattatctagacaattagataaagaaggcagtataaaattagaaaatatattaaaaaataaaggattaaacttattagttgataaatgtgtagaatctataaaaggagaaaataaagtaacaaatgttgtatttaaggatggaagtttactagaagctgatatggttatattctctataggggttagatctaatatacaaatagttaaagatacagatataaaaactaatagaggtatattagtagataaatatatgaatacatcatcaagggatatatatgcatgtggagatgtagctgaaatagattctatagtttgggctatatggccagcagctatagatatgggtaaaatagctggagctaatgcatgtggtgataaattagagtttaaaatagataattatccagtaggacttgatgtatttgaaactaaagtatttagtataggaaatataaaagataataatggatgcataagtttaaataataataataattacaaaaagttatttttcaaagatgatttattagtaggagctatatttataaatgatttaagcaaaaatgttaaagtaatgaatttaatgtctgaaaatgctgcaatgaatgaagtattaaaatctaatatattataattaagatttatataaaacctatcttaaatatggttataactatatttaagataggtttttgtttattattacaaaaaagtaataaatatgtaatactatataaactaaatatattgtataatagtgttgttaaataaaaaagtaaatgagtagaataaataattggcacttaaaaggatggaggttgcctatgaagaaaaaaaagatgttaaataaaaatatactacaatatgggcttttattgtttatactagggataacaagttatttagtttataaaactttagatataaatatgcttggtgaagttgtaaaaatggtagataaaaagtttatatttcttggaatgtgtgcagtaattgttcatatgcttttagaaggtgtagttttaaaaattgtaatagatagtatacacaaagtaaatacaaagtttataggatttaagttagctactatgggattttattataacttaataactccatttgcatcaggaagtcaacctatgcaaatatatgtattaaataaatgtaaaatgcctgttagtaaagcaacagcagttataatgaataaatctataatatatcaagttgtggttactatttactgttcagttttagttatacttaatacaactatactaaaaggaatgaaacctgttatgcctttaatattacttggtatagctgttaattcatttgggttaataatgtcaatgctagttgtatataatccacaaaaagtaaaaagtgtaacaaagtatattataaaagcattagcaagatttaagatatttaagtttttagaaaataaaatagataagatagaaaaatttgcggatgaatatagttattctgtaaatttatttataaaaaataaaaaagcattaatattaactttagtgataactacagttcagttaagtgtttactttagtatttcattttggatatataaagcatttaacttaacaggatacacatatatatacatggtgacattacaagcatttttatatatggctatatcaccagctccaacaccaggaaatgttggagcaagtgaattggcatttttcactatatttaaaagtgtgtttcctcaacctcttatggggtatgcagtatttttatacggaggatttgtatattatgcggtattaataggtagtggtatatttactatgtttactcaccatactatgaagaagaaaattaaaaaagttaaaattgaaaataaagaatatgcaatgtaaaaagaagaggattacctcttcttttttaatctaatattttatatataatagtatttactatagatagtaatattgaagctcctatagcattgacaaatccatataagtaaactccaggaactagtccaaaagctaattttaatacaatagcgtttataattaataaaaataaacctagagttaaaaatgttataggaagtgataaaaactcaagtattggtttaactgttaagtttaaagcaccaaatataatagttaaaatgattaaagcaccaaatgaacctatatacatgctattcattaataaagatactaaatataaagagatagcattaactattataaataaagatactcttttcataaatgaaactcctttcaataaagcaaaaaataaaataattgctttattattttgtacataattatacaagttatttctaaataaatgtatataatagtatattcccataaaaagtaaatttacacagataaattttaaagttacaaaattgatataaatttaaattaaatatatgattatttctaatttgtataatattaatattttataaacataataacagtaaaatgtgcttaaggagataaaaaacgaatttataaagtaggtgatttgtatgtcgattaataaaaaacctaatgaattaataaatgaaaaaagcccatatttattacagcatgcttataatcctgtaaattggtatagttggagtgataaagcatttgaaatagctaaatctgaagataaacctatatttctttcaataggatactccacatgtcattggtgtcatgtaatggaacatgaatcttttgaagatgaagaggtagctaatatattaaataaaaattatatatgtataaaagtagatagagaagaaagacctgatgtagatagtgtatatatgactttttgccaagctatgacaggcagtggaggatggccacttactgtaataatgactccagataaaaaacctttcttttgcgggacttattttccaaagtatcaaaaatacaatagaataggtttaatagatttattagaacaaatagattttaaatggaaaaatgaaaaagaaactttgcttaaatcaagtgaaaatatattaaatgttttaaaagaagattttgagataaataaaagtgaagatgaattagataaagatataatagaaaaagcaattgaagtttttaaattatcttttgataataagtatggtggttttggtagagcaccaaaatttccatctcctcaaaatcttatgtttttaatgaaatattataatttagaagatgatgaacaatctctggatatagtagaaactacattaaaaggaatgtataaaggtggtttatttgaccacattggttatggcttttctagatattcaacagataataagtggttagttcctcactttgaaaaaatgctttatgataattctatgcttattatagtatatctagaagcttacaaaataactaaaaatgatttatataaaaatatagctattaaaactatagattatgtattaagagagttaactgatgaattgggtggattttactgtgcacaagatgcagatagtgaaagagaagaaggcaagttttatgtatttaaccaaatagaaataattaaaatactaggagaagaagatggaaagtattttaatgaatattataatataactaaaaatggaaattttgaaggtaaaagtataccaaatctcataaataacaaagattaccataaggaaaatgaaaaaataaataatttaagaaaaaaagtatttgattatcgactaaaaagaactagtcttcataaagatgataagatattaacttcttggaatggacttatgatagtggctttagctaatgcatatgaagttttaagagatgataaatatttagattatgcaaataaagctttaaattttattaaaaataatcttattaatgatgaaggtagattattggctagatatagagataaacatgcagatcatttagcttatttagaagattatacatttttaacatgggcatatataagaatgtatgaaactacttttgatgagaaatatttagaagaagctatttatttaaataatcaaactatagaacttttctgggataatgaaaatcatggattttttatatatggaaaagatggagaaaatttaatagcaagacctaaagatttatatgatggagctaaaccttcaggaaattcagtagctacttataatttaattaaattagctagaatgactaaagatgagaaactagaagatattgcttataaacaaataaatatttatggtagtagtgttatagattcaccaacaggatatagtttttttatgttagcacttatgtatgaattatatcactcaaaagaattaatttgtgtaattaaagaagatgaagatttaaaagatttacaaaatatattaactaataattatttacctaatcttaatgtagttgtaaaaaaagaaggtaatttaagtagtgtaagtaagtatttaaaggattataaaagtataaatgatttaactacttattatttatgtgaaggtaatagttgtaataaaccatttaatgatattaatactttaaaagaatatttagatgtataaaataagaaaggataaatagttatattataacttttatcctttttatattttaaatttacaactagcttatatctaccaaggtttagcccaaggagcttcataatattcttctttccacaacaaatcagtagaaactctaaaaatatcactagatatagctgatttatagtatatattgataacgcttattttatcacataattctttattaataacgattttaaaatcatcagactcaaatactatatcattttctgtaggctcatccagagctatactaaatataggtccgtatcaagcacttagttctcttatataaactcttagatatttgttatttatattatattctttaaacatattgttaagttcttccttagcagggttactaatatttataatcataaaaacacatcctttactatgtaatatacataatatacccaaatttatacttaataaatgacaatattttaaagaaacaattaattaattattgatataatatataaatagggataaataagggttaagaaaatatgacaagcttatatttttcataagggataaagtctaaaattaaaaagatcatgtactataattgagaattgataaactttatacttatttaaattacttgtaatactgtataataaacagttataatattaaatatagtactcatataattaaaatgaggtataaagttaacataaataaagaaagttataaacttaatcataaatagaagggatatatggctatgttttttttcgatttttttaaaggtaacaaaaagaaaataaaagctcaaataagcgaattaaaaattgaaagagaatgcttagagaaagaatttagcaaacaccatagcaagtatgaagagctatggagaaagtatcatagtaatgagatgaactatacttcggctatgaaggtagataacaaatgctatgagttaaaagcaagaataaaagaaattgacaaaaaaataaaagaactagaagaagaattataaaattaaaggcttataagtttttgtataatataaaaaatttataagccttttttatatttagattttaattgtaaaaattaaaatgaataattaaaaatatattattcataaataaaataatattttaaaattgggaaaatgatactaatattagaaaactaacattcataaaaaataataaaaattatctaaaaattttaaaaaatgtcgaaaaagaattgacatatgcaaaaaatgtaaatataatttaattcaacaataaatatctaagacaaaagaaaggaaatagaagatgataaaattaatcggtattttagttgttatattagggtttgtattaaaaatagaaactttatttacagttttattagctggtatagcaacaggattagtagcaggaatggatatagttgaaattcttaacacattggggcaatcgtttgtagacaacagagcggtatcattatttattatgactttaccagtaataggaatacttgaaagatatggattaaaacaaagagcagtttacttaatacaaaaacttggtaaattaacaacaggtggggtattttctatatatatgataattagacaaacagcaggtgctctttctataagaataagtggacatcctcaatttgttagacctttagttgagccaatggcacaggctgcggctaagagtaagtataaaaaagttgatgtgaaagatgaagaagctataaaagctttatcagctgctagcgaaaattatggtaacttctatgggcaaaatttattctctggaagttcaggagtattattaatagcatctacattaactggttttggttatactgtaagcgagctagatatagctaaagcaagtataataatggctgttatagcatttttagtatcagctatacaaaattacttattcgataaaaaactaagcaaaaaatatagcaaataggaggaagacataagtgcaaaactttataaatataggactagaatcgttttatgttttaatgggtgtattaatgttagttatagcatttaaatcattgaaaacgattggagataataaaaaatatggaacatttgcattctggacattattgagtataccttttatgtttggaaagattttaccatcagcattagttggaggtatattagtattattaagtttattaactttgactaagcaagttgtatttgcaaaatatgaagttgcaagtgaagaatttagtcaagctcaatcagaaaaaataaagagtaagatatttttaccatcattaatattagcatttgctgcagttgcagttgcaatgtcactttcagcatatggaagttcatctcaatttgcaataggagcaggagcagtagttgcacttgtaagtgcatttataataactaaagcaaagccaaaagaagcagttgaagatggagcaagattacttcaacaaatgggacctacaagtatgttacctcaattacttgttgcactaggagtattatttactaatgcaggagttggagatgtaatatcaaatatgatatcaggagtagtaccagcagacagtagattctttggagttgttgcatacgttttaggtatggcagtatttacaatgataatgggtaatgcatttgcagcattctctgttataacagcagggataggaataccttttgtattagcacaaggagcaaatcctgcaatagtaggagcattagcacttacagcaggatattgtggaacattacttacaccaatggctgcaaactttaatatagtaccagctgcacttttagaatctaaagatcaatatagtgtaataaaatatcaagcaccagttgctatagtattattagctttacacatattcgtaatgtatacatttgcattttaattagctaactaggagtgggttataaataattaatctacaaatttatataaagtatagagttaaaggaggatataatatgaaagttttaataacaggatttgatccatttggaggagagcaaataaatccagctgaagaagctgtaaaaagagttagagataatataaatggagctgaggttataaaattaactatacctacagttagaacaaaatcagtagaagctatagaaaaagcaatagaaaaacataatccagatatagttatatccgtaggtcaagcaggaggaagatttgatatcactccagaaagagtagctataaacttagatgattttagaataaaagataatgaaggaaatcaagtagttgatgaaataattaaagaagatggacaagctgcatatttctcaaatttaccaataaaaggtatggttaaacatatgaatgaaaatggaataccagcatcagtttcaaatacggcaggaactttcgtttgtaaccatgtaatgtatggtatattatacatgatagacaagaaatatcctaatataaaaggtggatttatacacataccttatatgactgcacaagttgtagataagaaaaatactccatatatgagtttagatgaaatagttaaaggcttagagcttgctatagaagcttgtactatatacaatgaagatataaaagctataggtggagaaatatgttaattaaaaagatatttgtatatggtagtttaagaagtgacatgtttaattataaaatacatttagatggcaaagtttctagttctaaaaaaggttatataaaaggagagttatcacacatagaaaataaaggatatccagcagttgtaaaaggtgataataaaatattaggggaattaatggagctttatgattttgaagctactttagctgaacttgatgaaatggaaaattatataccaaataaagataacaacgagtataatagatgcgaagttgaagttacacttttagatggaagtgtagaaaaagcttactactatgaatataataaaaactctgaagttaataaaaatgatttgttattacctattaaagaaggggattggaaggaatttattataaataaatagatatatacaggctatattaaaaaagtaattaactactattttaatatagcttttttaatataataaaattaacacatatacataaaattacataaattagtataaaaagatgaaaaggaagggtttattttggaaatatataaaagattggttcaaatagatatgttaccattgtataaatatacgcttaaaaatactaatttaagaaaaaataaatcaactagttctgaagttttagaagttataccgaaaaattctaaggtagaagttattgaagctgatgatgagtggagtaaaattagttataattctaaactgggatatgcacacaatgatttattatcaattagtaaacatccatggagcaatttaaatattagagaaaaagctaatattaattcgaaaattttaactacaatacctaaaaaatccagagtagaaattattgaaaatttaggagattggagcaaagttatatacaatgataaaacaggatatgtttttaattattttttatcagatgatggtaatgaccctaatatgttagattatactaatttttataaaaatatgactgattttgttaatgaaaataaaattaagagtcctacagattatttgttagtaactgatgtgaaaaataaatacacttatgtttttaaaaaagatgatggcaattgggttaatttatataaatgggaaagtactgtaggaaaaccaagtacacctactataacaggagtattttttgtaaatggaagaaaaccatactttggaactgatgagtacagggtcaaatatgcaactagaataaaagatgggtattattatcattctatactttatgattcaacaggaagttatataatagatggaagacttggagaagctttaagccatggatgtataagattagatgttaataatgctaagtggatatatgaaaatattccagatactacaacaatagttatacactaaacatatgatataaaattatggtattatatactaaagcacttatgaaaggaaataaaaaataatgggaaaaacactagtactagctgaaaaaccttctgtaggaagagatttagctagagtattaaattgtaaacaagagaaaaatggatatatagaaggaagtaattatatagtaacttgggcacttggacatttagtgactcttgctgagactgaaagttattcaaataaatataaaaattgggatataaatgatttacctatacttcctaagtatttaaaaactatagttattaaaaaaacatcaaaacaatttaacacagtaaaagcacagttaaacagaaatgatgttgatagtattgttatagccacagatgcaggtagagaaggtgaacttgtagcaagatggataatagaaaaatcgcaagttaaaaagcctataaagcgtttatggatatcatctagtacagataaagctataaaagaaggatttaaaaacttaaaagatggtaagtcatatgaaaacttatataaatcagctgtggcaagagcagaggctgattggttagtaggtataaatgcaactcgtgcacttactacaaaatataatgctcagctttcttgtggaagagttcaaactcctgctgtaaatatgatttataaaagagaagaagaaattcaaaagtttaaaccaaaggaatactatggaataagcttacaagctcctatgtttaaattagcttgggtagatagtaaaaataatagtcaaaatagttttaataaagaaaagatagaaaacatattaaaaacgatagaaaataaaaatgctaaaatagtagaagttaataaatcatacaagaaaaaatattcaccaggactatatgatttaacagagcttcaaagagatgctaacaaaatatttaatttctcagctaaggaaactttatctataatgcaaaaactatatgaacatcataaggtacttacttatcctagaacagattctaagtacataagtacggatatagttgatactttaaaagatagagttaaagccgttagtgtaggtgattatacaagagtttgtactaagatattaaaaaataaaataaatacaaataagtcatttgttgataactctaaagttacagaccaccatgctataatacctactgaagaaagagtatttttaagtgatttaagtgataaagaaataaaaatatatgatttagttgtaaaaaaatttttaagtgttttaagtgaaccttttgaatatgagcaaacttctattaaagcagttatagaagatgagacttttgtagctaagggcaaaaaggttataaagcttggatggaaagaaaattacactaatgttgatgaagatgatgataatcaaaatcttccaagtttaaataaaggtgatattataaaaataactaaatctagtatgacaagtggtaaaacccaacctccaaaaccgttaaatgaagctagtttactagctcaaatggaaaaagaaggacttggtactgttgcaactcgtgcagatataatagaaaagatatttaattctttcttagttgaaaaaagaggaaaagatatatttataacttctaaaggtaagcaattattagatttagttcctagtgagttaaaatcagcggaacttacagcttcatgggagaaaaagcttaacgatatatctagtggaaagcttaaaaaagacgtttttgttaatgagatgaaaaattatacaaaagatattgtaaaagatattaaaaatagtgatgcaacttttagacatgataatttaactagaaataagtgtcctgagtgtggcaaatatatgcttgaagttaatggtaaaagaggaaagatgttagtctgtcaagatagagattgtaacactagaaaaacagtttcaatgactactaatgctagatgtcctgtttgtcataagaggttagaacttcgtggtgaaggtgaagctaagacttttgtttgtagttgtggtcatcgtgagaagttaagcagttttaataaaagaaaaaaagaagaaagtaataaagcttctagaaaagatattaataagtatttaaaaaatcagaataaaaaagaagagagttttaataatccttttgctgaggctttatctaaattgaaaaagtaagctatataaaaagcgagatactgatatatgcccattaataatataagtaaggcatatatcaaaatctcgctttttatataaatttcaactatttaaaaataggatcattaatatctaaatttagagcttctaagtcaggtaaagttacatactttccagaaacccaaccagtatatccatctttaaattgaattttaagccaatcattagaagtgacagatgcaatgacagctaaaatctctcctttttttacttgagaaataacagagtaattagtaccaggtccacttcttacattaagtttagagacagttacttgtgctggaccatctgcaaccactacatctttggaagtaatatttactgtatcattagtagcaatagttacatactttccagaaacccaaccagtagaactatttttaacttggactttaagccatccattatctatatctttagcaattacatttaagctatcgtccatttttacttgagaaataacagggtaactagtaccaggaccggttcttacattaagtttaatagcatttactgatactggcccactagcagtttctatactcgatttattatataaattatttttatcagctatattgttactgtttgtagtgtttacatactttccagaaacccaaccagtagaactatttttaaattgaatcttaagccaaccagtagaagtatcttttgcaattatatttaaaatatctccttttttaacttgagaaataacagagtaattagtgctaggaccagttctaacattaagctcagatacagtaactataccagaatttttatcaattactacattatctttattattagtattattttcattttttgaatttaaaacttgcacaaagttttcgtttagataagctatttgtccgttatagttaactttgtaccaagatccaacttttcctgtagtttttagtatttgtccatttgtagcctttcctattattttataatttgttgaaggtccacttctaatatttaaattactgcctttatctacagtcacttttagatttaagttaaaattatcatcttgtgttttatattcttttatgaattttttataagagtacccttctttaccattatattctaccttataccaataaccatcaaaatctaaaatatttacatcggcacctttaggtattatagttagtactttactattagtgtttttattttgtctcatatttaaatctgttgttgttgttgctttttctgctgcataagctcctatagtcgaaactccaataaatgaaaaaactaatatagtttttaaaatactttttttgaaaatattaaattgtttattcattcaaaatctaccacctttatttaaatttaataggtattaaatttttcaatattaaaattaaaattatcaagaacagctgttttaaatttatatttaatatacattaatgtcatatttgcaaatcaattataacacttagttaaaaaacttactataatttggaaataacattattattacagttctgtaaattgtaaaaatattgtagttattttaaatattaaaatttattatatgattaattaatttgtatttactatatatgtataaaaataattttgatatgaagaataatgattaaaaaattgtttgaaatttaagattaaaaaggtaatagataagttggtgagttagaataagtaaaattaaatttatatgtggtattattaagaaatcatttttgagaaattcttataaatgtaatcaaataccacatataaaatattactaatgtatagttatataattttttctaagtaaagcatataatatggctattattcctatgcctattattaaagtattaactgataaatttagtatcccacctattaagaacactacacccattaatactatagttaaggcctcaaattgaatagttttttttctgtctattttgccaagtctttttgataatctttcaaaatactcttctttaaaaatataattactaaattttatttgaataaatccaaatataaatgcagctataccaaagaatacatataaaaagtttatattattcatagttgtcactcctttttaatatttttatattatataatttgaattaaaactttagcataaattattacttaatataaagttgatttaaaatataaaaattacttatattttatactatttatctaatgtaagattaataatttgatcttttgaataatactataggctttgtaatatttgctagattggtgtttttaataattaattcagttgtgtttaataagatattgtcttacatattatttagtttcatagaatcaacctttcgtaaaaaacttgctatttttaataaaacaattataagcgcataagaaaatgttgtcaacaaaggtaattatcaatactaaacaatttacagaatttttagttattgactttttataaaagtgaagatacaattaaaataaatatcggtcgactgactgactgaaaaattgaatctgataattaatcataagataaaaataaaatagataatatgtttatgcaaagagagggagaatatgagtaaaataaaaataataacagacagttcgtgtgatttaaataaagatatagttgaaagatataacataggtgtagttggtcttaatgtatcttttggaaaagatacttatgttgatggagaaataagtaatgaagatttttataaaagaatggctaatgaaaaagaacttcctaaaacatcttgcccatcacctgataaatttacaaaagcttataattgcgatgaagatgaagttttagtaattactataacatctaagctatcagctacatactcaactgcagtacttgctaaaaatatgtttttagaagaaaattttaataaaaatataaaaataatagatagtgaaagtggatcaataggtcaaggacttttagtagttaaagctgctcagctagcagaaaaaggaatgtctttggatgaaatagttaatgagattgaaaaattaaaaaaagatatagtattttttggagcacttgaaactttagaaaatgcaatcaaaggtggaagaataaatccattagcaggaaagcttataaatgcattaaattttaaagttataatacaagttattgatggagtagttaggcctgttgataaggcaagaggagataataattctatcaaaaaggtaattgaaaatgttttaaaatcagttggagaaaataaaaataaagtgttggcaataggccatgctaattgtttagaaaaagctttaaaggttaaagaaattatggttaaagaaaataattttaaagatgtaactataagtgaagtaggctcagttatggggacatatgcatcaaaaggagctattttaataagcgttttataaaataaaaattaccattaacatggtttacataattttattttagtaaagtgaaaatattcttaactatatccttagaatataatatatacaatttagaaaatgaaattaaaagaattatagaaagtttaaataaagagttgaagtgagcttaacaaaggcctttacttcaactctttttatttaattataattatattataatatttaagaataacgtataaaataaagtaatttcaataattggatataaaaataattaaatactaaaattacaaaggaggtgaagtttatgaaaaataaagtattaccattgatcttattgatactaatagatcgaggacttgaccaagattatttaatcttacaaatgttattcagtttttaaagtattaataatatgctagtgtggctcaacggtagagcagctgacttgtaatcagcaggttgtaggttcgattcctatcactagctccaacaaagattatgtggttattatagcaaagaggatatacctgttcccattccgaacacagaagttaagctctttagcgccgatggtacttggtgggaagccgcctgggagagtaggacgtagccacgtaatctttttttatttatttttaatatttattagatattaaaggattttgtatactcatgtagaatttattttatatggggtaaaacttttacatcaaaaaatttcaaaactaaataaatttagatatatttaggttcttatatttaagattaatagggaaagaggtgtaaatcctctacagtccccgctactgtaatgcagacgaactctatttaccactgttttatacgggaaggttagagtaaggttgaagctaagtcaggagacctgccttgtatattatagctaggttctcggggttatagaatttaaatgtcaaaaatttttattacattataatgcacttaaagacttaactctaaagttaagtctttttttatatcgaaatataaggaggtagttatgcaacttttaaaaaatacagttgaaaatatacatccactaagcgaattacatatgaaagcttcaaaagaaagattagatagattaataaaaccggttggtagtttaggtaaattagaagatatatgcatacagttgtcaggtataactaaaaagaaatactttgatactgataaaaaagtgatcatagcatttgcaggagatcatggagtttatgaagaaggagttgcaccagatcctcaaataataactaaactgcaatttcctaatttcacaaaggggttatgtggtgtaggtgcaatatctaaattcgttaactcagatgtgatagcagtagacctaggtataaacacggatgataatttagaaggagtcctaaattataaaattagaaaaggaacttcaaatatggctaaaggaccagctatgactagggaagaagctattaaatgtttagaaatagggatagagataacaaatgattgtatatctaaaggttataatcttataggaattggagaaatgggaatttgtaatactactccaagtagtgcaatagtttctgtgataggtgaatgtgatccaacagatgttacaggaattggagctggacttagaaaagatagattagagcataaagcaaacactataagaaaagctatagaattaaacaaaccagacaaatttgatggagttgatatactagctaaagttggaggatttgaaataggtggtatggcaggagttatattagcttgtgctgcaaataaagttccagttgttattgatggctttatatcttatgcagcagcccttatagcctatactataagccctatgactaaagagtatatgatagcttcacatacttcggcagaatcaggagctaaaaaagcattagaagtattaaagttagatccaatgcttaatatggatatgagattaggtgaaggaagtggagctgctttagcatttaatattatagaggcagctaactttgcatataaaaatatggcgactattgatgaagtagatataggtaaataagaaggtgaatctatgagtaaattaattttagtaactggaggatctaggtcaggaaaaagcaattttgctgaaagtttgtgtattaatagaagaaattccactgcttatatagcaacttctattccatttgatgatgaaatgaaagatagagttaggaaacataaagaaagtagacctagcaactggaaaacttatgaaatttataaggatatatactctataattagtgatataaataaaaagcataagacggttatactagattgtgtaactttattagtcaataatttaatgtttgaatacaaactagattttgataattgtacgccacaagaaactaatgaaatggaatcttacataaaagatcaaatagataaacttataagagaagtagaaaaaacagatttatactttgtaatggtaactaatgagctaggtatgagtttagttccagataataaactttgtagagtatactctgatatagtaggtaggataaatcagtatatagttaaatgtgctgatgaagtctattttgtagttagtggtatacctatgaagattaaggagtaacttatgaaaagatttataggtatattacaattttttactagaattccaataagggtaaatataggttttgatgaagagtttcataaaacaatgtattactttcctttagtagggtttgtattaggaattttatattttataattggattagtatcaagttttttatttgatagctatataacttctgtaaatattttgatatctacagtgatattaactggaggtcttcatttagatggggtaggagatacatttgatggtatatatagttatagagataaagaaaaaatattagagataatgaaagattcacgattaggaacaaatgcaatgctatcagtattatttttaatgttgatgaaacttggattaatatattcaattgtacaatcaggacaattatataatttaatatttatgcctgtatttgcgagaatggcaattgtaatagcttgctataaaagtgtcactccgagaaaaaatggaatgggtaatgtatttataggcaagccttctttaaaaatgatattaactggaatagtgtatacagttatattaataataattatgggtattactttatttaacttaaattcattagatttaattaaagtaatagcgttcatacctataatgattatattatcaagatgttttgtaagatatatatattctaaaatagatgggataacaggagatatacttggatgtatttctgagcttatggaagtaatgtatttaatctatatatatttaatttttggattaaagtaagaggtgaatagatgtctagattaatactagtaaggcatgcaacaactaatgataatatagatgggaatttatcaggtcatatagatagcgaactaagtgatttagggaaattacagatagctaaattaaatgaatttcttgaaaaagaaaaaatagattctatatatacaactacatcgactagaacaaaacaaactgtactagaaatatcaaaatctagaggaataaatattatagaaaaagaaaatttaaaagaaattagttttggagatttcgaagggtttaattttgacattatacaaaaaaattacccagaagaatttgaaaagttaatttcacaaggatttaattatagatatcctaatggagaaagtttaatagactcatataatagagtacgtgaagaaatagataaaataataagttgcaataaagataagactattttaatatgttctcatgcaggaactataagaaatattatatcttacttaattgggaaaacttatgaatttcattggaattttaaaataaataatgcatcagtgagtattattgatatagttgatggatttccagtgattcaaacactaaataatacatctcatttaacttagaataaataagaatacataaaaatattataaaattaacataaattaggttcttcattgaagattaatagggaagaaggtaaaaatccttcgcagcccccgctactgtgatactgacgaaactattagacaccactgtgacgatttacgggaaggaatagaagtaggttgaagtttagccaggagacctgcctagtttatgaatataaaatcttcggggtgaaggattttaaaaattggtgaagtatgtgcatttttaaaaacctatcctttagaggataggtttttatatttctataaatttaaatcttcaatttatagataaaaataattatcaaatcacatatctgaataatgtagagtattttaaacgttgttaaaagattaaagaagtgaattttttgttgtttaaggagattaataatatgagtaaatcgttaatgtttttaggaacagcttctaatgttggtaagagtactttatcggcagggttatgcagaattttaaaacaagatggatatagagtcgtaccttttaaatctcagaatatggcactaaattcatatataactaaagatggattagaaatggggagagctcaagttactcaagccgaagcttgtggtattgaaccagatgttagaatgaatcctattttattaaagcctgctgggaaaaatagatgtcaggtaattgttaaaggcaaagtcttagaccatgtgagtgctagtacttatcatgggtataaggatgaattagcgtctatgcttaaaagtatatatggagatctaagtagtgaatatgatgtagttattttagagggtgcgggtagttgtgcagaaataaatttaaaagataaagatatagctaatatgggaatggctgaaattgcagatgctccagtaattttagtagctgatattgatagaggtggagtttttgcttcaatcgcaggaactatgcttttattagaagaaaaagaaagagctagagttaaaggagtaatcataaataaatttagaggaactgtagaacttttacaatctggtatagatatgctagaggatattataaaagttccagtattaggagttgttccttatagtgatttaaatatagaagatgaagatagtgtgacggatagatttaataaacaatttagacaaaatgatataaatattgaaattataagaactccttatatgtctaatttcacagatgctcatatgctagaaatacaagaggatgtaagtattagatatgtagaaaaaggacaatctttatcaaatccagatatggttattataccaggaagcaaaaatacaatagaagatttaatttatataagagagagcggattagaaaagcaaataaaagacttagaaagacaaggtaaattaatatttggaatttgtggaggatatcaacttctaggtaaaaaaatatatgatccagatggagttgaagggtctataaaagaaatagatggacttggtcttttagagatagaaactatatttgaaaaagaaaaagtaactactcaagtagaagctgtaataaatgagaatttagggggttacttaaatttattaggaaataaaagtgttagagggtatgaaattcatatgggaataagtaaaggaattaataaacctttaaatactatagtaaaaaaattaaatgaagaaacttcatatgttgaaggatgtgtaaatgaaaaaggaaatgtagttgggacttatcttcatggaatatttgatgatgttgagtttacaagaagtttactaaattcagttagagagaaaaagggattagagggtgtagagagttctataaattcttttgaagaatttaagaataaagaatatgacaaattagcagatatattaagacaatgtctagatatagataaaatatatgaaattataaatggttaggtgaaattatgaaaaaaatattaatagcaggaacgagtagtggagtaggtaaaactactatatcactaggaataatgcaagcactaactaatagaaagttaaaagtacaaccttataaagttggaccagattatatagatccatcttaccatacttttataactaaaagagattcaagaaacttagattcttatatgttagatgatgaaaaaattaaatatatagtaaataatgcttctaaagatgcagatatatcagtaattgaaggtgtaatgggtctttatgatggatttggaattgacttaaatgcttgtacaagttcatacacttcaaaattactaaaagctccagttatattagttataaatggaaaggctatgtcatcatcagcagctgctatggtattaggatataaagaacttgataaaaatgtaaatataaaaggtgtaatagtgaataacgtaaaaactcaaagacactatgaacttataaaagaagctatagaaacatattgtaaaattgaagtcttaggatattttccacctaatgaaaaattttcattagaatcaaggcatttaggattagttccaagtgtagaaatagattctttaacagagaagtttaataatttaggaaatgagattgaaaaatacataaatatagacagattaattgagatatcagaaggtgaagaaattgaaagtaactttgatataagtgatctaccaaagtttaaaaataaaaaaatagctatagcttatgataaggcttttaatttctattacaaagaaaatttagaactattaaaacagatgggtgtacaaatattaaaatttagtccccttaatgataagcatttgcctaaagcggattgtatatatataggaggaggctttccagaattgtttgcaaaagaactagatgcaaatcaaagtatgagaaagtctataaaagaagctcatgaaaagaatatacctatatatgctgagtgtggagggttaatgtatttaggagaaaagcttaaagattcaaatgatgatgaatttaacatggttggaatttttaaaggaactagtgaaatgactaagtctctaaaaagatttgggtattgcgatggaattgctaaaatagatacaatactttctaaaaaaggagatgtaataaaaggtcacgagtttcatcattcagtatttaatagtgaagaaccatgtgcatataaaatgataaaaaaaagaggaaataaagtattagatgaatgggatggaggatactcaaaaggtaatactttagctacatatttacatacccacttttataataacttagatgccataattaaatttgtaggtggtagagatgaatagtttaactgtaattataatgacattagcctacatactggatttaataataggggatccgtattcttttcctcatccagttagatttattggaaatttaataagatttgtagaaaataaaatacgaagtatattaaagacatcaggacaattaaaaatgggcggatttgtattgtggattataactgtaggaactacatttatagtaactaatttaataattagtgtatttacatttagtaaaatatcttatgttatagtagcatcaataatactatatacaactttatctacaaaatgcttagcagatgaagctaagaagatatataaggttttaaaaactggagatatagaaaaatcaagaaaacagttatcttatatagtaggtagagatacaactaatttaaatgaacaagagataataagagctacagttgaaacggtagcagaaaatactgtagatggaataatatctcctatgatgtatggatttataggtgggcctgtacttgcgatggtctataaagccataaatactttagattcaatggtaggatataaaaatgaaaagtataaagatataggatttgcatctgcaaaaattgatgatattgcaaattttatacctgcaaggataactccattttttatgattatagcaagtttaatgcttcgactaaatgctaaagaaagtatacgaatagccataagagatagaaaaaatcataaaagtccaaattgtgcgtatccagaaggttcagtagcaggtgcacttggagttcaattaggtggtactaatatatattttgggaaagaagtttataaacctactataggtgataaacacagagaattagaaatagaagatattttaaaaactaataaaataatgtatgttacatcttttgtggcattagtgatattttctattataatttatttaattagatagaaggtgaaaaaatgaatgatcttggacatggagctaatgtagaaattatgtgtaaaacttacaataaagattcaaaaaatataattgattttagctctaacataaacccatatttaataaataatttagaaaattatatattagatggattaagagaatgtgttaaatatccagatataaattatactaatttaagaaaaaacatagctaattatcttaatgttaaaagttcatttataataccaggcaacggtgcaacagagataatatatctcttaatgaaaagtataaataaaagattagctatattaaatcctacattttcagaatatgaaagaggcgcattactaaacaatgtagatgtaataaacttatatctagataaggataaagattttgaaatagatataaataatataaaagaaaatatagataaattcgatagtttatttatatgcaatccatccaatccaataggtagagtatatgatttgagtgaattattagaagttttaactaaacataataagctacttataattgatgagacttttatggaatttgtagaaaaagaagaaaaatatagtttagtaaaatatatagaaaataacccaaatatatttataatcaaagcagtaactaaattttttggcctgccaggtttaagattaggatatggtgtttgtagcaatgaaaagttattggaaaatatgtataaaataaaagagccatggtctataaatacttttgcagatgtactttcaaattacatatttaaagaagagggatatataaaggcaagtaaaaagtattttataaaagaaagaaattttatgcttaaaaatttaaatgaaattaaagaaattaaagcatataaaacagatactaattttatattaattaaattaaaaaataaaactgcaaaagaattaaaagaagaattatttataaaaggtaatattcttataagagatgcatctaactttagaaatctagatgaaaattatataagagtagctataaagagtcatgaagaaaatttaaagttaataaatcaattaactaaaattctaggagaatagaatgaaatcacgtggaatatgtccagcttcttgtggggaatttgttcaaggaattataaaggataaagagtatttatcatcttatgctatagatagatactcaatagttactttagaagaaagaatagaggatgtaaaaaagggtcctttaaaagctagaaaggctatagaggaagtttttaaatattttaatttacctaaaaaagaattaaaacatatatctatagatataaatagtgaaatacctataagtaaaggtatggcaagctcaactgctgatataggagctactataaaagcaactttaaatcttataggaaaaaatttagatgaatatgaaatatctaggcttgcaacaaagatagagcccacagattctatttatattaaagaaaatacaatttttaatcctttagatgcaaatgtaataaaaaagttaggtattctagatactggaaaagtattaatattagaacctaatgaaactctaagtacaaaatacataagaaaaaaagaaaattataataagttaaaaaagcaaaataaatacataatagaatatgcttttaagcttctagaagaaggtataaaaaagaaagatttaaatttaataggacaagcttgtaatataagtagtattgcaaatgaaaacatacataaaaagaaatatttaaatgaaataatggatatatcgaaagagtatggagcctacggagtcaacattgcgcatagtggaactgtggtaggaatacttttagaatctgatatgaatgaagaaataattaaaactaagcttatagatagaaagataaataaaaaatataaaaaaatatacacagcaaatataatagctgggggacttaggagtgattaaacatggaatacattaaaaatcctatgatgatagaaaataaaagttttgaaataatacaaggaataattgatgaaataagaccagattataaatttaaaaatgatatagaagaaaaaattataaaaagagctatacatacaacggcagactttgaatatttagatatattaaaaatatctgaaacagcggtagaaaaaatatcaaatgcattaaaaaataaagctactatttatacagatactaatatggcattaagcggtataaacaaaagaaaattagatgctctaggatgtaaatacaaatgttttgtaagtgatgaagaagtagcgaaactagcaaaagaaaaaggaataactagatctatggcagcagtagaagttgcatcaaaagaagaagggaaaaaagtttttgtacttggaaatgctccaacagctttatataaagttatagagatgcataatacaaaacaattagaagtagaagcagtagttggtgtgccagttggatttgtaggagcagaagaatcaaaggatgagttagaaaaaacagatattcctttcataatatcaaaaggtagaaaaggtggaagtaatttagcagcagctataataaatgcgatattatatgcgatgtaaggtgatatcatggaagaatatgtttatatagatggtaagaaatataaaagaggatatactacaggttcttgtgctacagcagcagctaaagcagcatcttatatgctacttacgaaatttccgatagaagtcgtaaatatagatactcctaaaggaatacctcttaatttaaaagtagaaaacataaacatacaagatgattatgtagagtgttctatacgaaaagatggtggagatgatatagatgcaactcataatatgcatatatatgcaagagctgaatttatagattcaaaagaaattataataactgggggtaatggagtagggagagttactaagaaaggtttaggtatagaaattggagaatctgcaataaataaaactccaagaaatatgataaacaatgaagttagaaaagttataggagaagataaaggagtgaaaataactatattcgcacctgaaggagaacttatagctaagaaaacttttaatccacgacttggaatagtaggggggatatctataattggaactacaggaatagtagaaccaatgagtgatgaaggatggaagaaatctttatctatagaacttgaaatgaaaaaggctcaaggaatggacaagataattttagttccaggaaatcatggagaaatgtttataaaagaaacattaggaattgatataaagtatatagttagaactagtaattttataggctatatgttaaaagaagctcaaagaattgggtttaaaaagatacttatggctggacatcttggaaaatatgtaaagatagcaggtgggatatttaatactcatagtaaagtagcagatgctagaaatgaaatattattggcaaatttagctcttatgaatgcacctttcgaacttattaagaaagtaaatgaatgtttaacgactgaagaatttattgaaattattaattctaaagaatatgaaggatacaaagaaatatataatatactttcaaataaatgtagagaaagaatagatatataccttaatgatgaagaaatagatgttgaagtaatgatattttcaatggaaaaagaattacttgggcaatcagaaaaagctagtgatttaaaggagatattttatgattaacattataggactggggccaggtaacataggatactgcacgaaattaggtgaaaagttaatatataactctgacataattattggtggaagaagaaatttagagaccataactaattttaaaggaaaaaaaattgaactaaatactaatttaaaagaaatagtagaatacataaaaaacaataaagaacaaaatatctcagttatagcttcaggagatccatctatatatggaataggtaagtatttatcaaataattttgataagagtgacttaaacatagtttcaggaataagttcaatgcagtacatattctccaagatatgtgtcgatatgaatgatttgtatatcacaagtagtcatggaaaatctccagattttgactatatacttaaccataaaaaagtttgtatggtaacagataacaaaattggaccaaaagagattgcaaaagaaatactaaaaaggaacttagatagagttatgatagttggagaaaatttatcttatgataatgaaaaaattactatagcaaagccaagtgagattatagaaatagaaaaatttgatatgaatgttgtggtgatattagatgaaaaatagtgagtttataacaggcgatgtgcctataactaaagaagaagttagggctatatctataaataaacttaatctaaaggataaaaaaacattcttagatattggggcggggacaggaagtgtcagtatcgaagtagcatataattaccctaatattgaagtaatatctatagaatgcaaggataaagcgattgatttaataaatcaaaatatagaaaagtttaatttagataatgttaaagtacttaaaggatatgcaccattagatataggtaaaaaagtagattctatatttattggaggaagtggtccaaatctaaaggaaatattagaatggtctaaaatgaatttaaatgaaaatggaactttagttgcaaattttataataatagatactttttataaaactttgaacttattaaaagaattaggatttaaaaacatagaagctacaatgttaaatgtagctaagttagagaaattaggtaaaggtgagtacttcaaacctttaaatccaatatatataatatcttgtaaaaagggagatgaagattatgaataaggtacattttgtaggggcaggaccaggagataaagatttaataacattaaaaggatataaattattaagtgaagctgatgtagttatctatgcaggttcattagtaaatccagctttactagattattgtaaagatggttgtgaaatacataatagtgcatctatggaccttaaccagataatagatgttatggaaaaaggaataaaaagtaataagcaagtagtaaggcttcaaactggagatttctctatatatgggtctataagagaacaagtagaagaactagtgaaattaggtatagattatgattgtactcctggagtaagttcattcttaggagcagcatcggcgttaggagttgaatatactgttcctgaaatatctcaaagtgttgtgataactagaatggaaggaagaactccagtacctgaaaaagaaagtattgaatcttttgctaagcaccaaacatctatggctatattcttgtcgattcacgatatagagaaagtagtaaaaagattacacgaaggtggttatccaatgaatactcctatagctgttgtatataaagctacttggccagaggaaaaaatagtaaaaggtactttagaagatatagctgaaaaagtaaaagaaaataaaataaataagactgctttaattttagtgggaagattcttaggcgaagagtataaaaattcaaagctatatgataaggacttcaaacatgagtacagaaaataaaattgcttttatagcagtaacgcaaaatggtaaagatttagctgttaatataaaagaaatattaggtgaaggtgatatttatattactgacaaattatctaataaaatcaataaagaaatctataaaattattgaaggaaggttatcagattttacagctaaactatttaaagaatatgagattttaatattcataatggcaactggaatagtagtaagatctatagcaagtcatataaaaagtaaatttgaagacccagccattttagtaatagatgaaaaaggaaagaatgtaataagcttactaagtggacatatgggtggagcgaatgaaatgacaacatatataagtagtcttatagatgctaatcctgtaataactacagctacagatgttaatggtaaaagttcactagatataatagctaaaaatttaaatgcacatatagataattttagggaaaatgtaaaagatgttaattatttactggttaatggaggaaaagtaggattatatatagatggtaattataaagttgatgctagaggttttataaccatcaaaaatattgatgaattccatagtctaaataatttagataaaattatttatataactaataaagataatataaatgtagaagattcaagatttataaaagtagttccaagagacattgtaatagggatgggatgtagaagaaatacaccttatgaaaatattaataatgcattagaagatatcttgaaaaaatacaacatagataaaaaagctatacgtaaaataggaagtgttgaagtaaaaaaggatgaacaaggaattataaaattatcagaaattttaaaagttccatttgaaactattagtatagaagaaataaaaaaaatagaagacaaatttgaaaaatctgagtttgtaaaaaagagtataggggtttattgtgtagcagagccggtagcttatatactcagtgataaaaaccttatagtaacaaagcataagtataagggaataactttttcgatagggagaatagatatatgatttatgtaataggcataggacctggaagtaaagaaatgatgactatagaagctatagaagcaatgaaagatagtgaagtaatagtaggatataaaacttatataaatttaataactgaatttattaaagataaagaagtattacaaaatggaatgagacaagaaatagatagatgtaaacaagcagtagaaattgctaaacaaggtaaaaaggttgcagttataagcagtggagatgctggaatttatggtatggcaggacttatattagagctagtatcaaaagaaaaacaagatataaaagtaaaagttattcctggagttactgcaagtataggagcagctgcaatacttggagcacctataatgcatgatttttgtcatataagcttaagtgatttattaactccttgggaagtaatagaaaaaagattaaaattagcagcagaagctgattttgtaatttgtttatataatccaagaagtaaaggtagaagcgagcacttaagcaaagcatttaaaataatgagtgagtttaaagatggtaaaactccagttggaatagtaaaagatgtaggtagagaaaaagaagaaaagtttatatgtacatttgagactatggattttgaaagagtagatatgactacaatggtagtgataggaaataaatctactttcatacatgatgatttaatgataactccaagaggttacaatatatgattttagttttaggcggaacatcagacagcactcgtatatgcagcttgttaaatgaaatgaataaagaatatatagtttctgtaacgacacaatatggagctgacttagctaataaagtagctaaaaatgtggtaattaaaagaatggatatcgaatatatgactaactttatgaaagaaaataaaattgatttagttatagattcgactcatccatatgcggtagaagtgtcaaaaaatgctatcgaagttacagatatattagatattaattatataagatacgaaagaaaatcacttttagaagaattagaatatgataaggtgataaaagtcaaaaatacagaagaagcttataaaaaggctaatgaaataggtcaaaatatatttttaggaactggaagcaaaactataaaagaatatgcagacaaccttaaaaataaaaggatagtagcaagggtattaccaacaagtgaagttattaaaatgtgtgaagatgctggattaaatgcagataatattatagctatgaagggaccctttagtgaagctataaatgaagaaacatataagcattataatatagatttagttataacaaaagaaagtggtatagaaggtggtttcttagaaaaagtaaatgctgccaaaaatttagatataccagtaattgtaataacaagagaaaaattaaattatcctaatgtagttaattatatagataatataaaagagttagtagtggaggattaagtatgaaaaaagctattttagttgttagctttggaacaagctacaaagaaacaagagaaaagactatagaagcatgtgaaaagaagataaagaaagcttttgaaggatatgatttttttagagctttcacatctaatatgataataagaaaattaaaaaatagagataacatatatattgaaaatcctatagaagctttagatagattacataaagaaggatatgatgaagttatagttcaaacattacatataatttgtggggaagaatatacaaaattaaaagaacaaataagtcagtatgaagataagtttaacaagatagtacttggaagaccccttcttactcagatagaagattataaggaaactatagaagctttaaaaccacaaataccagagctagaagaagatgaagcagtagtatttatgggacatggaactgagcatgaggctcatagtgcttacccagcattagattatatgttaaagcaagaaaatgttaaagcctatgttggaacagtagaaggataccctgagatagaagaagtaatagtaaatcttaaaaaagataaaatatcaaaggttagattaatgccatttatgttagttgcaggagaccatgctataaatgatatggctagtgatgaagaagattcatggaaatcaatattaaataaagaaggattcaaaactaaagtacatttaaaaggtttaggagaaaatgaatgtattcaagataaatttgtgagacacgcacttaattgtgttgaattagtaaatgtaggaggaaattaatatggccaagttttatgggataggtacaggacctggagatagtgaattagtgacagtaaaggcagtaaacacaataaaaaatttagatatattatatacaccagaagctaaaagagaaggaaatagcttagcattaaggatagtagagccgtatctaccagaaaatttaaaaataaaacaaagacattttccaatgaattttaatgatggtgaaaaaataattgcttggaatagagtggcggatgaaatcgtagaagatgttagagaaggtaaaaatgttggatttgtaactttaggagatcctatgatttacagtacatatgtatatataatggaaaggcttatagataaaatagatgttgaaactatacctggtatatcatcattttctaatatagcatctaaccaaaacttcccattagttatggataaagaacctcttataattgttccgtgtactatagatgaagaaaaaatagactatgctttagaaaattatagttctatagtattaatgaaagtttataaaaactttaaagaaatagttaataagttagaaaagaataacttattagaatattctatattagttagtaattcatctttagacaacgaagtggtgtataataatctaaaagagattgatttagaaaataaaatatcttatttttctactatattagtaaacaaagaaaatactaaggtaggataatctggaggattatatgaattttgcagtagtgggagttaatcataatgatacacctatacatataagagaatgcgtatcttttacagatacgcaaaaaatagagagtattaacttcttattagacaatggaattcaagaggttgttatactttctacttgtaatagaagtgaaatatatatatattcgaaaaatatattggataaagttgaaattgtaaaaaatttttatgaagacttttttaatgtaagtaatataaaaaaatatttattttgcaaagtaggtcaagactctataagacatgtatttaatgttgcatcaggacttgattctatagttataggtgaagaccaaattcttgggcaagtaaaagatgcttatgatttttcaagacaattaggagcaagtaaaaaggtatttaataaactttttagagaagctataactgtttctaaagatataaaaactactactaaaatatcacagcagccattatctataagttatataggtattaaatgcttaaaggataaaataggtactttagaaggaaaaaatgctttaataattggtcttggtaaaatgagtagattagcaatgacacatttacaagaagaaaatctaaacaaaatatatattacaaatagaagttatggaaaattacaaggtttacaaaatgagtgtgaaaatttaatacctataaaatttgaagataggtataaagttatgggtgatgtagatgtggttataagtgcaactgcatctcctcacactgttataaagaaagaaaatatgccactattatcaaataaattatttatgatggatatagctttgccaagagatatagataaaaatttaaatcatatggaaaatatagaagtttatgatattgatgatttaaagaaaataagtgatgaaaatgataaaaaaagaaaagagttagcatcctgtgcacaattaataatacaagataaggtagaagagtttaatagttggttaaaagcaataaaaatagaccctactatccaatctttaaatgataaatgtttagacattagagaagataccctagattatatttatagaaaactagatttagattgtaaagagaaaaaaataatagacaagatgcttacttctgcattaaaaagactaattagagagcctatattgaatttaaaacaaattaaagatagtggtaagcaagaagagtatataaaagtagttgaggaattattcgacttgtaatatgtgggacaaaaggagattaagtatgaaaatcatagtaggaagcagaggaagtaatttagctcttactcaaacaaactgggttataagtgaattgaagaaacatcatccaaatatagaatttgaagttaagataataaaaactaaaggggatttaatccaaaacgtttctttggataaaataggggataagggtttatttgttaaagaaatagaacaacaattattagataaaaaaattgatatagctgttcacagtatgaaggatatgccatcaagtttacctgaaggtttaaaatttgcaggtgtacctaaaagagaagatataagagatgtacttatacttaaagaagggtataattctttagatgatttacctgaaggtgctaagataggtagtggaagtaaaagaagaaagtatcaacttttaaagcatagacctgatttaaatatagttcctataagaggtaatatagaaactagaatgaaaaagatagaagatgaaaacttatatggagtaatacttgcagcagcaggtttaaaaagagcaggattagaagaaaaaataagttgttatttagatatagatacagttataccagcaccagcacaaggagctttaggcatcgaaataagaaaaggagaccctaaagtagaagaggtattagactgtataaaagatgaagtctcacaaatacaagtaagtgcagaaagaggatttttagatggaatcaatggaagttgtcatattcctataggtgcatattgtatggttaatggtgaaaatataagtttaactggattatatggagatgaagaaggtaaaaaacttataactaaaactatagaaggtaaaaaatcagaagctagagagctaggaattgagttagctaaattaatttcaaaggagtttgagttttatgaagggtaaagtttatttagttggagccgggcctggagattataagcttatgactttaaaaggaatggaatgtataaaaaaagctgatgtaatagtttatgatagactggctaatgataaatatttaaaagaagcaaaagaaaattgtgagtttatatatgttggaaaagcatctaaaaatcatgctttaccacaagatcagataaatgaagttataactcaaaaggctaaagaagggaaaatagtaacaaggctaaaaggtggagatccatacgtatttggtagaggtggagaagaagctgaatttcttttagaaaatgatgtggaatttgaaatagttcctggcataacatcagctataggcggactttgttatgctggaatacctataactcatagagattatgcatcttcttttcatgttataacaggtcatttaaaagatgatgaaaatgatgaattaaactggaatgctttagctaacaatgaaggaactttagttttcttaatgggagttgcaaatctaaaaaaaataagcagtaatttaataaaagaaggtaaatctaaagatacaccagtagcattaataagttgggctactagatataatcaaagagtagttacatcaactttagaaaatgtatatgaaactgcaataaaagaagaagtaaaaccaccaacacttatagcagtaggtaatgtagttaaacttagagataaattgaacttctttgaaaacaaacctttatttggaaagaatatattggttactagagctagaactcaaagtagtactttggtagaaaaaataatggatttaggtgggaatccaatagaaatacctactataagaattgaaaaagtagaaaacaataaagaattagaatacgaaattaataacatcaaaaaatataattatttaatacttactagtcaaaatggagtaaatatattttttgataagttaagtgaaatgaaattagatttaagaatattagcacatttaaaaatatgtgctgttgggcctgctacagctaaggagcttaaaaagagaggaataattgctgatatagttcctgaaaagtttgtaggagaagcaatgtatgatactttaaaagatatattaaatagcaatgataatatacttattccaagaggttcaagtgcaagagacttcttaggtgataaattaagtgaaatttgcaatataaaagaggtacatacatacaacacagttatagaagataattataaagatgaaataataggcttattaaatgatgaaactatagattacataacatttacaagttcatctacagtttctaattttattgatataataggaagagagaatatagataaacttaaaagtacaaaagttatatctataggtcctataactagtaatacagctaaaaatttaggacttgaggtttataaagaaccaagtaattacacaataaatgatttaattaactgtattatacaagactaaaaatctagggggaatttaagatgttaagaagaccaagaagattaagagcaagttctgcaataagagatttagtgagagaaacagtactaaatataaatgatttaatatatccactgtttgtagtggaaggagaaaatataaaagaagaaataccatcattaccggatgtatatcatttttctttagataaattagaagatgaaataaaagagttaaaagaattaggaatacaacatgtcatattatttgggataccagatgaaaaagatccatgtgggaaagaagcatataatgataatgggatagttcaaaaaggtataagaaagataaaagaaatagatccaagtatgtgtgtaacaactgatgtatgtatgtgtcaatacactagtcatggacactgtggaatattaacagaaaaaggttacgtagataatgatgaaacattaggatatttaacaaagatagctgtaagtcatgctaaggcaggtgcagacatggtagctccatctgatatgatggatggaagaatacaagctatgagagagggattagatgcagcaggttttgaaactgtggctataatgtcatacagtgtcaaatatgcatcaagtttttatggaccatttagagatgcagctggttctgcaccatcatttggagatagaaaaacatatcaaatggacccagcaaactcaaatgaagctttaatagaagctgaacttgatgttttagaaggatcagatatgttaatggttaaacctgcattatcatatcttgatgtaataagaagagttaaagataactttgatttaccgctagtagcttacaatgtaagtggagagtattcaatgttaaaacttgctgttaaagaaggattattaagtgaagatgctatatatgaagctgttatgtcaataaaaagagctggagcagatataataataacttactttgcaaaagatatagcaaagaaaattagggggtaatgaccaatgagaaaaaatgaaaagtcacttaaaatatatgaagaagcaactaagtacataccaggtggtgtaaacagtccggttagagcatttaaatcagtaggattagaccctgtttttatagatagagcagaaggttgcaaaatatatgatgtagatggaaatgagtacatagattatatttgttcttggggtcctcttatgttaggacatagccctaaggaaatagttgatggaatagaggaagtagttaaaaaaggtacaagctatggagttccaactgctatagaagttgatatggctaaacttatagtagaagcttatcccgctatagatcaagtccgtatggtaaattctggaacagaggctactatgagtgctttaagagttgctagagcttacactggtagaaataaaatactaaagtttgaaggatgttaccatggacactcagatgcacttttagttaaatctggatcaggaactataacttatggagttccaacaagcccaggggttcctgaagatgttgttaaagatactttagtaactagatacaatgatatagaagctacaaaagctatatttgaagaacatggtcatgagattgcggctgttatattagaaacagtagcaggaaatatgggagttgtcccaggtaaaaaagaatttatacaatttttaagagatataactaaagaatataaaactgttttaatatttgatgaagttataactggatttagattagcttataacagttctgtaggttactatggaatagagcctgatatggcttgctttggtaaaataataggtgctggacttccagtaggagcttatggcggtaagaaggaaataatggatatggtatctcctgtagggcctgtttatcaagctggtactttatcaggtaacccactagctatgtatatgggtaaaaagaacttagaaatattaagagatagacctgaaatttatagtgagttagaaagaaaagctaagagacttgaagaaggattaagagctaatgttgaaaaattaggattaaactatactgttaatagagctggatctttagtttgtttattcttcgctgaaggacctataaataactatgatgatgttactaagtgtaatgttgaaatgtttaataagtactttgaagaattgttaaacagaggtatcttacttgcaccaactcaatttgaggctatgttcttatctaatgctcatactgacgagataatagatgaaactattaaggctagctatgaagctttaaaagctgctcataatttataaataaaattagattatcaagacattggttgatttattgaccaatgtcttttttatataaaataaaaaggtaactcatatttatttatagaaatagataaattgtaaataaatttttagaggagaaactttttatgaaaattgatagagatttattagaagtatatttaaataaatggcaagatattcttagacttagagattgggatattaagtgtgaattggttgaagttgaatggagaaagagtggagatataaaaatcgatagagatgtcaaacaagctgttttaatgataaataactataatagaaaacataccaatttagaagctttagtaattcatgaactgttacatcttaaattatggggtatggatcaaatgatagagtctcttatttacagtgtttttgggaatgatgaaaataatcctaagtttgaatttgcttataatcaatttatgcatgaattggaaagtactgtagaagatttggcaaaagcatatgtatttacaggagctgaaaataaagatatttcatttggtagaattcaaaagcaagtggatgaagagttaggattaaatattgatgttaaatagtttttagttgtaatataattatatatatgaatataatttgaagggatttaaaatatgaattatccaataatgatagatttaaaaggtaaaaagataactataattggaggaggaaaaatagcgtacagaaaagctagcaactttattaattttgggtatgatgttaatgttgtttctataggatttatagaagaatttaaaaatataagagataaagttaattttataattgatgaatataatgaaaaatatatagaagatagctttatagttgtagccgcaactaataatacagaaattaataaaaaaataggtatattttgtagagaaaaagataaactagttaatgtggttgataatcctgacttatctaattttatagttccttcttgtcttaaaagaggagatttaattataagtgtatctacttgtggaaaaagtccttctttagcatctaagataaaaaaagatttagaagtaacttatgatgatagttatgaagaatatgttaatttattaggagaaataagaattaaaattctcgaaaaatataatgattcaagagaaaaaaagaaattattaaatgaaataataaatttaagtcttgaagaacttaaaaaatatgaaatctgataattgttgaaatttagggttttttaagatgtgcctttaaagtttaaaatgaaaaataaaaaaagtttttaaaaaagtattgacgatatgatatgaaggtggtaaagtattacttgtccttaagaaaagggcaaacaaataaatgaactttgaaaattaaacagtaggttaattataaaaattctttttaaagaattaaacaacaaacaaccaagccagatattcagataatgatagctgagcgatggacaacttttatttgagagtttgatcctggctcaggatgaacgctggcggcgtgcctaacacataataaaaaataaaagatattaaattatatgattttaaatttagttctttaaaataaataaaaagagaaaataatgtagaaaaaacaatgtaatccataaaaatgataaaaaatatatttagatacttaaaaaatgtagaaaaatacactataatttagatttaaataaatttttcaattatctgattgtttttaaaaataaataaagtatgaatttttgataaaatctaaacaatattgaaaaataagaaaaatggtgttattctttgaaatgaaaggggatgataaattaataacaattttgttattaatttataaaaagaaatcataaatatattcaagggggattaacatgtctaaaccaagtaataatactaagaaacttacgttagtaccattaatactaatgatatttacatcagtatttgggttttctaacatgccaagagcattctacttgatgggatactcagcaataccttggtacgtattaagtgccgtactattttttataccttatgcatttatgatggcagagtatggatctgcatttaaaaaagaaagtggaggtatgtattcatggatggaaaaatctgtaggagctaaatatgcttttataggaacattcatgtggtatgcatcgtatatgatatggatggtaagtgtatcatctagtttatggattccattatctaatgcaatatttgggtctgataaaacagcaacttggacaatatttggactagattcagttaagacattaggtatattaggagctatatggatatgtgtagttacatttgtaggatcaaaaggagtagataaaataagtaaagtaacatcagtaggtggtactgcagttacactacttaatattgtattattaggtggaggtatgctagtagttgctttaactggggaattagcagaacctataactaatattgctcaatcttttactaactcaccaagtccaaattatcaaacacctcttgctatattatcattcttaacatttgcagtgtttgcatttggaggattagaagttttaggtggtcttgttgatcaaactgaaaatgcagagaaaactttccctaaagggcttgcaatttcagcaatagttatatctgtaggatatgcacttggaatatttgcatgtggtatgtttactaactggtctgaagtattaggcggagaacatgttaatatggcaaatgctacttatatactaatgagtaacttaggatttaaaataggtcaaggtttaggtcttgctgaaactacttctttagcaataggagcatggactgctagatttgttggattatctatgtttttatcattaactggagcattctttacattaagttattcacctttaaaaactttaatacaaggtgcaccaaaagaagtatggcctggtaaattaggagagataaaaaatggtatgcctataaatgcaatgatagttcaagctatactagttgtagctatgatacttatagtttcatttggtggaagtaatgcagcagagttctttgctatattaactttaatgactaatgttgcaatgacaataccatatatgttcttatctgcagcattccctgtatttaagaaaaagcaattaaaaggtgaattagataagccatttgttgtatataaatcttatggagctgcgatgatagcatctgtaattgtaactgctataataggatttgcaaatatatttactattatagaaccagcattatcttctccagaaggtatgtcaaagactatcactatgataggtgggcctttagtattctcagtagtaggatttggattatttacattttatgaaattaaacatgttaaaaaatctaaagaatctaaaaaggttatgggatagattaaaaggagagtatgaactctccttttttttataaaaatattaattaccttggctacctaatatatttgttatatacaacaaatatattttaatttgagtatatccatgtgctaagtacaatcataactttaataattgatttaatcttatggaaattcataaaaactaaaggagttaagttatttaaaaatatatctataaattaggagagtatatagtttttataaggtgaaaattaccttggaaataattgaaacagataggattttgttaagatatttgaaaaaattatagtttatagaaaaaagtatttaaacaatatgaaaattatatgttttagggtatcctatggtaggatacctttttgtattaaaataaaaaaatattataaaaatgaaaaagttaaaactttttgatatggataaatcgtctatatatatgaagaggaaaggaggcttctacatttaaatgaaattattgagctcaaataaaaaaaataaagaagctaaagttaaagactatatagtaaataatcaagaaagtttctataaaatagcatatagttatgtaaaaaatgaagatgatgcattagatatagtacatgatgctatatgtaaggcgctttataaaatagattcacttaaagatatagaagttgttaaatcatggttttataaaatcttaataaatagttctatagactatataagaaaaaattataaatatataagtctgactgaagaacaatttataaatgaacatgaagtgcacgatagatatcatgatatagaccttgagaaagcactagatatattacctgaagattatagaattataatcgttttaaggtattttgaggatatgaaaattgaagatatagctaatgttttatcagaaaacattaatactgtaaaaacaaaattgtataagggactaagacggcttaggataaaaataaaaactgaggattattaaggagaatataatttatgaaaaataaaaataaaattgatgaattgaaagtggaatatgacaacattcctatcccagaaagattgaaatatgtagtaaatgatgctatagaatctaaaaaaacatataaacaaaatcaaaaaaaatggttaattacagcagcgtctttatgtttaataattggagctgttaatataagtccagtatttgcagaaaacttagaacaaattcccgtaataggaagtgttgtaaaaataattaacttttcaaactatgaaataaaagaaaatggatatgaggcatctataaaagttcctaatataaatggattagataataaagagttagaatataaattgaacaaggaatttgaaacgcaaggtaaacagatgtataaccaatatttagaggaaattaaatcattaaaagaagttggtaaaataggaaataaagaagttaagtcttggtatgagatccaaactgataatgatgatatattatcacttgttatttataattattctgcggaaggttcatctgatactaagagaaaattctataatatagataaacataatcaaactatattaacgctacaaggcatatttaaaaatgatgattatataaaagttataagtgaaaatataaaacaacaaatgaaagatcaaatgaaaaaagatgaaaataaatattattggctagatgaagaaattgatcctgaaattaattttaaatctataaaaaaagatcagcaattttatataaatgaaaataaagagcttgttattagttttgataaatatgaggtaggaccagggtctatgggagtagtagagtttgttataccaaatgaggttataaagcatctaatgaattagggaggggattttgtgaattcaaaggttttaattagggcattatcaattatcggatggatggggttagttataactatgtatatgatagtatctactttaaatatgtaaaatactaaagtttattattaagtaaatatatatttaaagtttgacactactttaaattaaaaaatagagtctataatataggctctatttttattttatttacactttaaaataaaaggtgtagaataaaatgtaaatatttttttttaaagagtagactttttgcattattatgatatactaataatgcaaaaatgatatactaaataaacttggagggggaattatgtttaatataaataatataaatgatgaattatttggtaaggttatagcaaatcctacgagaagagagttaagagatttagcaaatcatatggaaatgacaactgagtttaaaagtgctagctatgtaagtaaagttagaaatagaagtgctaaaaatacttatatagttgatgaaatagaaacaggtgtagatcaaatggaaataactaaagctaaagctgacgaaatagcagctaaggtttttgaatatataaaagataaggaaatgataagagtagatagaaaaatgggaatgaatgataaattttcatttaactgtagactatatatttcaaaaaattatgctagaatagctcacatgtggaataatacattattcaatccaactgatgcagaaaatccagatttagtaagtatatatgtaccagagtggccagaaagaataatgtttgcttacccagagtcgggagtaacatttatactaggtagtgattactttggagaatctaagaaatcttttttaagaatggctatgtataaagtaaaacaagcaggtggattaggattccatgctggtagtaaagttcttagagtttatgataaaaataataatctaaaagatgtaggatttataatgtttggattaagtggaacaggtaagactaccttaactatacatgatcatgaactaactggtgaagaaaaagctatagtaagacaagatgatgttgtattcatggatgaaaatggatactgtgtaggtactgaaaatggattttatataaaaacagaagggttaaaccctgatcaacaaagtgttttatacaaagcagcaactagcgaaaatgcagctttagaaaacataaaagtagatgaaaatggaaaagttgatttttatgatacaagtcttacatcaaatggtagaggtgttatattaagagaagaaatagatacaacagatgatactgtagacttagaaaaagcaaataaaataatatttataactagaagaaatgatatagtaccacctgtagtaaaactagatcctaagcaagcattagatgcatttatgttaggtgaatccatagaaacttcggctggagacccaactaaagctggtcaatcaaaaagatgcgtaggaactaatccatttataatgggacctgaaatagaagaaggtatgaaacttaaagaaatactacaaaataatcctgatatggaatgtttcatattaaatacaggaagtgttggtgcaaaagaaaactttgaaggagaaaagttaactataaaagtatctactactataatgaaagaaatagcaagagataacattgagtggataaaagataatgaatggggatatatggtgcctgtagaggttgaaggtatagatataaataaatataatccaagaaattattacactagtgaagagtactctaaaatagctaatatactaaaattagaaagaaaagcatggatagctaaatatgaaaattcagtaatggatgaaatagcagctactaattaattcaataaatataaaagctgtatataatactattattaagtattatatacagctttttattatgcttagagtaaagtataaaattaccccactcttactattataccactaaaaaattataaaaaatagaatagaaaatatgatttattaggtatataattaatttaaattaaatacaagataacaaataaattaagtatttaataattgttttataacaagggggtactacttatgaacataagagtaattggcaaaaacattgaacctacagaaagtataaaagctaaaatagaaagtaagatggagaagttgcaacagtacctaaatatagatacagatattaaagttacaataagtgctgaaagagaatgccaaaagatagaagtaacgatagcaccagtaaaaggacatataataagagctgaggatagccaaaaagatttatattctgctatagatactgtatatgataagttatataaacaacttagaaaatataaaactagaattaaaaatagaaaacacaatagtcaaagcattagatttgaaaatatagaagattatgattttgataatgatatagaagaaaaggatatcaaaataaaaagagttaaaaaattttcaattaagcctatgagtagtgaagaggcaatactacaaatggaacttttaggacatgacttttatatgtttagaaattcagaaaatgataagataagtacagtatataaaagaaatggtttaggatatggaataattgaagagaactaattaaagtaaaaaagctatataaaatgcaaatgcgttttatatagcttttttatttataagaaaatataattaagtaaaaataaaaaattatttaagattaatttaaggttaatttaaactttagtttatgtactttacaatcattaatatgtataatattaaaaaagtattaatggaggattaagtatgaaatcaagatttgaaggtagcttattaggattaattggtattaatatattagcagcattaataagtttttgtacactaggaatagctacaccatgggctatgtgcctaaaatacagttgggaaatagataatactataatagatggaagaagattaaaatttgtaggaagcggaacagaactattttttgaatatattaagtggtggatattaactataataacttttggtatatatggattttggttatatataaacttaataaaatggagagttaaaaatactgaatttgaaaattaatgagggtgataccctcatttttttatgaaaaacttgaataataaaggttaagatgttgtaattaaattttaatctttattagatgacaacgtatgcctattaatatataatataatttgtaaaaagacaaaataaggcaatatggggggatttttttgaaaaaaaatataaaattgggtaaaaagaaagctattatagggtcaatagtaataatagctctttgtataagtggatttgtcgtatttaaaagtaaaaattcagatggaggagaagtaggtgaagcaactcctgagatatacactgtaccaggtaaggaaaaaatatttgtaaatggaaaagttattccaaataaatcggaagatttttttatagatggagataagggagaattagatgagataaaagtagaagatggacaaaaagtagaaaaagggtcagctttattttcttgtaaaaataaaagtgctatttcagaagtagaagacttaaaagaacaaataaaagttaaagaaaatgaaaaaaagaatatagaagatgaattgttaaaaaaacctgttgaatcagagatagaacaattaaatagacaattaaaaaaacttgaagataaagcatattcaacagtacatgctccatttagtggtaaagtatatataaatgagcaatcacagggagaaaatcaaactccatctattatgaccttagaatcagaagatttttatataaagggacaagctagtgagcaagatttatcaaaattaagtttaaatcaagaaatggaaattttagtatattcaacaaaagaaaagtttaaaggtaaaattacatttataggagacaggccttcaacaaatcaaagtggaattgaaaacatgggaaatcaaaatatgtcttattatgatataaaaataaattttttagaaaatcaagatctaacaaatgtaaaaaatggatttcatgttcaaaatacgatagaggtttctaataaaaaaataaaagttccatacacttcactaattcaagaagatgagaagagatttttatataaggttatagatggaatagtatataagcaagaggtaaaaacagaagaaactaatgatgaatttgcagtagtaactgagggtgtaggagaaaatgatgaagtaataagatatgcagatgataaaactataaaagaaggagaaagtatttatccaagcaaagaaacttcagttgaaggcgagggtgaataatttgaaaaatgtaatacagcttaaaggaattcaaaaatattataaagtaggaaaagagaaattacatgttttaaaatctataaacttatctataaaacaaggtgagtttgtaatgataatgggtaaatcaggaagtggaaagactactcttttaaatatattgggatttttagataaatttgatgaaggaagttatttatttcagggtgaagacgtaactaatttaagtgaaaataaacgatcaatatttcgaaatactaatattggatttgtatttcaacaatttaatttagttgaaacattaaatatatatcaaaatgttgaattaccaatgatatataataataaatactctaaagaagaaagaaaagaaagaattgaaaaaaatttagaattagtaggtcttttagataagacaaaacaaagaccacttcaattatcaggaggtcaacaacaacgtattgctatagctagagctcttgttaatgatcctcaaataatatttgcagatgaaccaacgggagcactagatagtgatacaggtattgagataatgaacttattaaaaaagttaaacaatcaaggaaagactataataatggttactcatgatgctgatttaacagaatatgctacaaagcttataaagttaaaagatggtgttataattgagggggtgtagccatgaacttaataaaaaatacactggtaaacttaaaagcacataaacttcgtgtttttgtaactatgatatggataataataggaataacatctgtaatattagttacttcaattggagcaggtcttgaagctaagatgaaagaatctacggataaagttaataagaaaaaaactactataaggtttgaaccttccaattatggcatgatggactattcaatttttttacaaccatttactcaacaagatatagaagtaatttcttttatggagggagttcagatggctaggcctactagtgatgaatctcaaatgagtggttcttatggatttgaagcatatgttgataaaaaatcaacttttatagatataaattcttataaaagtgataaaaaagtagatgtaatatatggaagaaattttggatatgatgatgatgaacgaaaagttatattaataactatgcaaaatgcgacagaattatttgataatccagaagatgctgtaggaaatggaattaatattgatggggatatatatgaaattgtaggagttttaaaagaacaaacacaagaaactgcaaatcaaattaatatgatttatggtatgggagatatgggatatcaaacttcattaatgcctaaaaaagtatttgaaaaacttgttaataagtataattatggaaataacgaaatttatagtatagacatattggtatctccaggatatgatacatatgaagttgctaataatgtagctatgaaactacaagaattacatcctgatttagatgggagttacattactgaagatatggatagtacttatatggaacttgaaaatatgacttcaagtatagataaatttgtaaagattataacacttgtatccttatttgttggaggaataggtgtaatgaatataatgtatatgtctgttattgaaagacaaagagagataggtataagaagagctataggtgcaaaacctcgaaatataatgactcaatttttaatagaatctacatttataactatagtaggaggaatattaggaataattgtgggaattattttagtaggatatatatctaataagttaccatttaaagctatattatcttttaaaggatttgtatatgcagtaagtacatctatattaacaggagttatatttggtatgataccagcatttaaagcatctaaattagatccgataaaagctattcaaaaataattagtaaaaataaatatagttgatataacattttgtagaaataatacatatatattattaagatattgatatttaatatatcatatcagaaaaaatataaagggtgaatgttatgtcaaacaattgcaaaaaaaagtgtaataaatttaaccaaggatgtaacaaaaaacatgataatgattgctgtgaatgtagtaaatttcaagaaatatcaagagaaaaatgtgaacaagctaattgtataatagaaagagctaatagaattgctcaacaagctagacaagcacaacaaagagcagagagacttaaacaacaatcaatagaagaatgttcaagagctaattgcttgtgggaagagtataaaaggttatcaagacaaggtgaagaactaatgaaacaagctaaagattgcttggaagcaagcgttcaatgttttaaagaatgccataaagaagaatgtggatgtagtataaatgattgtgagtggaaaatagaatgtaaggatgacaaacatacatgtgatcactcttgtaagtgtaatcataattggggatgttaaaatcataataaatattaattgaaggtagcatttttatgctacttttaattttaattataatttactgaaaaatcatgaaatatagatatatcaaaaaaggtagaaaaatatgaatattaggtattataaaactgacattgatttaaatttaacatagtaatataataaatacgtattaggttttcatctattaagtttttaatatttatattattggtaatcctaattatgaggtgatttaatatgaaggaaaacaatatcaaaagaaatattaaaaaagagagttttaatgagaaaaaacaacgaataagttcagttgtaaactctattttagaggaaaacacaagtgagtctgatccagatggacattatacaggttgtccaaaaggaaaacaaatcagaccaatacaagatgtagatgatttataaaatattaaaaaattatgccgaggaaggagctttcttatgatttacacaacagaaatcacaaatatgtgtaaaataaacaaaggccctaatcatggaccagcaccaatacctgaagaaggtaagtgggtaaaagcgaaacaaataacagatatatcaggattaactcatggtgtaggttggtgtgcacctcagcaaggagcatgtaaattaacattaaatgttaaagatgggataatacaagaagcgttagttgaaacaataggatgttcaggaatgacacattcagctgctatggcatctgaaatacttcctgggaaaaccatattagaagcattaaatactgatttagtatgtgatgcaataaatactgctatgagagaacttttcttacaaatagtatatggtagaagccaaacagcattttcagaaggaggcttaccagtaggtgctggacttgaagatttaggaaaaggacttagaagtcaagttggaactatgtatggaagtcttgaaaaaggacctagatatttagaaatggcagaaggatacataactaaagtagctttagatgaagatagtgaaataataggatatgagtatgttcaccttgggaaaatgatggaaatggtatctaagggtatggaagctaatgaagcactagaaaaagctaaatctacatacggtagatttaatgaaggtgttaaagttatagacccaagacatgaataaaaaaaaggaaggtgaacttaaatggctttatttgaaagttatgaaagaagaataaatcaaataactcctgtacttgaaaaatacggatttaattctatagaagaatgcagagaactttgcaaatcaaagggatttgacccttatcaaatagttaaggatactcaaaacatagcatttgaaaatgcttgctgggcatatacattaggagcagcaatagctataaaaaaagaatgtatgaaagcagcagatgcagcagaagctataggtgaaggcttacaagcattttgtattccaggttctgttgctgatgatagaaaagtaggacttggacatggaaatttaggtggaatgcttttaagagatgaaactaaatgttttgctttcttagcaggacatgaatcttttgcagcagcagaaggtgctataaaaatagctgaaaaagcaaataaagttagaaaagaagatttaagagttatattaaatggtcttggaaaagatgcagcttatataatatctagaattaatggatttacatatgttcaaacagagtttgattattatactggagaactaaaaatagtaagagaaaaagctttctctaaaggagaaagaagcaaagtaagatgctatggatgtgatgatgttagagaaggtgttgcaataatgcatcatgagggagttgatgtttctataacagggaattcaactaacccaacaagattccaacatccagtagctggaacttataaaaaagagtgttatcaagaaggtaaaaaatatttctcagtagcttctgggggaggtacaggcagaactcttcatcctgataatatggcagcaggaccagcttcttatggtatgactgatactatgggaagaatgcattcagatgcacaatttgcgggttcttcttctgttccagcacacgttgaaatgatgggacttataggaatgggtaataatcctatggttggagctacagttgcaatagctgttgctgttgaagaaagttttaaataagaaatttgaaaataggtagaatttgaatttattcaattcatacctatttttttattatagtattttataatttttctattatatataatagaaataatctatatgaataaagctattgtttataagtgcaaaattagttgatataataaaatcaaaggggggtattgttttggaatcaacttcaatagaatctaaattagatgaacaaaaattaaaagttatacaaaaatataggctccatttaaattctagttctaattgggaatatagacatccaaaaaataaatatcagcctattgaatatttttcacaaaagtttgtagaaaggcacactgcacttgccatggtttttcaaatacataaactttgctttgctaaaataaagtattttgaaagtaatttaaatgattttataccttattcatattcttttaaggatggatttagtgaatgtgagatatataaagttcaatttttatatcataaatatagtaagtatatgattggaatttgtgatttacaaaatataaaagatataaaagaatttaatgatttttgtaagcatttggatagctttaaatattgaattaaattactaaaatcatcgttgatgagaaaattaaaattattaatattaaattatagataaggagagtatggtactcttcttatttttttgaaaaatagtttttattcataagtacagtttgaaagcttatttactacaatattttgtgtataaattatgtgatatttaaatatgaaattaaaaaaattttaagattaataccaaaaatattgggtataaaataaaataaaaccgaatccagcaaagaggataaagttttcttgggataagtttattactaaaagcaaaaaggcttatatatgaaaacactccaatgatggcttttaaaattgtagactttttgaataatttggggtaatatacctaaattttaaaaatagaagattatacaaataaaataaaccacttaaataaaatttactaaaaaggacataacccatatgtaggcaaaatataatctagctatagtaaaagatttagtcaaatttattggtaattaaaacaacaatatgggaggtattatgtatgaatgtttataaacatttcccagtagctaatgatgaagtaggtataatatggacattatcatctataaaagatgcttgtgttgttgagtttgaaccagttaaaaatactaactgtaaagaaaaaaatgaagggaatttaaatggtgaagatgaagcaaaagtacactatattaatatagaacaaggtgatattaattttgaggagtatgataggcttgaaaaagctataatagaaatagataaaaatacagatactaaatatatatttattatgatattaactaaagatcctataataaaaaataatatattaaatatttgtgaaagtttaaaagacaatataactgcaaagttaatacctataactactggtggattaaaagatgaatataatgtaggggttgaagaggcattagaaattttagctaataaaatagttaaaagtaatcataaagattttaataaatataatatattagggtttaatatagataagtataactacgtatcagatgttaaagagttagaaagaattatgaaagaattgtttaataaagatgtaaatacaatatttacagctgattcgagtatagaagatattgaaaatgcaggaaaagcatctttaaatatagtagttagaaaagaaggtttaaaagcagcacagtgtatgcatgaaaagtgtaatataccatacatttataaaaatctatatgggctaaaaaatactattaaatttgtagaagctacaaaaaaaatagatggctatgaactagatgaagacaagtacaataaagaaatacaccatgtaaaaaaatgtatgtttaatatgaaaagaaaactatacttttatgaagaaagtaaagattgtgcagtatttggagatatggatactgttacaggtatgagtgatatgctaaaagaattaggacttaaagttgatagaaaagaaatactacataaaattatatgtgatgaattaaatgctacaaagttagagagaatggattatctaaataataaagaactgttaatacttttaggtgatggtcaaagtatagatatgtatcatgattcaaaaatggacttacaagttactaatacaaacttagataaagctagtatatgctcagacacaccatatattggttttagaggatgtgtgtatattatagagagaatattacatataaaaactgaatgatttattttgtattacactattttataaaaagttttactaattgatataaaagctaaaaaagtcacaatttatagatgcagtcataatatatattacagaggcatagctctgaaactttaataaagggtgagaaattttatgagttgcaaaaacaaagtgtggagtgaatgtggaaatatcagtagtagaaaatgggataacgtatgctattacaaatgtagtgataactgctatgaatccaaaaaatgtaaaagagaaatttgcgaagctaaagaaatcttagatagaataagaaataaaaatgataatttaggtgatcacttaaattatgctaaagaaaatcaagaagatgtaaaaaatgcattaagtaaaattgaaaatgatgtatgtaaattggctaatgatttagagaaaatacaaaaagctttagaagatgctataaaatctttatgtaatatagttaaaaatttagaaaaagctcaaacatctcaagataaatctttgtgtaatgtaaataatgctataaaagaccaagagggcatagatgacttattagataggctagaatgtgcacttcataatattgttgaatgttttggagataattgtagtcatcccatattggttccatgggaagaagattgctgcaaacattcaagtaaaatatgtagaccaaataaatgttatgaaaaaggaaactatgattgttagttgatattttaatttttgacaattgtataaaattaaaaaatgagctcatttttaaaaaaggagctcgtttttttgtgcaaaatatttttaaagattaaatatttaaaagatgaaatatatataaatagacaaatatttacaatttattgtatacagtattgaaaaaaataataaaatatgtataataatctgtagagtaaatattacataaaggttaaaaaggaggaattttttgaagattaagactattaaaaaaagtgttgcggctttagtattatcaacagcatttatgtcgactcttacagtagccaatgcaaataactataaagtatttatagatgcaggccatggtggaagggataatggttcatcatatatggatagagtggaagataaaataaattttcaaattgctaataaagttgaagaaaagcttaaaaagcttggaatagatgtggaaacaagtagagaaagtgatgaatatgtatcactaagagaaagagctaaaaaatcaaacttatcaggtgcagatgtattcgtatctatacatcaaaactcagcagatgatacaaatgcaaaaggattagaaacattttattacaatgaatcagataagaattttgcacaaaagatgcaaaatagtttattaaattacactaatggaaacaacagaggatttaaaaaaggtaatttacaagttttaagagataatgaaataccagcagtacttgtagaatgcggatttatatctagtaatgatgaaggtcataaattaactacagaagagtaccaaaataagatagcaaatggtatagttaatgggataacagatcaactaaatatagataaaagtataaaaactaaaattaacacaaataaagcaatttctttagaagatggtgttagtgttagaagtggaagaggttgtgtttttaaagctattggacgtttagaaaaagggcaacaggtagaagttatagatactaaatttgattggcataagataaagtttgatggcaaatatggatatgtatctagcgtatatgttaaataattaatagagctactttaaaatattaatattttaaagtagctctattaattttttttgaattttaaggtattttttgggaatttaagttgcaaaataagtattgatattataataacttaagcttataatttataaaaataacaatatagaggtgaaaaaaatgaacatgctaattatattagctttaatattaagtataggaatatgctttttaatacccttaggaagtttagcttactttgtaattaaagataaaaagagaattaaaagtttttttataggaatattaatattttttataacacaaatagtaattaggttaccacttataggtttcgtttttccaaaaatgaaatggtatgaaaatatgtttttaaatacatggctaagtgctatatttttagcattaacagcaggattagttgaagagattggaagatatattgcatttaagtatatattaaaaaataatagaacttatagtgatgggatagcctttggctttggtcatggaggaatagaagctatattaattacagggatctcttgtattgttatattaattggaatattagtaggaaatggatttaatttaggaattactgccacagatgtttttatagtaggatttgagagattatgtgctatggttatacacatagggttatctataattattttatatggagttagagaaaatcatataaggtatttatttatagggatacttattcatacactagttaattttccgattataatattatctagagtatttaacgtaggttttatgggagtggaagcgtatgtgtttatatgtgcaattataataggtggatttactatatatgctaaaaatttatatgataaacaaaagttaaattaattatataaaacaagataaataatataaatctatttaaattaatttttacattattttaattaggaaatataaaaatagagccaaaaagaggctctattttttgaacatactatttttaggatacatattttgacttataaaatttatggcttaattttataaatttaaaatttatatttataaattagcgatatcttcgccatatttaacacatctagtagcatcatcgccttcaggagattcatttactattacagattctagaggaagttcaaatccgtaatttttcatttggtcttcccaatttctcatccattctccatccccccatccgtaagaaccgaataggcaagcttttttaccatttcctagattttgtaaggattctataaatggttcaaaatcaacttcttctagattttcattacccatagaggggcaacctagaattagtatatcttcattttttatatcatctatatttactttttctacatttaataactctactgttttaccttggctagatattccttctcctataaggtttgccatagattcggtatttcctgttccactccaatatataattttcatatttatttcctcctatatatgagattgaaatttattatcaattactttgatttaatgataattgttttcaattaaaatgtcaatagtttatttaagatttttttttatcttaaatgaagtatattaaaaaattatattgataaaaagtgtattaaaagtttaataaatttataaatatacataacaaaaaaacaaaaaggactgttagtttggaggacagtcctttttgccgtttgcttgtcttaggaaatatacaatatttaataaatttaggcttattatgaaattaatctggttgcttaattgatattgattattatttattcttgccttgatttaatgataattgttttcaattaaaaagtcaatagagaaaaagaaaaaaataaatcatattaaaattatttgataaatatattaattcataataatattaaattataaagaaactaaagataggagaatctgatttgagtaataaatattatgcagtaaaagttggaaaaaagcctggtatctataatacttgggatgaatgtaaagaacaagttaataaatttccaggagctatatataaaagttttaaaacattagaagaagctgaaaaatttacaggtattaaaaaggaagttaaaatcagtaaagagaaaagcataaaaactaaaataacagataaagttaataaagaaagtgagttaaagcctataagaagcagcgcaaaagttaaatattttgaaaaatacataaaaccagatgatataaaaaatgattttgattttgtggcatttgttgatggaagttatgatagagtatcaaaaacatttggttctggaattgttgtacttgattttaaagatgatagtgtgtgtgaatttaaagttgcaggccatgataagtgggatcaatggaatattgtaggcgaaatagaagcctctaaatatgctatcaaattagctcatgagaaaaaattaaaaaaggtatgcatatatcatgacttaaaaaatatagcactttgggctagtggaagttggcaagctaaaaatgagtatactcaagattatgttagatatatagaaaagtatagtaaggatatggatatcacttttattaaagttaagggacatagttctaacaaatataatgatatcgctgatagattagctagagaagctatagaggaatatttataagtaaaaagtaatacaatataattctagcatgcaagttttataagatataagagtataaaaatttgtcaaaatagagttttcctagaattaaattcataataataaagtgttattttgcaaaaactatatatgaaaatatctcaaggaggaaataaaatgacaaaaaagcctttagtaagtaatgcaaaagaagctttaaatcaaatgaagttagaaatcgcaggagagttaggaatttcaagttttaatgtaaatggtgctaatagaacctcttatgaaaatggtgttatggctggaagtttaggtgctatgatgagcaaaaaattagtacaaatgggagaagaacaattaattaaagaatacaatagcaaaaagtaaaaagataaagcattgaactaagttatagttcaatgcttttatttataaaaaattgatatattaaaataaaatttgaacaaataagttgtaaaaattgatataatattacttaacagtagttatttaaacaaagataaatataaaaactggggagatttgggggagaaagatgcgaaggtatgggggtaaattattatttacttttttaactattatgttttatttaacatcttttaacatagtaagtgcacaacaatataaaagttggaaaaacgttttatatataagttcgtatagtcctaattatgaaactttttcagatcagttggagggcataaaagatggaatagaaaaagatgttaatatacaaatggagtatatggattcaagaagatttttagatgaagaaaacgttaataaattttatgaattgcttaagtataagctagaaaataataaaaaatatgatgttataattttagcagatgatcaagcacttgaatttggattaaggtataaaaaagaattatttaaagatactccaattgtatttttaggtgcgagctcacctgatagaattaaaaaagctaaaaaagaagaaaatatatatggggttacagaagattgttctatacaagaaaatatagaattaatagataagttgcataaaggaaaaaatataaatgttatatcagatgcatcatcaaatcatttgaatgatcaatatgattttaaaaaaatgcgtgaaaaaaataaacatattaattttacaagtatgtctttatacaatatgacatttgaagagctaggaaaaaaattgaaaaatttagataataatgatgtagtattagtaatatattcttatgtagataaaatgggaaatctaaaatctataaaagaatcttatgaacttataaagaaaaatgcaaatgtacctatatattcagttatggattatggtactcaatgtggttttgttgggggaagagtagtaagtcactacgaccaaggtaaaatagcaggattgatggctaaagacatatttcaagggaaaaagcctaaggaaaaaattattgatggatataaaataaataaatttatattcgactatgatcaattaaaagctaataaaataagaaaaaaagacttaccaaaagactctaagataataaatacacctatggatattatatatagatatagagaaataatatatactagcgtggggttaataataagtttagtcatagtagtgatttcatttatattatatacaataagaaaactacattatgaaaaagaattaataaaagcaaaagagctagctgaaaatatgaacaaatctcaaagtaattttatatcaaatataagtcatgaattaagaactccagtagctgtaataatgtcggccaatcaaatattagatataaatatgaaaaaagtaaaaaatgattattcagaaagcaataatgaaaaaatagatataataaagcaaaactgtaacaggttactaagacttacaaataatatcatagatattgcgaaagtggattcaggttttatgactttaaaattaaaaaatatagatattatccttttattagaaagtattaccatgtcagttataccatatgcaactagtaaaaatataaatataatatttgatacaagtgatgaagaatttataatgagcgtagatccagacaagatagaaagaatagttttaaatttaatttcaaatgcaattaagttttcaaaagataatatgaccatatatgtaaatgtttatgttgataaaatagaaaatatattaactctttctgtgaaagataatggaattggaatagatgaaagtcatttagaaaaaatatttgagcgatttgcacaagtagaagatacaatgataagaagtaatgaaggtagtggaattggattatctcttgtcaaaatatttacaaacttgcatggaggagatatagaagttaagtctaaggttaatgaaggtagtgagtttgtaattagactacctataaatgtattagaagatgaagaagtagtaaattgtgaattatattatgatgatacaacaaattcaaagactgcattagaattttctgatatagaattttaatttaataaaataataaagaagtattgagttatgtaagctcaatacttcttttgttttataaaaagtaatagatttttatagttttgacttttatgcatttatagagcaacactctgaagcatttaggctattaatttttctaaaataatcaatcattaaaggtatacaagctgcaatccaagcaaaaggccctgctaaacaaacacctgtataaccaattgctaaaggaagagcaaatgaaaccacagttcttgccacaagttcacaaactccagccatcataggtgtgaaagtataccccattccttgaagtgaatttctatatataaatattaaactaagtggtataaagaaaaatgatactgtagttaaatacttcatagaataagcaataacatcagggtctgcatcggatataaataatttaacaaagctttctccaaatactacaagtataattcctgaaacaataccaatacctatatttattatagtacacttcttaactccttcttttatacgttctatacttgaagcaccaagattttgagcacagtaagtagccatagttacgccaaatgttacactaggttgcataacaagttgctcaaccctagaagcagcagtatgtgcagcgataacagttgaaccaaatttattaacagcaccttgaagtattattgcaccaatagctgttattgaaaattgaagagccattggaattcctatgtttaagtgctttttaaaatagtttatatcaaatttaaagtgttttttttctaattttaatataggaaatttcttagctgtataaattaagcataaaactcctgaaaaaccttgggatataacagtagcataagctgcaccagctactcccatggacaaattaactataaacactaaatctagtattatatttaaaatagatgcaacaattaaaaagtataatggtgttttactatcaccaagtgcacgaagtatactagatatcatattataaaaaaatgttgcaaataggccaccataaataactattatataagcataagaatcatttattatatcactaggagtttttatcgcatttaaaagtggtctagctgtaaccatacttacaatagtaattaaaattgccataataatagataatataatagaactacctactgcatattttactccctcttcatcatttgccccaaatctttgtgaaactaaaacagaaaagccagatgtaagacctaatacaaatccgattattaaaaataccatagaacctgtagaaccaacggcagcaagagctttaacacctaaaaattttccaactattatagtatcaaccatactataaaattgttggaaaatattgcctataagtaatggtatagagaaatataaaatcaattttactggatttccagtagtcatatcctgtgtcataatatcccctttcatatacatagaatttatttatttgcatataatatcattatttaaatattcatacaatagattatattaaagttaatgaaaatgatactaaaataaataataaaaaaatagtttgacataaaactattttatttatataattaatttgaaaataaattagttatataaaggagacaaaataatgacagacttaagttttatatataaccgtcaaagtataagaaagttcaaggatactaagattccaagagaagatataatggaattattaaaggcagcaacttttgctccatctgcaaaacatcaacaaaattggcattttgttgtacttcaaaataaagatataataaatgaaatggcagatatagtaactaagagtcatgaaaaaataggggaattagctaaaactgaaaaagataaaaaaatacatatgagtgtaataaattattatacatgttttaaaaatgctccagtagtagtattagtttatggatgcgaatataaaatgatagaatataagatattaaaagaaaataatgctccaaaagaagtattagatgttttagtatcaccacaatcaggagctcaaagtataggagcagcagttgaaaactttttattagcagcaactgaaatgggatatggaacttgctatatgacaggtcctactcatgctaaaactgaaatagaaaagcttataggatttgaaaagccaggatatgaattaatgtctatgatagctttaggagttgccgaagataatcaaccagctcaaccacctagaaagccattagaagatgtaactacatttatagactaacaaataaaaagtactctaaataaaattaatatttagagtacttttttattggaatttatattataaaaaataaattttatataaaaaaatttttataatatagattctaataaaaaatcgtgatatattgtatacatagacaacaatattagacaaataacaacaaatcagtaggaagttgacaaaatataaaaaagattaaattattttaagctatagacatcaaaatagggaactacatgagttcctcttgaccccttaaaaatcccttataaaagtataataaatattcccttaaaaaagactgttagttaacagtcttttttatttaaaaattatatttaatcttatttttaaatattattttaaactaaatcttcttttgttggaaaatatttataaaatgtagatttagatattttgcattctttaacaatatcatctattgatgtgtacctaacaccgtgatcattaaaatatttttgtgcaacttgtataataacttcttttttattagtcataattcacctctttattataagtactataaattactaaacgatactagaaagtactagattagattatatttgatttttttattgatgtcaatttttatataagtactgaaaagtataaaaaaatatatataaaatatactgatataaaaatattatcctagctatgtcataagtaatattattaattaatacaatttgtattgagttaagttttaattcattaattaataattaagggtggtgttttatgtatccagtttataaaagtataactacaaaggaaaaatgtgaaaaagtaaaagtatcatttccacctcaacatcaaaattgccaacctggacttgagtatattatgatgccaagacctatatctgataatccttcttataaaggaagttgtaaattacaagataaagttgcaattattactggaggagatagtggaattggaaggtctgtagcttatgcattcgctaaagaaggtgcagatgttgttatttcatatctttgtgaagacaaagatgcaaatgaaactaaagcttatgtagaatgtttaggcagaaaatgtttattagtacctggagatttaagagatgaagaaatgtctaagacagttgttgaaaaagctatagaatgttttgggaaaattgatatactagttaataatcatgcagtacagtttgttcaaaatagtatactagatattacatcagaacaattagatactacttttaaaaccaatgtatatcctttcttttatatgacaaaagcagttcttccgcatttgaaaaaaggatcatctataattaacacaacttctattacggcatatcaaggagagccactacttatagattacagtgcaactaaaggagcaatactatcctttactaggtcactttctcaatcattagtagacaaaggtataagagtaaatggcgttgccccagggccaatttggactccattaattccatcttctttttctgctgaacaggtagaaacttttggtagtggaacaagtaaagttcctatgaatagggcaggtcaaccatttgaagttgctactagctatgtgtttttagcaagtgatgattctagatatatgtcaggtcaagttcttcatcctaatggtggaactatagttggttcttaaattaaataatatatagtttaataaaaaaatttacaaattaatattgtttctaacaaaaagaagtagttattatatataattacttcttttttatttttagtatataaatcaaatataggattataaaattttaataaattagattactgtgtaacgaaagcaaataacttaaattgcttctgtttaagaatgtttatttagtggtaaattcataatataaggttttaatttacatataattgttattaaaataacaattgattggatattttaataggaggatacgaaatgatagacagtgaaactagggtaaagataaaagaagatgcgagaaaacaactaaacacaaataaaaatgcaatgactatagctactgtaatagttgggttaatagctttaattcctcaaatcttaagtgaatatatagtaacatcttataaaatctgtattttaataaacagtattataattcttgtagaaacacccttagtgataggattaaatattatatccttggactgtatgaaaggagagaaggtaaaagtcaaagatatattaaaaggatttgatagattatatcaagcatatggttctatgctaattcagtatgttatagcttttatacttacaatacctcttgcattagttccaataattttattagatagtagctttatagctatatccattatgtctatcataacaggaatagcaagtatattcttctttgctatattttctcaaacagaatttataattgcagataaaaaggatattagtattttagattcaatcaaaaaatcaatagatatgataaaaggacatatattggattacttaatatttacattaagttttattggatggatacttttagtagcatttacatttgggatagcatatatttgggttggtccgtacatgcaaatgtcatatgctaatttttataactacataaaagaagataaattaaataattataaaaaatcaaaaaataaaagtttatttataggaattttaataggtatattactatgtggatatacagtagtagaagaaagtataaaaaatgaattagcaacaccaaaagtaattaaaaatgtattaaatgaaaataatttaaaacttataagttcagatgaagaaactgattattacataacagataaggaacgtaagactttcaatataaataacgaggattatttaactaaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttgtgaaccatatgattcaaaagaaaaagcagataatcataatacaattttagggagatatgatataaaaggaaatgcgctaaagtaaattaatattttaaaataattagtatataaataaaaactctatgctcaaagtatttaaagtactttgagtatagagttttttgttttatatatgtaacagaaattgattgttatactaataaaatatggaaattaattaacgtaagactaatttatataaaaataaatatttaaataatagatttatcatacaattttgtaaaatagaaataatataataagtgcaaaactaaggcatatatacataattcggtggtgaagtataatatgagtaaagtatctaaaagaggatttgacgaaaatgataaaagatggttttctgataaagagctaatacgtttaaaaaaagctaaagaagaaattgaatggttaataaatagagaatataaaatagaacaagtagtaaattttgtaggagataaatatcaattttcaaaaagacaaagagattcgttaaaaagatcaatatgttgttataaaaataaattaataagaagttcaaaaaagctttctatagataacataagcaaaggtcctatatacatagatggctttaatttaataataactcttgaagttgcattatctggaggaacattaattataggtagtgatggaaatattagagatttagcaggtcttagaggtacttataaaattattgataaaactgatgaagctctaaagttaattggaatgtttttaaaaaaacataattgtaaagaagtaaaattttacttagatgaaccagtatctaattcaggaaatttaaagtataaaatacttgattatgctaaatactgggatattgatacaaaagttgagttggtaaataatgcagatgttgttttagaaaaattgggaagagtagttagcagtgatgcagttataattgataaatgtgaaagttattttaatttggctagaagtataattgaagaatatataaaaggcgctaacataattgatttagaaggattaagttaataacttaatcctttttttatttattccattttagatttattaattaaattaacaaaacttaatatattgaaaaaattaattaacataatgattaatgcagattttcaatatttctaaatatatagaaataaacgttttctgttatctttatttagtcaagggtataaaaataaatgtacagataattgctgtacaaaaacttaaggaggtgtttgagatgaataaaaatcttgaagaacaaaggaatagaactataggtgtggggcctaagaaagtaagaagggtaagggcggcaaaagttgataagacagctataagtccatacaatcgttattgtgatggatacggaatgccaggtgcttatggtaacggatatgtttcagtacttacagtttctgttggtacagtgaaaaaaactgatgactttttattagatggtatagtttcatatgatagagcggaaataaatgatgcttatgtcggacaaataaatatgcttactgcttcatctttctgtggtatagcaggtcaagtatggggatatgatttagcgactcatgaagcgatagcagatgaaaaagaggaaccattattttatgtcgaacaatatgatggaacaccacttaaagtatatgatgcaaaacctctattagaagcaggtattgaattatttggtacagaaaaaaatagacgttttacaacagctccaggagctcatgtaatatgtgcaaataaaagtgttacatcttatagaccaaaagaagatagaccgttaaaagatggggaagcttatggagtatggtcatttatagcaatttcattatcaaacgatagagataattgtgcggatttatttatagaagatgcgggactttggacaaaaaatgataatgaagaagatttaagaaaattcttagaaaaacatagaaaagcagtagcttggtcagttaaagagtgcggtagagattcacatgtagttttcgatagaacttatgtcggatttgcttatacaataatgaaaccgggtgaaataggaaatgcattaacttgtgcaccttatgtaactcttgcaagagatgcagtgcctgaaagtggattccctagcttaaatacattaacacttaatgaatggttagatgaaatgaattttaaaccattaacagagtgtactcaaaagtaagatttttaagtacattttgttaaaagtttaaatagcaaaatgcacttaaagctaatatgtttcataaaattaaatgaaatttaggagggctattatgagcgataaaagcagtagtaaaactgataataatagcactaaaaagcttggtgtagttgctttagcaggcgtagtaataagtgctatgctaggtggtggggtttataatctaccacaaaatatggctcaacatgcatctgcaggggcaattttaattgcatggattataactggtatcggtatgtggtttattgcaaacacatttagagtacttgcagctgcaaaaccagatgtaacaactggtatatatgcatatggagagctaggatttggtaaatttacaggttttttaatggcatgggggtattggatttgtaactcttttgccaatgtaggatatgcagtattattgatggactcacttaactatttctttccgtcatattttacaggtgggaacaactggttatcaattatatgtggatcaatagtactttggattatatattttgcagttttatctggagttaaacaagcttcatttttaaatattatagggacaattgggaaattagttccattagctatattcttattagtaatagctatatcatttaaagcttcactattttttactgacttctggggattaaaaactgtagcatcagttcatgatagttctttaggaggattattacctcaggttaagagtactatgcttgtaactttatgggtatttacaggtatagaaggtgcagttgttgtatcaggaagggctaaatctcaaaaagatgttggtaaagcaacatttttaggatttttaatatgtcttttattatacacagcactttcattattaccacttggtgtagttcctcaaggaactgtatcaaaaatggctccaccatcaacagcagccgtattaatgactgtaattggcaaatggggtagcataataatgaatgttggtgtaattatagctatattaagttcatggcttatatggacagttatgctttcagaacttccatttgcagcagctaaaggtggaacattccctaaaatatttactaaagaaaataaaaatgaagcaccagcattttcattacttgcatctacaattgtaatgcaaataatattaatatgtgttcattttacaggaaatgcttggaatatgatgttaagtataacaagtgtcatggctctaccttgttatatagcttcaactttatacctatataaaatatcatcaaaagaggatacttatcctaaaaaaatatttgcaagtcgtaaatatgcgtttgttacttccatattaggtactatatatggattatggttactttatgcagctggacttgaatatttattaatatcacttgttatttatgcaataggtattccagtatttaaaaaagcaagaaaagaaacagcacctaatgagcctgagtttactaagatagaaagatatgttgctatagggctaatagtgcttggagtaatcgggttgatatatttatttaaatttatgtaaattaaataaatataaaaatagagagattgattttaatcaatctctctattttttatattttattagataagtatgcttttagattaattggaaaaaatatctaaaaagggtattataaatataaaaagtaatttgattgacaatatgaaaacactttatcataataatattatactaattttagtaggaggacttattaatggttgataaggaaaaagcacatgattgcaacgtgattcatgctgatatacttaacaaagttaaaaataatatgccaagtgaatttataatgggtaatttgacagagttttttaaaataatgggggatagtactagaatgcaaatattatgtgctttagtacaaaatgaaatgtgtgtgtgtgatttagcagtattggtaaatgtgactaaatccgctatatcacatcaattaagatatttaaagcaagctcatttagttaaatcaagaagaagtggtaaaaatgtattttactctcttgatgatgatcatataaaagatattttagaaaaggcaatagagcatattgtagaatagtagaaatttcaattatagtatatataaatcataaataaaaaaactgttacagcgattaaagctgtaacagtttttttattttaaaaaattttaaaattacacttgacagttgagtaactgctcaactataattaagacataaagttgagtgaatgctcaactgttaacgaaagattaaaataaaaatttaaaaatattaaaaatctaggaggaattaattatgaaaaagaaatttagattacaagggttagattgtgcaaattgtgcagcaaaaatagaaaatgctataaaaaaattaccagtagtaaatgatgcaacagtagattttatgactactaaattagtattagaagcagatgatgacaaaatggaagaagctatagaatcatctaaagcaataattaaaaagatggaaccagatgttatagtgaaaaaaatctaattggagggatatgctatgaatgataaaaagcgtactactcatatggttttaggatctatattattttctttagctgaaaaagataatggtagcatacaagaagttataaagcattttaattcagcaataaaaaaaatagaaccatatgttatggttaaaaaatctaattaggaggatatgctatgaataataaaaagcgtgttactcgtataattttaggttcaatattatttgctgtagcgttaattacaaaatcaaagctacaactattactttaccttataagttatattgttgttggtggagatgttttattaaaagcaattagaaatatttttaaaggtcaagtatttgatgaaaactttttaatgtgtgttgcgactgtgggggcttttcttgtgggggagtacccagaaggggtagcagtaatgctattttaccaaataggtgaagttttccaaagtcatgctgttaatcaatcaagacaatctattgttagtttaatggatattagacctgattatgctaatgtgaaacgtgataatggattagtaaaaatagatccagatgaagtaaaagtagatgatataatcgtagttaaagcaggagaaagaattcctttagatggaatagttatagatggaaattctatggttgatacatcagcattaactggtgaatcagttccaagagaattatctataggttcagaggcattaagtggatgtattaatgttaatggagttttaactgttaaagttacaaaggaatatgaagaatctactgtaagtaagatattagacttagtagaaaatgctagtagtaaaaaatcaaattcagaaaattttataacaaaatttgcaagatactatactccaacagttgttattgtagcagctatattagcagtactaccacctctttttattcaaggagctacatttacagagtgggtatcaagggctttaacatttttagttatatcatgtccttgtgcgctggttatatctgtaccactaagtttctttggaggtataggagcagcttcaaaaagtggtgttttagtaaagggaagtaactacttagaagctttagctgaaatagaggtagttgtatttgataaaactggtaccttaacaaaaggggtatttaaagtacaagagataaatgcaaaaggtatttcaaagaaagagttattagagttaactgcttatgcagaaaattactcaaatcatccaatttcaatatctttaaagcaagcttacaacaaagatattgatgaatctaaaatatctgatgttgaagaaatagctggatgtggagttaaagcaactgtaaaaggtaagtcagtatatgcaggtaacgtaaaattaatgaaaaaaataaatattccttattataaaggagatataatagggacagtagtacatgttgcaattgatggtaaatatgcaggatatatagtaattgcagatgaaatcaaaccagatgcaaaagaagcaataagtgaattaaaacaagcaaatatacaacaaacagttatgctaacaggtgatgctaatagtgttggtatgaaggtagctaaagagttaggtatggataaagcttatacagagttacttccaggaggaaaagtagaaaaaatagaacatttactaaaagagaaatcaccaaaaggaaaactagcttttgttggagatggaattaatgatgcaccagttttagccagagcagacataggtattgcaatgggtgggcttggatcagatgcagcaatagaagctgcagatatagttattatgacagatgaaccatcaaaaatagcaacagctatgaaaatatcaaagcgtacactaagaattgtaagacaaaatatagtatttgcattaggggttaagtttatagtccttattatgggagcttgtggtatggcaactatgtgggaggcagtattcgcagatgtaggagtatctgttattgcaatcttaaatgcaactagagtattaaatataaaaaaaattaaatagatttaaagcttataaaaacattatctatcaaataaaagacgtattggacaacacccaatacgtcttttatttgataatatttaaccttatcgatagatttcattatatattagatgaagtgaagttatatgagaaaatcaagctacatttaattaaagaaattaaagatttttaatgatatactaagtatataaaaagttaaacttatatcttaaaatttaaaaattatttaaaatatatattatatgctaaagggggaagaattaagtatgaacaatatgtataaaacattatcaaatggagtaaagattccatcaattggatttggaacatacaaattaggggattatgatgatacgataaattcagttaaaaatgctattaaaatgggatataggcaaattgatacagcagctttttataaaaatgaggaagctgtaggcttagggataaaagaaagtaagataaatagagaagatatatttttagttacaaaattatggaatgataatcatggttatgaaaatactatgaaatcatttaatgattcaataaaaaaacttggagtagattatctggatttatatttagtacattggccaaacaagttaaatagtgaaacttggagagcttttgaggatttatataaaaggggaaaggtgaaagcaattggtgtttgtaatttcaaagagggacatatagaagaactaaagaagactgcaaatataatgcctatggttaaccaaattgaagtacatccatattgtacacaaaagaatataatttcttattgtaaggataataatatacaggttgttgcttggggaccaataatgagaggtaggatattttcagatccaattatgataaaattatctgataaatataataaaagcatacctcaaataactttaagatggcacttgcaaaatggaataattccaataccaaagtcgtcaaatatagaaagaattaaatcaaatctagagatatttgattttgaaatttcagatgaagatatgaatttaataaataaattaaataaagacgaacatgtatcaggtgtaccagaaaatacaacttatttggattttaaataataatttattttataaataagatttgaatagttacaaagaaaattgaatcacatagtaaaaaatattaatacactaattagatatattaataaaaaaggaataatattaaatgataagttggaatgataataatttattgtgtaataaataaaatattaaatttaaaatatataaaaaaataaaaagatattttcatatatttaatgaaaatatctttttatttttttatatatttagtttaattcttgaatgtctttttctatgatttcagaagctttttctctagattcaacataagttaaatctactttatctaaaggaataactttagttttgtgtttaatcttataatatatatataaagcgaagaataaaggaatacctatataagaagctactaaacctttccaatcgatacctgatggctttatacaggaataaccttgaccaattattattataagacacattaaaagtgctaggataggtccaaaaggataccatttagctttatattttaattcttttaaatcatgatcttgatgaatatacgcttttctaaatctataatgacaaactgctataccaacccatgcaataaatcctgcaagaccagatgcagcaactagccaaacataaacagtactttctgcaaatatacctgttaagaaacatgcagaagctattatagtagttaaaactaaagcatttacaggaacgcctcttttattagtttttgcaaacatcttaggagcaagtccttcttttgccatagaatgaagcattctacttgatgcatacataccagagttaccagcagataatacagaagttaatataactgcattcataagagaagcagcaccagctattccagctttttcaaaaaccatagtaaatggactttctgaaactcctgcttgtgtaaaaggtattatagcacccaaaacaactatagttcctaaataaaatattaatattctccaaaatattgattttatagcttttggtatagttttttcaggattctcactttcaccagcagcaactcctataagctctgtaccttggaatgaaaaacctgcaactaaaaatattgcaaatatggatttagctccaccatgaaatggtccatcagctataaaataattatgaaagcctatttcatctgaacccattattccaagaatcattagtactcctattactaaaaatataattacagtaagtactttgattccagcaaaccagtattcagattctccataagcttttgatgataaaaagtttaatccaacaattataaataaaaataatatactccaataaaatcctggaacgtgagggaaccagtatttcataactaaagagcctgcaaccatttcagcagctattgttatagcccagttataccaatagttccatccaagtgcaaagccaagtgctggatctataaacttagttgcataagaactaaatgagccagatataggcatataagttgccatttcacctaagctagttattaaaaaataaaccattactcctattagaccataagctaataatgctcctccaggtcctgcttgatgaagcgtatctcccattgcaagaaatatacctgttcctatagaaccacctaaagctatcatgtttaagtgtcttgcctttaatcctctttttaattcgtgattttgttcactcatttaaattatcctccttatggtgtcaattataaataagtaactaagataataaaaatatttttaccaataaaaaagtcatgagactatacccatgacataaatacaaaaagatcatacaaaaaagtacgaggttatcgtatgttttcattgaaaatagctctccacaaaatgtgacagtcttatatatattctatataagcccagtaaatagtattaaagctattaactatttacttcggcgaaatttcctttcatattatttcatcgagcttacctccataatactaatcttaagtttcgcgcctctatctcagttatctacttgttgtattcaattataaataaaatttaaaataagtcaatattaaaaattatagttataaagttaattattttcagatatttaatatcaactatattaaatcaaatagtcatgattttttaggagtaataattattaaagagtatattatttattaaaaaactagttgtacatattgtgttgactcatataattataaattttttcaccatgttcttgttcttctttttgaatatggtttaaaacttgtcttacatttttatctctaaattcaaatatagctgtatcatatgtagatgatacatatttttccgtactaagcatatcctgacacagaaccttatcatgttgattaaattgcatactttgagatgcttgtgaattaaggttaggcatagttgaattagtttgaatagttgaattttgattttcttggctttgaccttgatttacgttaggtacagtaccacttaataattgatttatagaatctaagtgttgttgttctttttgagaaagttgattaaataaattttttagctcagaacaagaagctttttgagcataatccttatatttttgaacacataattcttcatgacttttttcatcttctaataacattctttctttagtagttaaatttaacataaaatacacctccaacattattttgtataataaaataaaatattattcaaaaacatatagaaaatatataaataaaaatagaaatttaatatacacttttaaataaaataagctaattagtatataatttttttaatattattaaagttatatgtgttaaaattattatatattaagttagaaaaattacttttaaaggagtataaaaagtgagaaatgaaagcttaagtttaaataaaataatagattctaaaaagtggaataatcttcaagattatctttctatagttactaaaatggcaattgttattgtagattataaaggaaatccagttacgaagcatagtggatgccataaattttgtgaaagggtaagagctaattcaaatctggcaaaacattgtcaaaagtgtgattcaagaggaggattagaagcagtacgattaaacaaaccgtatatatatttatgtcattataatatagttgatgttgcaattcctattataatagatggtaaatatattggagctattatggcaggtcaagtaaaattgtcagattctaactcttgcgatgatttagaacaaatattaaatatatcaaataaatcattagatgaatataatacagaaatattaaaagaatattatgaagaattgccagttttatcttatagtgaagtgaaaaatatttctaatatgttattttacttatctaattacatagttgaagaagcgctagacaaaaacttaattttggaaatgtatgaaaaatccataaaaaatgaatcggaaataaattctaaaatgtttaagggatatagtataagaaatatcaaaaatgtacaaaaagagatgtctaatgctattataaatagctacattagtgaaaatcaagataacgatttcgataaaatctctgtaagcaaaactttaagaccagcaatagaatatatttataaaaataagagtgaaaatatatccatggaaaagatggcaaacttatgccacgtaagtcctagttattttagccggttattttcaaaggagataggagaaaatttttcaagctatatatcaaagttaaaaattaaatgggcaaaaagtattttagaagaaaccgatatgcctattaatgaaataagtgaggaacttggttttagtgaagctggatattttataaaaatatttaaaaagtatgagggagttacaccattttcttatagaaaacaatttagaaaagaaatataattagtttaacactattatgttgttaaaaaaattacgaaaagtagcaaaaatacaattatacaattttaggtaaaaaaattacggttttaaatcgtaactttttaacatatgagtccaatgtaaatttgtgaaaacgatattataataaagataacttaaaaaataataacatttaacaaaatgtgaaggagagattaagatgagaaaagcatttatatgccctacaaaatatgtacagggacaagatgaattattaaatttaggttattttgtaaaagtatttggggactcagctttattaattgctcataaggatgatatacaacgtgttaaaaataaattagatgcaactggaaaaaaattcaatataaattttgtagaaagtaacttcaaaggagaatgttcaagacaagaagtagctagattacaagaaatagctaagaacaataaatgtgcttgtacaataggtcttggtggtggtaaagcaatagatactgctaagtgtgttgcacaaggtgaaaatttaattatagttccaactatagctgccacagacgctccaacaagtcattcagcagtattatacacaccagaaggagagtttgatgattatgcatatttcaaacaaagtcctagtgtagtacttgttgatactacagttatagcaaaagctcctactcgtttcttagtttcaggaatgggagatgcattatcaacatattttgaagcaagagcaacatcaagctcatttacaaaagtaaatgcaggattaccttgtggtgttagagaaggtaagtgtgaaacagctattggaactaatgcagcattagcgcttgctaaattatgctatgagactttattaaaagatggagtaaaagcaaagcagtcatgtgaatgcaacttagtaactcaagcactagaaaatattatagaaacaaatatacttttatcaggacttggatttgaaagcggaggattagcagcagctcatgcaattcatgatggattaactatgttagaaggaacacataagtatttccatggggaaaaggttgcatttggtacaatagcacaattagtactagaaaatgctccaacagaagaaataaatcaagtattagatttttgcttagaaataggattacctgtatgtttagaagatataggagtagatagcatcacagaagaagaagctattgctgttgcagaaaaagcttgtatcccagaggaatcaatatatgctatgccatttccaatagatatagaatctgtagctgcagctattattacggctgacaaaataggaaaaacatataaaaacaacagaggtatgtaatatgaaaaagataataaataaaccagaaaatatagttatggagatgtgtaatggaatagctatggcacatccagaacttgaatttataaaaaaatataaagtaataaagaaaaaagatataaataaaaataaagttagtttaataagtggtggaggaagtggacatgaaccagcgcatgcaggatttgtaggaaaagggatgctagatgctgctgtttgtggggatgtatttgcttcaccatctcaaatacaaatttatcaagctataaaagctacagcaagtgataagggaacactattaattataaaaaattatagtggagatatgatgaactttaaaaatgctgcttatttggcaagtgaagatggtattaaggttgattatgtaaaagtagatgatgatatagctgttgaagatagtttatatactgtaggaagacgtggtgttgcaggaactgtattagtacataaaatagctggggcagctgcacaaagaggaatgtctttagaagaagttaaaactattgctcaaaaagcagcaaatagtgttagaagtataggatttgcacttacatcatgtactgttccagcaaaaggtacaccaacttttgaattaggtgaagatgaaatagaatttggagttggaatacatggagagccaggaataagaagagaaaaaatggcttcagcagatgaattagcaattaaaatggtaaatgctttattaaaagatatgaatatagatggtaaaaaacaagaagaagtcgtgttaatgattaatggatttggagcaactccactacaagaattatatttactaaacaattcagtttctcgtgagttaaataaaagaaatattaaaatatacagaacttttgttggaaactatatgactagtatagatatggctggagcatctgtatctataatgaaagtagatgaacaattaaaagatttattatctgaagtaagtgaagcaccagcttttaaagtttcaggacctgttgatactgtagaatatgtagatatagatgaatgtgataaagattctaacgaagtatcttttgaagtagaaactaatgaaagtttttcgaaaattgaagataataaattaactttacaaaatatgatgtatattgtagataaaatgagtgaagttattataaaaaatgaagttccattttgcgagttagattctcatgcaggagatggtgactttggtatgagtgtagcaaaaggttttaaacaattaaaaagagagtggaaaaatataatttcacataaaaatttaaatataggagaatttttaaatgaatgttctatggtaatcatggaacactgtggtggagcatcaggcccaatatggggatctgcatttagagcagcaggtaaatctacaggagaaaaaatggaacttacagtttcagattttgcaaatatgatgcaatcagcagttaatggaattcaatctacaggagagagatcttttggtcgtggagctgtagttggggataagactttaatagatgcattagttccatgtgcagattcatggaaagtaagtgcaaatgaaaatgatagtttcaaggtagcttttgaaaagggagctaaaaaagctgttgaaggagcaaaagcaactgaacaaatagtagcacgtatggggcgtgcaggaactgtaggcgatagaagtttaggatatccagatgcaggagcatatggattaggtgttatatttacagaaatagcaaataacttaaaatagatatgtcataaatttcaaattagaaaagagttactcaataaataaaaaaagttgagtaactcttttttatataaaaaaattaaaatctataacgtatgttacatacttaactttagttaaaggttataataaggttattaaaaagatgaaaggaagaaaatcaaatgagcaaatttttagcaccaatacacacatggctttttaataaaattatgttagcacaagatttagaacaagatataataaaattacacatagataaatataaagataaagctaaagaggtaaaagaagaatctattaaattatatgggaactatatacctaaaaagcctttagaagatttaatagatactaataatatacatggatggctacagcaaaaaataaaagaggtagaaagtagaagttcatatataataactaagtattgtgagatctttaaagatgaaagtgaagaaataacacaaagtgcatatgttaatcaagcaaaaagatgtgcaaaatatgaaaataataaaattgattcaccagaagatgtctatatatctttaaataattatatattatcaggtatgccttgtgatagagcgaattctgttactgaaagaaatgaaaactatatagtttatgaacaagaaggatgtatacacaaagctaattatgaattaggaaaagcaaatttagattatatgagccaacttagagatttatgggtaaagacgttcatagaaaacttagaaataaaatatatatacgaaaagcaaataaatggtaaaataactattaatacaataagaaagggataaagttatatgagtaattatggaaatctacaaaaaattaaagatggtaaaagaacctatgctataactcctcatataccaggtgggtttgtacttccagaaactcttataaagatagctgaagtggctaagaaatataaaggggtaattaaattaacatcaggtcaaagaatacttataactaatttaaaacaagaagatttagagagtatatgggatgagttagggatggagcctgctgttaaaaaccaaaattcagttaaaaatgtagagatttgtccagctaacttttgtaaacgttcaaaatatcctactataggaataggaatgaaaataagcaagaattttcatggtatgatattgccaaatagaaccaaaatcggtgtagcaggatgtagaaatgcatgtactagtgtatattctaaagatattggagtaatagtagatatagatggaaagttttttgtaacagtaggaggtagtgctggattttacccgagaagttcagatatagtaactaagggtttaagtgaagaagaagcttataacttagtaaaagtaatactagattattataatgaatatggacaaatgggtgaaaaacttggagactttgtagacagaattaaaatagagaaatttagagaagatgtacttaaaatatcaaatttaaaggagtgtttataatatgataactaaagatacaataatagcagatataataaaaatgagacctgatgcagctcaaatacttatgagctatggaatgggatgtataggatgcccatcagcacaaatggaaaaattagagcaagcttgtgaaatacatggattagatttagaagaagttttaaaaaaattaaatgaaaattaaaaaatagaaaatgccttaactaactttaaagttagttaaggcattttttaatatgtaaattttattatctataattatagattagttataaataagaaaatatacatattttaaatattataaattagccaattctttttgaaattcatcagaaagattatttttatcattaggattaaaattatttaaagttgaaatccatacatttactactgaacttatttcattagatatcacagatgaattatcaatattatcaaaagataaaattttagttaataaatattttcttaattcctcatgatttagataatcatagttacttccacatttattacaataattagaataagcattatatacttgggctaagtaacgttctttttgagttagatttttagaatcttttattttatttagaaattctgttaaatcttgttttttattgnnnnnnnnnnnnnnnnnnnnnnnnnnnnnnnnnnnnnnnnnnnnnnnnnnnnnnnnnnnnnnnnnnnnnnnattagattttcatcaaaatttctttcttcttctgaagcttttgttataagtttttttaattgaataatagtatattcaattgtaaagttacataattgttcttctaattctacactttttattaattgattgttattattttgcattcttaccactcctttttaattctatacttataataatagaaataataacattatttgtaagtaacctaagttacgaataaagtgttttataacgggcacaatataattaaagatatgaaatgtaaaaatttataattaaatccatattcagaaataatttacattaattttggaaataatataataacaaattaatacagggaggatgcaataatggattatccaatgttttgttatcaatgtgaacaaacattaggaggtaaaggttgtactaaaataggtgtttgtggaaaaagtccagagatagctgcacttcaggacttactaatatatcaagtaaaaggaattagttgttatgcaaaagaacttatagaaaaaggcgagaaaatagacaaagatatagttagctttgttgaaaatagtctgtttacaactttaactaatgttaacttcgatggtgatgttcatgagaatatgcttagaaaatctcaagaaataaaacaaaatttaagaagtaaagtaaaggcaaataaagtttgctgtgatcaagctacatataatttaagtaatactagaaatcaaatgttagaagatgctaaaaaggctggaataatgtatgatcaagaactagatgcggatatacgttcattaagacaaacaataatatatggtcttaaaggaatctcagcatatggacatcaagctagagaattaggatattataatgatcaagtagatgaattttactttagagcattagcagctactacagatgataaattaacagttgaagatttaataacatggactatgagaactggagatatgagtgttgctgttatgcaaaaattagatgaagcaaatacaactacatataataacccttctcctcataaagtaaatgtccatgtaaagaaaggcccatttatagtagtatcaggacatgacttaaaagatttagaaatgttacttaaacaaactgaaggaaaaggtataaatatatacactcatggtgagatgataccttgtcatggatatccagagctgaataaatatcctcatttagtaggaaactttggaggagcatggcaagatcagcaaaaagaatttgacaacatacctgggtgtatattaatgacaactaattgtttaatgaaacctagagattcatataaagatagaatatttacaactagtgtagttggatgggatggagtcaaatatataggaaaaactgaagatggtcaaaaagactttagtgaaataatcaataaagcattagagcttggtggatttaaagaagatcaagaaccgcatgaaatattagttggatttggacataatgcaaccttaagtaatgcacctgctataatagatgcagttaagtcaggaaagttaagacatttcttcttaataggtggatgtgatggagcaagaccaggaagaaattattatactgagtttgcaaaaaaagtacctgaggattgtataatacttacattagcatgtggtaaatatagatttaataaattagaatttggtgaggttgcaggacttccaagattacttgatgttgggcaatgtaatgatgcatattcagcagtaaggatagcattggccttagcagatgcatttgatactgatgtaaatagcttaccactttctataatattatcttggtacgaacaaaaagcagtggctgatttattagctttattatcactagatataaaaggaatatatcttggaccttcattacctgcttttttaagtccaaatgtacttcaatatttaattgatagatttaatataaagcctataagcacacctgaaaaagatttagcatcatgcttagaggttcctataaattaaagtagagatatggtatttaaaactggataaaaatttattttaaatctagataatttttttatagtttaatacaagagtagaacataaattgaaagatagatagtttagttcttttcttgttacaataatattttaaaacaatcaggaggtagttatgaaagcttttgtggataaagaaacttgtatagggtgtgaagcttgtgctagtatatcaccagaaatatatagtatggatgatgatggtaaatcagttgcaatagaaggagatatacctgaagataagcttgaagaagctcaagaaggaagagatgcttgtccagtagatgctataagcatacatgaataatcttataaataaaaaagaactaatcttaaaattaagattagttcttttttatttataagattaagctattaaatttaaaaaaatacataattatattatctatctaaaaagaatttttagacttttacaactttttccattagggttttaacctaataatactgggtatctaattaacacagacataagtaatatcaattattctaggggtagtttaattaatattataaaataaaatatataggagatgattaagatgaaagaggcacaagcggccaaaaagaattcacttactttatttgcattctttgcgatgaccgcatcaatggttatgacagtttacgaataccctacattcgcaacttcaggattccatttagtattcttccttttacttgggggtatattatggttcttaccagttgctttatgtgcagcagaaatggccacagttgaagggtggcaagaaggtggaatatttgcatgggttggaaacacattaggtgaaaaatttggatttgcagcgatattcttccaatggtttcaaataacagttggatttgttacaatgatttatttcatattaggttgtgtttcatacatatttaattggaatgcattaaacaatgttccgtttataaaatttattggagtattggtaatattctggggattaactttctcacaattaggtggtactaaaaatacagctaaaatagcaaaagctggatttatatttggtatattaataccagcaataatcttatttgcgttatcaatagcttatatagtacaaggaaatcctgtagacgtaaaaataggagcaaaatattttgtacctgatttttcaaaagtagatacattagttgtttttgtttcatttatacttgcttatatgggtgttgaggcatcagcttcacatgtaaatgaattacaggatgctcacaagaactatccattagctatgattatattagttgttttagcaataattttaaatactataggtggtttaactgttgcagctgtagttccacaaagtaaattaagtttaagtgcaggagttgttgaaacatttaaagctttagttttacattttgcacctaatggtacatggcttgtaaaattaattgctatattattagcactaggagtaatgggtgaagttagtgcatgggttgtaggtccttcaagaggtatgtatgcagcagctcaaaaaggtatattacctaaatctctaacaaaaacaaatgaacataatgttcctattaacttagttttcgtacaaggtataatagttacaatatgggcagcagtacttactttcggtggtggaggaaataacgtatcattccttacagctatatcattaacagtagttatatacttagttggatacttattattcttcataggatattttatattagtacttaaaaaatctaatttaaaacgtgcttatcacgtaccaggaggaaaaacatttaaattaatagttgcagcatgtggtttcttaacttcaatatttgcgttagttatatcatttgttcctccagctcagttaactggtaaaagtgctcatgagtatttaactatattaattgtaagtttcattatcacagtgttaataccatttgtaatatatgctattacatctaaaaaaagagatgttgaatcaacaaaatagattatattaaatggataattactataaataattaattaaaaatacttatataaatagggaggtttttaaaatgctatttggaaaacaagatagactaggagataaatataatacgccaatatttgggacaacagaatctggctctagtgtacctaaagatgtattagggaaagattctattgctccaaatctagcttacagactaataaaagatgaattaatgaacgaaggaaatgcaagacttaaaatctaaaaaagaaaagtatatggaacttatgagcaaaaaaataaaagatgctatacatgattaaatataaaaaagagatacatttataaaagtatctcttttttatttaagttttaaattaaattaaaaatttgatgattttaatttaagatattcatttttatcaatacaataaattagatgtttcatttttttattatcatatatttttatataactatcttgtattttcatatttaatctatttgctacattacaagaattaatattactaggtcttatttgtgcaataactttattagcattaagcttagaaaaagcataatcaatacaagctttaataccttcagttgcatacctatatccccatgaatttttatttagtatgtatgctacacctataaatgaatcattatttatatattcaattaaaggtcccattacaccaactactttattatcatttttatttaaagctaaaaagtaactatatccttcattatcatatctttttaaattttcatttatccaatttctaacttcttcatctgaaaaagatttttcccatgcatacataacttcaatatcttggagtatattagcaatttctttataatcattttctgaaatttttcttaaaatcaacctatctgtttctattattatatctttcataaattgagtcccctttttagataaagtatatcacatgattattgaaaaaattcaaaaaaaagaatacacttatattgggatagacaaaaagagaatgagaagagggggatttatgggaaatcaaggtaaggtaaagctcagtaagaatattaaattatttcttgctataaatcttatagcttcttttgctatgggaatttttaatatgtttgtggggatatatctaaaagaaataggatatcaagaacaatttgttggaaatatactttcaattaacactttttcaatagccatagcatctatactaagtgcttacttaatagaaagaatcggtagaaagaaaagcttttacttaggttttatatgtatagctattggatctaaatttatagtacttgttaataatccaatcttaatagtagttatggcaataatgaatggatttggtatgagtatgaaatcaacagcagaaggaatgtatatacttgaaaataccacagaaaaagaaagagtttctgtatttagtacaaattttataatatctaatgctggtatgatgagtgcatcatttttaggaggcgtgatgtcttcttatttaagcaattactttacatcgagtgaatctataaagtatgtatttataatatctgcaattttatctatattagcgttagttcctatatattttatgaaagaaccagaaaacttagagactagaagtttaaaagattgttttaaaggatatgtatctatatttaataaaaaagttgcaaattttatgatatatcaatttttaattggtataggtgcaggtataatagttccattttttagtgtttatttaaaatattcaatgaatatagaagatagtatcgttggaactatactttccatatctcagtttggatgtattataggtggtatggttattccttttatgtcattaaaatttggaaaagttaaatcagttattatttgtcagttattatctataccatttttattatcaattgcttttccccagggaataattataataacgatatcattttttatgagaaatggacttatgaatatggctatgccattaatacaaaacttatcaatggaaatggtttcagataaagaaagaactaatatgagtagtttaatatctttatccagtaatataagtagagccataggaatagccattgggggatttttaatggaaaatatatcttatactgttccgtattattttacagtaggattttatataatagcagttatattatttagtcatatttataaaagtgaacttgagtttaagagaaattcatcttgtattaatattacagataataaataaaaaactagcttaaagtagctagtttttttatttaataaaaactatatagttacaatgaaaacttattaaaacttgattatctagtagaaaaggatatggtatgaagaaaatgttattacacaattgaagaaggaaaagaagcttaatttataaaaaagcttaatacatatttaaactttggaatgatttaaaatcacgtattatatactttaaaaatgccgatttttttaactatgttctaaacaaaacacatctaataataaatatttatgattatattaacttacagttaataaatttaaacaaaagttaaattttagtaaattgtgtatccttaaaaggtaatatatactaattatatagtatcaaagggggaaagtatatggaaagcttaaaaataggagaagttataaaaaaacttagaaaagataaaggtatgacacaagaagatttagctcagtatgtaggtgtatcaactccagctatatcaaaatgggaaagtggtacaacttatccagatataactatactacccatattagctaatttgtttgaagttaccatagataatctactaaactacaaagcagaattagaagatagtgaaataataaaaatagttaaagaatgtgaagcttatattataaattcagacatagatggatatttagatatacataaaaaatacataagaaaatatccttcaaattataagttacactatggattagtaggacttcatgttatggcttatgcaaatataactgatgaaaatgtacgagaaaacttagttgaagatagtataaagatactagaaaactctgtgaaaaacactaaagatatgaaaattaaagaagcatcactaactttactaagtagccaatatttattaaaaaatcaagctgataaggcagaagaagctataaaaaagatatataaaccaacttgtaatcccaatatggtactacctattatatatactgaacaaggcaaagtagaacaagcaagaaaattaatgcaagaaaatttgcaaactgcattaatagaagctatgggagcagctatagcacttggaacaaactactataattataaggatggaaaagaattagattatattgattttgataaagctcaaaaatactttgaattatctatagagattaaaaaaatatttgaagatgaacaaatgacatacttaagcttcatgagtttagcacatatatatttaaggcaaggggatatagaaaaagctataaatactttaaaggaaatgatggtaattgtcagaaagtacaatttaaataagtttaaaagtccaaatactaaatggtgttttgataaattagataaagtagaaaataatacaaatgcttatgatgcatatgagtttttaataatgagcttattaaaagactttgatgaaataaaagataacaaagattttattaatataataaaagaaataaaagaattaaaatctaaaaatagctaaataaaaaggttgtgaaaaaatgggaattgaaattttaaaattattagtaggagcaggagcaatactattaataggaactagctttgccatatttgaaaataggagaagattaaagtacataaagttaaatataataaatcagtatggaaaagaaatcgacttagatgaagtaatgataaaaatgaataacgtatcaagttattttagaaataaaaatgaaaaaaatacaatagataatataacttggaatgatttaaatatggatgatgtatttaagaagataaacaatactcaatgtacagcaggacaagaagtattatatgatatattaagaaagccattatataataaagaagttttaattaaaagagataaagttatagattactttagaaataatgcaaaagaaagacaagctatacagcttattttaggtaaacttggaaaaagcgatgaattatatataactaattgtttatttaatgaagctgatgatagtaaaagtaaactattaaaatatagattactatcatggctaccaacacttagtttattattacttcttataaatcctatgttcttggcactaactataggacttgcagtagtaaatgtattcataagtcaacgaagtaaagttaaaaattatgatgctagtggatttagctatatgataagcattataaacgtagctaataaaataaaaaatatgaatattaaagaaatagaagaaaatgtatatagtatagaaaaaaacttaaataatgttaagcatataaaaagaaaaagtgttggaagtgaaactaaatctattatgagtgatatggatgtattttctgagtatgcaaatttaatatttttaaaagaattaaaaacttatgagaaagttaaaaatactattataaaaaataaagaagatttaaaagctatatatgaatatgttggaatgatagatgctttaatagctatagcatcttttagagatagtttaagtttttatactaagccgatacttactaaatcaaaatcaaaaaaagaaaattatatagaatttgaaaaaatttatcatccacttataaaaaatccagtactaaacagcgggaatttttcaagaggtgtactacttacaggatctaatgcttctggaaaatctacttttataaagacagtagctataaatgctatattagctcaaactatatatacttgttttgcaaaagaatataaatcatcatattttaatatatatacatctatggcactaaaagataatataaacagtagcgaaagttattatatagttgaaattaaatctttaaaaaggatattagatagtataaataatgatataccttgcttatgttttgtagatgaaattcttagaggaacaaatacagttgaaagaatagcatcatcaagtgaggttttaaaaagtatagaaaatgataatactatatgttttgcagcaactcatgatgtagagcttacttatatacttgaagatttatttgataattaccattttgaagagactataacagatgatgatattaaatttgattataagcttcatactggtcgtgctgaaactagaaatgctattaaattattaggatttatgggatatgataaagatttagttgctagagctgatagtagggcaaagatgtttttagaaaatggagattgggaaaatttaaataaatattcacaaatataaagcacttactttttttaagtaagtgctttcttatgcttgaaattataatatatacaaaacatcataagttttacttatgatgttttgtatatatttgtattatctttttatctaataaaaatatataattatttaaaaatactaaatatttataaaaatcattataaaattaaagaaggagatattcttatgaaaaataaaaaaggtctattgacattagtaattatttttatagcagcaaatttgagaggacctttaactatggttggcccgttaataccatatttgaaaaaaagttttacatgtgacgattcaatatttggactgttaacatcaataccattacttggatttgcagtaatttcaataattgccccaaaaatagataataaatttggtaaaaaagctactattaaggggagtttaatattaattataataggacttatagtaagatctttagggttagttagtactttatttataggaagtattttacttgctataggaattggtatatcaaatgtagttttaccaagtgttatagttgaaaattctaaaaaagatgaagtgggaaaattaactggtacttttacaatgactatgggactatttagtgcggttggatctggctcaagtatttttctttactcaattttaggatggagattaacttttgaagcttttatcataacaacatctatagcattagctctttggatagtttttagtaaaaatatgaataaaaaagatgaaaaaacaaatcaagaaaatgatattaaaatatcaactatgttaaaatctaaattagtaatagcaatagcactgtttatgggtattcaatcgtggattgcatatgcaatatttgcatgggtaccttcaatattgataaacagaggagtgtctgcaagcttttcagcattagcattaatgaccatacaattatgtagtatgcctacaatgtatataatcccaattatagcaggaaagaaaaaaagtcaaagtaaatttgtaactcttacaactataatttcactaataggatgtttatcattatttacatctaatattcctacacttataataggattagttcttatgggagtaggacaaggtgctagtttaagtttcgcatatttattctttgcagtaaggtcaaagagttcagcagaaacatcagctttatctggagtatcacaagctataggatattttttaggagcaacagggccaatactttttggttcgatacatgatataactaattcatggacaagctcactaattttaatgatatttatgcatattattttattacttgtaggtataatatcaggtagagatagaaaaatataaaatatatcattttattaaaaaaatatggagattaacatatggatttaagaaaaatagaatattttttagcagctgtagaatacggaagtttcacacaagctgctaaaaattgcaacatatcacaaactgctataagtcaacaaattcaatctatagaaaatgaattaggaatacaattatttgatagaagtgaatacagagcaaagcttacatttgctggtaaaaagttttgcagaagatgtaaacatattataaatgattattacaatgcagttgaagaaataaaatcattagaaaatggatattcaggaaatataaatataggaatttctggaatcattgaaaaaagttttttacaaaaaattttacaaaactatagtcaaaataatcctaatataaatattgaattaaaagaaaataatccaaacaacttagttgaaaatgctaaaaaaaacaacttagatatagtatttggaaatgaaagtaagctaaaagaattagaagaatttgagttatattcagtttttgattgtgagatgtatgttattacatctaaggaccatcattggaataatcgatttgaagttactggaaaggatttagaatcagaaccacttataattttttctaaggaatttagctcaagttatcataaagatactataaagtcttttgagaatgatggatttgaacccaatataactaaattggttgactcttttggagagttaatttttatggtaagcattaacagagggatagctgttttaccaaaagaatcactttataaagttgaaagtgtaaatgcttttaaattaaacaaatcacatcacaaatttgaatattgtattgcaagaaataaaaatagtaaaaataaacatgtggatgtatttgtacaaaatgtattagattttttcaataatgaaggagataaaattatataatatatttaatatttttgattttcccaaaatacagattaaagtaagtaataacaacattacttacttttttgtttttaagcttaaaattttatttaattataattctaatacaaagttatggataataaatttatagaagatacaattaaataaaaattgggggggatatatggatatattaaaatacaatagagacgcttgggataatgaagtcaagataggaaacaaatggacgataccagtaagttcagaagaagtagaaaaagctagaaaaggagaatttaaattattattaacacctacaaaaccagttcctaaagaatggataggagatataaatggcaaaaacgtactttgcctagcttcaggtggaggtcaacaaggacctatattttcagcattaggttctaaagttactgtatttgacaatagtaaagaacagcttttaaaagataatatggtagcaaatagagataacttagacataaaattagaacaaggggatatgagagatttatcaagatttgaaaatgaaggttttgattttatattccacccggtatcaaatagttttgtagataatattgaacaaacttggaatgagtgctatagagtattaaaaaaaggtggaattttaatatctggatttgcaaatccaatttcatatatatttgacttatatgaatgggaaaaaaataataagctagttgtaagcaatagcattccttattcagatatagaacaactttctcaaaagcaattagaagaaagaataaatactcatgatacattagaattcggacattcgctacaaagccaaataggcggacaaattgatgctggatttataatatgtggattttatgaagacaattctggtggtgggttattggatgaatatatagatacatatattgctactaaagcaattaaattataggctaaatatgctaaatataaggctgataatacgaaatatacaacttaccatcatgggaaaatatgattgaatagagattaattaaaaaaaacagtctaaaatattatctaaataagatggtattttagactgttcttttttaagatttatctttgactatattattttctttactatcttgttttatttcccattcaataacaaaagtcataagtactctaagtaaaaatacagcacctaaaattacaagttcatctaatgttttaacaagtactgtttttaaaatttcagcagctaatttgaattctaatccagttgccatagcagttgcaaattgatgtttaaaaccatactttttactaaaaagattattacttaaataaaagtaaaaagctttaaaagcacctattgttataattattacgcccataatttcaaatatactaaccaatataggaatatatttagtcattacctcttctaacataatatcctcctaagttaaaattataactatttatataattaacttatttatcaattatatttattaaatacaccttttttatcaagtaaaagaataattattatacctaaaattaaaataagtgtagaacaaagaccagcttcaggaccaaaagaaccacctgaaataagactatttccagttagattaaaatcaaataagcttcctacattgacatttaaaccactaacttcaaaaccaaataaatttccttgagcaaaattccaagcactgtgaataccacaagcaccccaaaggtcgttagtttttattacatataaaccaaataaatatccaactaatattatgtttaaaattgctacataatttacattaggattaagtagatgtagagctccaaaaaatacagaagaaataaacagtccaaattttataccatatctagcgcctaaaacattcataagccatcctctagttaatatttcttccgtaccaccttgaattatccatccaattaataacacaaatacgttaactaaggcaagtttacctattggctgagttggagttatatttattttagcaaatccaaataaatataatattaaaacaactagtcccattaatatcaatcctattaaaaatccaataacatatttttttagccacttttctttagaaaaaccaatagatgaaatttttcttttttctattttttttactctgaaaaatactaataaagatattcccaaaaaactaagcaaagaagctaaaagtgctataaaattaaatgaaaaaatatgggagacacttaaaaaaataacaagtggtgtaattataagtgaaccaagtatagctcctacatttaaaaatactaaagctaggataatagcccaaattaaattaggcagcttcttagaatatctagctttatcgactaaactttcatttttaataaacataaaaaacccccattaataaaatatattttactatcaatattattttaacatatattttataagttaataaaattacagaaatcttataaaaaatggaatatttaaataaatattggaaatactaactcagagaaaaaacttcataaggagtgtggtattatgttattaagacaaatagcattagtattagttataataggagctttaaactggggaactataggtctatttaatttagactttgtaggaaatttatttggtggaacttattcaatgataagtaaaagtatatttacattagtaggattagctggtttatattctatatacacgctatttacgttaaatgatgataatcgtaaataacaaaaatatagtgaaagattaaaagcttacatcaaaaataaggtgtgagctttttattttagttagaaaacttaaaaaataaataaatattattgactctatacctactatagactttataatttgatttaggaaaaattataggaggtataatatggttaaagaatttttaagttatgccattccatcatcattggcaatgtttatatcgtcattatatactgttatagatggaatttttgtaggtcaaggtgttggaagctcggctttagctgctgtaaatatagtacttccttttactgttgtattatttggaattgcaaatatgctagcagtaggtggaggagcattagtatctaaaaatgtaggtgctgatgaagttgataaagcagtagatatatttagacaggtatttaaattattattaataataagtataataacaagtttagtatgtattatatttaataaacctatagtaagaatgttaggagcaactgagaatttagagccattagcagctgattatcttttatactatgcaatattttgtacacctaacttagtaggtatagtacttaatagttttgttagaaatgataatagaccaaagcttgctatggtttcgactattgcaggagctataactaatgtaatacttgattatgtatttatattccctttagctatgggtataaaaggagcagcaatagctacgggtcttgggcagatagttacagtgcttatattacttcctcattttataaagaaaagaggatatttaagctttggaaatacatctttagacaaagctactataaaagaagttttaaatgtaggattcccatcattttttggtcaggcaagtttctctataatagtatttttacacaatatagctttatcaaactttatgggagaaataggtatatcaacatatagtataataaattatataactacaaatatatatatggttttactaggattaacatttggagcacaaccacttataagttacaatttcggtagaagagattctaagaaaatgttaaagttttatagcataaactgtaagtgttcacttatagttagtataagtgcagctttaatatgttttgtatttggtagaagtatagttggtatatttacaacagatgctcaaatagctaaacttggatatcatggtatcaaaatagcatgtttagcttatataataggtagtataaacttaaacactttagtttactatcaagctatagaaataccaaaattctcaaatttaatttgtttatttagatcaatggtatttttaccaatttgcttaatagtattacctaaattattcggactaaatggtatatggtcaagtgtattagtttcagaatctataacatttatagttatgtacgtaattgcaaatgttaaacgatacactgcaaaagttataaatgaaaatgaaaaaatagaaagtaacatttcagtagaagaattttctaatatttaatataataaaagctacccttatttaaataggggtagcttttatatgttaaaatatattagaggtgatgaaatggggaagtatttatcaattggccagatggctaaattaaacaatatatctgtgcagactctgaggcactatgaaaaagtaggtttgcttaaaccatcatatacaaataaagagacaggatatagatattattcaatgaaagattttaatactatatacttaataaaacagtgtaaagctatgggtatgtcgttagatgagattaaagaagttacaaataactataaatctttagaatctatatttgatatattaggaaatcaaaagaaaatgattaatgaaaagataaaagaattagaaaatattaaaaataaagttgaatctcttgaaaataaaataggattttcattagtacaaggtataaataaagtatttgtaaaacataatgaagaaagaaaatttaaaatatataattataaagatagatatacagatgaatttgaaataaatttaagtaaagtattattagaagtggaaagagattatgaaaatgtaaatgctgaaatatcttttactacatcttataaagaaataaaattaaatggaaatatagtatacaacaatgtaatgataaatttaggggaaaatgtaccttataaagatgagaatataatatctatacctaaaggaaattatttaactatgtattttgatgatgcttatagagattcaggaaagtattacgatataattatggactatattaaaaagaataatatagagcctaaaagtgattttcatgagatatacataatgactagagtcgggatgaatggtaaggaaaagtcattaggtcaaatagaaattttaatataaaatttaataaaaggatacctttagcactgagtataaaactctgtgctttttattttaaaaaaaaattttaaaaaaacttgttttaaaatacccatagggggtataatgtaatagaatcacttttaaagtgagaaatattataataataaattaaataaggatggtgaggaccagtggatgtaaatacacaaaaagacagctaccaaataacaggtatgacctgtgcatcttgtgctaaagctgtcgaaagagcagtaaaaaaaatagacggggtagaagatcaaaatgtaaatatagcaaccgaaaaaatgactatacagtatgataaaaataaggttagctttgatgatataaaatctgccgttgaaaaagcgggttatggaataaagtcggaaaataaaaataaaaaactagacataaaaatagaaggaatgacgtgtcaatcttgtgctaaagcggtagagagaagcataaaaaagcttgatggaatagaagatgtaaatgtaaatatagcaacagatagagcaactataaactataatccatcgatagtaaaaatttcacaaataaaaggcgcagtagaaaaagctggatataaagttgtggatgaagctaaaaagttggatataaaaatagaaggaatgacatgccaatcttgcgctaaagcagtagagagaaacataaaaaaacttgatggaatagaaagtgtaaatgtaaatatagcaacagatagagcaactatacaatatgatcagtcaaaagttaaagtttcacagataaaaagtgcagtagaaaaggctggatataaagttatagatgaagctaaaaaagaagctatagatgaagatagattaagaaaagaaaaggaattaaaggtattaaaaactaaacttataatatcaataatatttgcaataccattactatatatagctatgggacctatgatgccaaaaccatttggcccactacctataccagaatttataaatcctatgactaatactttaaactatgcattaattcaattaatactagttataccaatagtaggagctggatataaattctacattaatggtactaaagcaatgcttgcaaaaagtcctaatatggattctttagttgcagtaggaacagctgcagcacttttatatagtatatatacaacaattcaattagcaagtacagatactatgactatgtcagggcatcatcatcaattatactatgaaagtgcaggtataataatagctttaatattatttggaaaatatttagaatcaagatctaaaggtaaaacttcagaagctataaaaaaacttatgggacttcaaccaaagactgctatagtagttaaaaataacgaagaaattgaaatacctatagatgaagttgaagaaggagatataatagttgttaagccaggtagcaaaatacctgtagatggtgtagttatagaaggacatacatcagttgatgaatctatgttaactggagaaagtatgccagttagtaaaaaagttggagatagggtaacaggtgcaagtattaataaaaacggaaatataagatttaaagctgataaagttggagatgatacagcattagctcaaataataaaattagtagaagatgcacaagggacaaaagctcctatagcaaaattagctgatacagtatctggatattttgtaccagcagttttaactatagctgtaataagtgctctagcttggtttttcataggtggaaaagatgtagtattctcacttacaatatttatatcagtattagttatagcgtgtccttgtgcactagggcttgcaacaccaacagctataatggttggtactggtaaaggtgcagaaaatggtatattaataaaaggtggagaagcattagaatctgctcataaaatagataccataatatttgacaaaacagggactataacagagggtaaacctgttgtaacagatataataactacaaatgtagtaaatgaaaaagaacttttacaaattgctgcaagtgcagaaaaaggatcagaacatccacttggagaagcaatagtaaaaaaaggtgaggaagaaaaaatagagtttttaactttaagtaactttaattctataacaggtcacggtatagaagttacaatagataatcatcaagtattacttggtaataaaaaacttatgaatgacagaaatataagtttagaagatttacacatacaatcagataagttagctagtgaaggtaaaacacctatgtatatagcaatagataataatatagctggtataatagctgttgcagatatagttaaagaaagtagtaaaaaagcagtagaaagattacatgatatgggaatcaaagtagctatggttactggagataatcaaaaaacagctaatgcaatagctaaagaagtaggaatagacattgtattagcagaagtattaccagaagataaagcaaatgaggttaaaaaacttcaagatgcaggaaactttgtagctatggttggagatggtataaacgatgctccagcattagcaaaagcagatataggtatagctataggaagtggtacagatgttgccatagaatctgcaagtatagttttaatgagaagtgacttaatggatgttccaaatgctattaaattaagtaaagaaactattaaaaacattaaacaaaacttattctgggcatttggatacaacactataggtataccagtagcagcaggagtattatacttatttggtggaccacttttaaatcctatgatagcagcagctgctatgagtttaagttcagtttctgttgttggtaatgcactaagacttagaaatttcaaagcatataaataaaattaaagctacctaattttaggtagcttttttattagttaaaaaaattgtacttgttaaaaaagaaattgtatgggtacaaatattattgagtctttaaatataattacttataattgatgatataaggacttgttattgggaggtataataaaatgaacaatgaaacgaaaaaaattgtactaaatggattaatgatagcattagtatgtatagcaacaatgactattcaaattcctatgccaggaacgaatggttatgttaacataggtgatagtgtaatatttatatcatcaattttatttgggcctgtagtaggtatgattgcaggaggaataggttcagcattagcagatattttaagtggatatgcacactgggcaatatttactcttattataaaaggattagaaggatatgtagtaggaattgttataagaaatcactatactactataaaaagtttatttgcaacagctttaggaactataactatggtaactggatattttttagctggaataatcttaaaaggaagcataataatttcagcagcatctataccaggtaacttaattcaaggaatagtatgtatggctatatctattttactttcacattctttagcaaaagtaaaatatgttaagacttttaaagctcattcttagtatttaagtcatataaaatataaattattattaaaataattttaagtaaacatgttaataaattataaataaaaaagacaggtcttaaacctgtctttttgagtagtagaagaatttaaatgcatataaaagcttttctttttgttttaattatataaatataatatagaaatatttaagtaatcaaaaaagtatttgaaaaacgtccatgatagattataataggttagtataaataatattgaagatatacaatcaacgtgcaaatacttatgcaaataattgacttaaggagacttacatggataaacttcattatttttttagaaaatctataggacaaaatcattttgctacatttggcaaattacatctaattatattaagtatagctttattagttagcatgtttattattataagaaaagaagaaagtagagtttttgaactttttgttggagttgttttattatttcaacaaatagtattatatttttggtatttcagagaaaattaccatccactacaagaaggattacctttatttcattgtagaatagctataattactttattgataggattaatctttaaaaaagattttatggctaagatgggttcttattggggaatttttggatcactatcagctatattatttccagcgcttgacccattttcatttccacatataactcaattttcatactttataggacatgtgtttttactttggggttctatttatctattatttgtaaaaaatgtaggaatgaataaatatgaatttaagaaaatagttatcataacaaatatatatcattcattaatatttattctaaatcatataataggatctaactatgcatttatgagtacatctcctataggtataggaaataatttaaatccatatttatatggtcttatagttatgatgatatttaatataattttaagtttagaatatataattatcaataaaaaacaagataaagaattggaagaatgctatgatgtggaagttttaaatacttaaattaaaaggtatgtcataaaaaatgacataccttttttaaacttcaaattcttttttattaatacatctaaataatgtacttctactatgaccaaccgcccatatacataccaatgttaaacaaaaggcaatgcctagatccataatatttatcatggaaaagcaaatacgtataagtatcatatagcaaatacccataaaaactatgtaattaacgctaaacaataaatctaccattttttcatgccatccatacaaatatagtctacgagatttaataaggtttctacccagatgtttaatttctgaaaatatagttttaatagaataaataagtattgaaattgaaagcacacttatactatatggaattttatagataaagctaataacgcctgaaaatcctagaataaataaagctaataatatttttttcaatagatactttataaacataaatgcaattatacacgctactataattaaaattatttccaaaaacttcaccccttttaaacttactgtaaaaacaattcaatatatattattttctaaaatttagtaaatactcatttttttacaatatttataataaatgatataaaaattgttaataaagaaaaaaacaaaccaagcattaaaaataaaaaaatatataaattaatcttaaaaacaatactacttgtaaatatattagacacccctagtatcttacctaaaaatgtaattacaaaaacaacaataaaacaaactaataaacccttaaaactaccttttaaatctgccaaacttaaagtcatatgagtagatatagaatatattaaaaacaacataatcaaatgatttacattaaaaatataatcaaaggaaaatatagtcttaagtaataaaaaaacatcatgaactaaaaggtcaaaaaagcctgagtaattagatgattgaagataattagtatataaacctatattcatataatttaaaaacatagtataaatattattagagaatataatgaacaatagccatatagttaaagttccaaaaatcataggagcaatacctataaagaaatttccaacctgctgataaatactattaggattataagtgcttctcacaaagcccaatataccatcttctttatattttctaggtctaaacaactcaactttaactattttatgattaaatatcaaagccataatcatatgactaacttcatgtactacagtacctataaagcctgtaaaaattataattttttctcctaatgctcgttgaattaactgattatttttattttcaattacattaaaaataaaaccaaatatcacaaaaattcctaaaatactagctaaattagcaaaactatctattaaaatattaaaaaaaatcatatatcctacctcatcttttaataatataagtagattttaccataatataaatacttttaataaaatatctttgataaaatcaagtcaacttatatataagaatcgattgttatacaatattttagagaagataagagacaattagagaaaaagaagagataatatggaagatattttttaatagaggatgaaaaagctttaagtataaaaatacaagttataattaatatagcctaggattaatacaattaatattaacactaggctaaaaatctatttaattaaaaatcacgagtaacatcatgtatccatttacctctgataaccctaaatgcaccaatgaagctttttagtatttcatcacttctaataattaaaaacactaaaactataggaagttttagaacaaaagcagctataaaacctagtggaatagctataaaccataaaaaactcatttcaagccaaaatacaaacctattatctccaccacctcgtaatattcccattaaaatattagcagataatgctctaaaaattgaaactatagaagttgctatcataatttcacaagcaatagctttagtatcatcagatatattatataaattaactgctataggtcgtaaaaagtaaattgtaagaccagctaaaattcccataaatatactaagtacacaaatagtatttgcatattccataaccttttttttatcaccttcaccaacagtatttccaataattacggaagatgcacttgataatccatgtataaataaagttgcaaattgatttacaacattatttatactatttgcagctacaacatttgtacccattctagctactataatacaaatcatagaagatcctattgcccaaaaaaattcattaagtattataggtgtagaaacttttataaaatctttaaacattactttatctaataatttaagatgtttaaatttaaactttattttactttcaaacttagacataaatattaaaataacaagaatttcactacatctagataaaacagtagcaatagcagctccagctactcctaatgcaggaaatcctaaattaccaaatattaaaacccagtttaaaaatatattaacaaccaaagccacactatatactaaaagtgatattttaatagttttaacagatctaagtattgttatggtacaacttgttagagcatagagtatataacctaaagaaattattcttagatatgatgcaccttcaacaataactaatttatcatctgtaaatatagatattagttgttttgagaaaaaaaatgatataaaagtaaaaaaaatagctaaaaggagacatattctatacattatagccataattttgtgaattgactttatatctttttttccaaagtactgagctcccataacgctagatgcactaccaacaccaaatattataactgctagtataaaaaatatattatttcctatagctgaagcagacaagctaatttcaccaagtctaccaagcataatagtatcaaccatactaatagcaaaggttattagattttgagtagctattggtagtgatatgctaaatatagatttataaaatgaactgtctcttgttaatgtcaataaaaactcagtcctttcttaaaagtctctttattagcttttcatatatgttaaaattaattcataaatggtaataatatattgttgtataataaaggtagttcatgataaattcacataaaagttgtaaaatataaatagtaaattgaggtaataataggagattgataatgaaaaataaaaatatattagtaatagaagatgacagtaatatacaagaacttatagtagaatttttaacagcagaaggatataatgtaaaatctgctaatgatggacttgaaggtatacaagcttttaaaaaagaagaatttgatttagttatattagatgtaatgatgcctaatttagatggatatggagtttgtaaaatgataagacaatcttcaaatgttccaataatatttttaactgcacttaatcaagaaagtgatcaaataaaaggttttgatttaatgtgtgacgattatataacaaaaccattttcatttacactattaatgaaaagagtagaagcaattcttagaagaactagtaatgaaaatgaatcaaatatattgaactttgaaaaattgaccctagatttagatacttatcaagttaaacttggagataaacctatagaactaactttaaaggaatttaatatattaaaaactttaatagagagttatccacaagtcgtaactagagaaaatttactagatagtgtttggggatatgattactatggtgatacaagggttgttgacgcacatataaaaaatataagaaaaaaaatagaattaccatatataaaaacagtgaaaggaatagggtatagtcttgacaaaaattagagataaatgggatgatttagcaataaatagaaaaatatttataataataacaactctatctattgggcttatagtaactatatatctaattttatctcttttacttccatcatattatgaaaggtataaaataaaatccttggacaatagacttatgattttatcagctaaatcacaaaatcataatttaattagtttaaaagaagatttatatagattatcacagagtgaaaatgtgggagtgttattaagagatgctagaggtgtggttgaatatggaaataaagaattatcatttttaccatattcaaataatataagtgattcttataaaaatcataaaaaaactatagtattatatataaaaaatagtaaaatgccatattatctagatacaagcatgcctttacaaccagtagatgaagcaactactgtaatacttgatttaatgcctataatattatgtgtagctatagttttatctactataacatcctatgtattttcaaagtggataacaaaaccacttataaatattatagaaaatgaaagaatgcaagaagctagaagaaaagaatttatagctacagtatcgcatgaacttaaaactccgataacaataataagtggacaactagaaggtatgatttataacgtaggaaaatataaagatagagatacttatctaaaaaaatcttatgaatctactcaagagttaaaaactttagtagaagaaatgatacaggtatcaaaatttgaaataatagaaaaaaagcctgaaactaaagaaatagatttattcaatttaataaatagacttataaaaagacaaatatacttgatagaagaaaaagaaataaatttagatgtgaaaatggatagtgaagtagttgtaaaagcagatgaagagcgtatagcaaaggctataaataatttaataaataattctattaaatattcaccacaaaaggctgatttaataataagattatataaaaaagaaaatccaatcttagaaatagaaaacacaggagttacaatagatgaaaagcataaagataaattatttaagcctttttacagggtggaaaagtcgagaaatagaaaaactggaggtagtggtttaggcttatatattgtaagtcaaatacttagagagcatggttttaaatataatattaaaaatggaaaagattctgttatatttaccatagaatttaacaaagattaatattatctctattaaacgaattattaaacatcccttgagcgttaagttcaaggggttttttatttattaaattttcttaaaaattagtggacaaataaacaccaactgtatatactgattatatacagttaatatagtataaacaattgatgaaaggagcaaatatgaatataataatttctaactcatcagatattcctatatatcagcaaatagttaatcaaatgagagaagctataatatctaacaatttagaacaaggtcaaagtttaccctctataagaagtttagctaaagatttaaatataagtgttataaccacaaaaagagcatatgaagaacttgaaagacaagggtttatagatatagtacctggtaagggaagttttgttgctatatttaaaaaagaattagtatatgaagaaaaggtaaaagaaatagaaactaaagttgaagaaattgttgaaatatcaagaatgataaatcttagtaaagaagaaattattgaaatttttaatgtaatttatgaggggtgataaaatgcttagggttaataatattagtaaaatttttaagaattttaaattaaaaaatataaatataaacctagaagaaggctttataatggggataattgggcctaatggttcaggaaaaactacacttataaaaatgataatgggacttattcaaagtgatagtggaagtataagtttatttggtaaaagtatagaaaaaaatcctatagatataaaaaatgatatagggtttgtatatgacagtttagatttttatgaccatttaaaagttaaagattataaaaagataaattcattattttataaaaactttgaaagtaataaatttgattattatttagataaatttaatataaataaaaattcatatataaaaactttatcaaaaggtcaaagtagtaaacttatgttgactaatgcacttagtcataatgcaaaacttttaatattagatgagccaacagcgggacttgacccaatagttagaaaagaattgctagggtatttacaagagtttatagaagaaggaaataaaagcgtaattatatcaactcataacacagaagaacttgataaaatagcagattacataacttttattaataatggggaacaagtttttagtacagataaagaaacactaagggaaaactataagattataaatggaactaaagagcaaatagataatatgaataaaaatgtagttggaaagaaacatttaaaatactacagtgaggctttagttaaaatagatgaaagcatgaaacattataacgaaataaaggatatgaacaatgacaaaataaaatcacctaatatagaagatataatgtattactatgtaaagggggagagttaatgattaatttaattaaaaaagattttatagttagtattaggggagagggtatacgtaatataaaatatttattagtatttttatttatgtacttttttttaaactcagcatcatattatataactccaatttttataagttatcttatagtagtaaaagcttatatgcgtacataaggtaatttcattatattttttacagtgttcatatcatctttagttatgcctaaaagtatattatttaggattctttttacctttgttaaagtgtatctttttgattttattgattgctgaagttcgaatatatttttacacgaaaatactgatttatatattttattctcaattccttcgtttacatcaaaataagaatttaatatatttaaatctctaataactaattctcttattgtatcaaaataatattcatcaaacatagggttaaagttattatctatacttttagatattaattcaaatgtcttaataggaacaacattagatatactatctagtgtattatattctttaagagtttttcgtattgctgtggccgaacaaatattactttctatagtttcagaattataatctgcttgaattctagttattgaatatggccttatggtacttttatgctttaataaacttttaatgtactcaatacccaatatgttattaggtgtacttaatacatcatttaatttattttcatatatatttagatttgtatgatttagcatatactctgaaagtgctttacttcttgctaaagcaaataaaatcccttcatctaaatttctttttaaaagagttttaaacttatcaggttcattaattaatatttttgaaatttcaactaataaatctatatctccatgttcactaccaaaacaaattgaatctatacaatttaatgagtttagtaaagttatagcaccatgagcaaatatctcagcactttgacaagcataaagtgttggaagttctacaaccaaatcaactccatttgaaactgccatttcagctcttttatatttatcaaataaagcaggttctcctctttgtaaaaagtttccgctcattactgctatactatgagtggaattagttatctctaaagatttttttaagtgatataaatgaccattgtggaatggattatattcgactattaatcctaatattttcatgaaaatctcctttacgctaaatttctttaaaatatatcaaaaaaacagaaggtctgttattatataagtagaattaaaatattataaaaaataaattatatttattataatattaaacaaaaatgagaacaataattcttgaattaaatgtacatataacttaaaaaattaaaaaatcttataaagtatgtacttttatcaaaaaaaatgatatagtaataatgaataaatttgtttaatgtatacaagtaatattgttcaatttttaattgtagataaaattattacataattattggtaaagatttaaggaggtatactaatgaaagtattagtattaaactgtggtagttcttcattaaaatatcaattaatagatatgtcaaatgaagaagttttatgtataggattagttgaaagaataggaatagaaggttctatattaaagcaagagaaagatggagtagaaggtaagcttgtagttgagcaaccaatggaaaaccaccaagatgctataaaattagtattagaaggtgttgttcacccagaattcggtggagttaaagatataagtgaagttgaagctgttggacacagagtagttcacggtggagagaaattcgctagctcagttaaaataaacgaagaagttatggctgcaatagaagaatgtgttgaattagcaccacttcataacccagctaacataatgggaataaaagcttgtgaagctatacttccaggagtaccaatggttgctgtatttgatactgcattccatcaaactatgcctaagaagtcttatttatatggattacctcatgaattatatactaaatatggcgtaagaagatacggattccacggaacttctcacaagtatgtatctcaaagagctgcagatatgttaggaaagaacatagaagatgttaaaataataacttgtcacttaggaaacggagcttctatagctgctgttgatggtggtaaatgtgtagatacttctatgggattcactccattagaaggtttaataatgggaactagatgtggagatatagatgctgctatattaccattcttaatggaaaaagaaggattaaatgctgctggtttatctgatttaatgaacaagcaatctggagtatacggaatgactggtatatcaagtgacttcagagatatagaaggagctgctgcaaaaggagatgaaaaagctcaagttgcattagatgcttatgttcaaagagttcaaaaatatataggagcttacgctgcagaaatgaacggagtagatgctgtagtatttactgctggtgttggtgaaaatggtatagatataagagaaactatagcttctaacatggaattcttaggaatgaaattagacaaagaagctaacaaggttagaggtaaagaaagagtaatatctactgaagattctaaaactaagatattattaataccaactaacgaagaattaatgatagcaaaagatactgttgcattagtaaaataattgtaactggatataatactattaaggtaggttaaaacctaccttaatttttgccaataaaggaattaactatcaagtaaaaatacttgacaaacatagtttatatttgtataataaatttggcaataaattgaggtgaacttaatgaaaattagtttagataaaataataagaagagaaactgataatttacacttgaatttttgcgaaaaaattgatagtattaattattgtgataatacttataaattaacttctcctgtaattttaaacgggaaaataagtaaaaccaataaaggtttgtttctagattgcaatgttgaatttactttaattgataattgtgctagatgcttaaatgaagtagaagtaaaattaagttatcctattcaaggatttttaattaaagaagaagttgacgagaatgaagtagaagaatttgatgtttatacttatataaatgatgaagtagactttattgatttaatagaacaaacattagatttcaatttacctcaaagagttctttgtagtgaagattgcaaaggtctttgttcaacttgtgggacaaacttaaataacgaagtttgttcttgtgatgaagtcgcgaacgacgaggatgtaatagatccccgttttgctaaattaaaagaaatgtttaaaaatgactaaggaggtggcgtaaatggcagtaccaaagcgtaaaacatctaaatcaaatacaaaaatgagaagagcagctaactcaaaaatggtagcaactggattcgtaagttgcccacaatgtcatgagccaaagttaccacatagagtatgtccagactgtggatattataaaggtaaagaagttgtatctaagtaatacttctaaaaaacatgtagaatactctacatgtttttttttgcttaattacggcaaaacttatgataaaatttaaatatatctaaaattataaataaaagataaataatagttgattatttataattaatattatatactactattagtagttggtactaattccaactataaaaacttggaggtaatatgaaaaagaaaagcaaagcagaaagacaacatgaacttgtcgagatgctaaaggatgatcctttttatacagatgaagaattggcaaatgtatttgatgtaagtatacaaactataagacttgatagacttgcattaaatattccagagcttagagaaagagttaagcaaatagctgaaactgaaacatctaaagttaagactttaggtataaaagagataacaggagagataattgacttatctgttggtcaattaggcatatctatgttagatattaccgaagatatgatttactccaaaactggaactcttaaagatgaatatatattttcactagcaaattctttagctatggctataatagatgcacctcaagtaataatgaggtttgcgaacataaaaacgcttaagcatatacaacaaaaagatagacttatagcaaaagcggaaatatataaaaacgttgataaaaaacattatgtaaaagttgtagttaataataaagcgcaagaacagatatttagaggaaaatttatatttgaagagttagtttaggaggagaaatttatgaaaattgtaattgatggaatgggcggagataacgcaccaaagtctaatgtagaaggtgtagttagcgctataaaagagtacggtatagatgtaataattactggagataaaaatattttagaagatgaattttcaaaatacgaatttgatagagataagttagaaatagtgcatactactgaaattatagaaaacgaagataaaccagtaaaagcaataagatctaaaaaagattcatctatggttgttgctttgaaaatggtcaaagaaaataaagctgatgcaatagtgtctgcaggtaatacaggagcattattagcaggaggactatttgtagtaggaagaataaaaggaatagacagaccttgtttatgcccagcaataccaaatgtaaaaggaggaatgactcttattgcagatggaggagcaaatgcagactgtaagccgattaatttagttgaatttgcaggtatgagtaatatatacgctaaaaaggtactaggacttcaaaatccaagagttgccctagccaatgttggaactgaagagggtaaaggaaatgatttagtaaaaaaatcatatgaagaacttaagaagttagatttaaactttatcggaaatatagaagctagagaacttataaattcatatacagatatagttgtatgtgatggatttactggaaatatcttattaaaatcagcagaaggaattgcgatgtctatactaggacttctaaaagaaacatttttagcaagtactaaaggtaaattaggagcccttcttttaaaagatgacttgagaaaattaaaaactatgatggactactcagaatatggaggagcacctcttttaggagttaatggaggagttataaaggcacatggaagttctgatgcaaaagctataaaaaatgctataaatcaagctattaagttttctaaaggaaatgtagttgaagatataaaagaatttataaagactattgaataagaagattaagataaatagaaataatccaacttggaggttaatttatgaatacaaaggctggtatattaggagttggaagttatttacctgaaaaaataatttcaaactttgaccttgaaaagataatggatacatcagatgaatggataagaactagaacaggtataaaagaaagaagagttgcagatgtaaatgaggcaacttcagaccttgcaacaaaagcagctttaaatgctataaaagatgcaaatttaactcctgaagatatagacttaataattgtagctacaataactccagatatgatatttccttctacagcatgtttagttcaagctaatataaaagcaacaaaagcagcatgctttgatttagaagcagcatgttcgggatttatatatggtatgacagtagctaaacaatttatagaaactaatacatataaacatgtcttagttataggagcagaagctttatctagaatattagattatgaagataggtctacagcaatactttttggagacggagcaggtgctgtggttatgggatctgtaaatggaggtggagtattatctactaatttaggttctgatggaaatggaaaagattatcttaatataccagctggaggttcaaaaaatccagccagtgaagaaactttaaaaaataggttgcattatgtcaagatggcaggaaatgatgtgtttaagtttgcggttagaataatgcaagatgcatcaattaagtgtgttgaaagtgcaaaccttgatatacaagatatagattaccttataccacaccaagctaatataagaataatagaagcttcagcaaaaagacttaaattaaatatggataaagtttatgttaatttagatagatatggaaatatgtcggcagcatcaattccagtagcattagatgaagcttatagagaaggtaaaataaaaaaaggcgataatatagtgttagtaggatttggaggcggtctaacttggggagcttctgtagttagatggagtatataaggaggaaacaatgaataaattatgtgagattttaaatataaagtatccaataattcaaggtggaatggcttgggtagcaactgcagagttggcagctggagtttcaaatgcaggtggattaggaatcatagctgcaggaaatgctccgaaggatattgtaaaaaaacaaataataaaatgtagagagttaacagataaaccattcggagttaacgtaatgttactttctccgtttgtagatgaaataattgatttagtaatagaagagaaaatagaagttataacaacaggagctggcaatcctgcaaaatacatggatagattaaaagaagtaaatattaaagttatacctgtagtaccaacaatagcattagcaaagagaatggaaaagtatggagcagatgctattatagttgaaggtacagaagcaggaggtcacataggagaattaacaactatggtcttaactcctcaagttgcagataacgttaacatacctgttattgcagctggaggaatagctaatggtaaaggactagcagcagcattgtgtttaggagctagtggagttcaggtaggaactagatttatatgtagtgatgaatgtatagttcatgaaaattataaaaaatttattttaaaatctaaggatagggatgcaatagtaactgggagaagtactggtcatccagtaagaacattaaaaaataagttagctaaagatatattaaatatggaaaaagaaggggctgatattttagaaatagataaaaaaggagtagggtcattaaaagctgcagctatagatggtgatttagattatgggtcttttatggcaggtcagatagcatcatatataaatgatataaaaccttgtaaacaaataattgaagatatgataaaagatgctaaatctgtaatatctaatataaatatagacttggaggtatcacatgggtaaaattgcattagtttttccagggcaaggtgctcaatatgtaggaatggcaaatgacatatacaatagtgatgatatagcgagaaaagtaattgatgaggcacaagactcaataggtatacaattaaagaaaataatgtttgaaggtagtgatgaagagttatctaaaacagaaaatactcagcctgctatagtaacacatagtatagcattatttgaaagtctaaagaagaaaatcgacttaaaatatgatgcatgcttaggactttctttaggtgaatatagtgcattagtagctgcagatgcaatggattttaaagatgctgtatccatagtaaaaaaaaggggaaagtatatgcaagaaagtgtgcctataggaaaaggaagcatggcagctatattagggttagatagagataaagtaaataaggttataaatgaaataaataacggagtaatagaagttgcaaattacaactcaccaggtcaaattgtcatatctggagaaattgatacagttaaagatagtattaatttatttaaagaaaatggagctaaaaaagcagttttattaaatgtaagtgcaccatttcactcatcaatgttaaggccagcaggatataaacttaaaaaagagctagatgatattaatttaaggaaatgtaaggtttctgtagtttcgaatgtaaatgcagattactatacagaaaattataaagagttattagttaatcaggttagctcatcggttttatgggaagattcaatagaaaaattaatagatgaaggattcgacacattcatagaaataggtccaggaaaaacattaaagggatttataaagaaaatatctagtaagaaaaagattaatgtaaacgtttacaatatagagggttcagaatctatgagtatatttatagaatcttacaaaagaggtgaaatataatgattaacttagatggtaaagtttgtttgataactggaggttcaagaggtataggtaaagctatagctaaaaaactagcattacataaagcaaatataataattaactatacatcaaatgaaaaccatgccctaaaaattaaagaagaaatagaagaatatggtgttaaatgtgtacttattaaatgtgatgtatctaaaagtagtgatgttgaaaatatgattgaaactgcaattaatgagtttggtaaaattgatatattagtaaacaatgcaggtgtaactaaagatggacttttaataagaatgaaagaggaagactttgataaagttatagatataaatttaaaaggagttttcaattgtactaaatcagtatctaagtacatgatgaaaaaaaggtatgggaagataataaacatatcatctgtggtaggaattattggaaatataggtcaagttaattattgtgcatctaaagctggggttatagggcttacaaaatcaagtgcaagagaacttgcttcaagaaatataaatgtaaatgcaatagctccaggatttatagatacagatatgactagtgttttaaatgaaaatttaaaagaacaaatgctaaaaaatattccacaaaatagatttggagaacctgaagatgtagctaatttagttttatttttagctagtgatatggcaagttatataacaggtcaggttataaatgtagatggtggaatggtaatgcaataaatattttaaaaatataaaaaaataaaaaatttaggaggatttaattatgtttgaaaaagttgtagaaataataaaggaccaattagggatagatgataaagagataactatggagacttcactaatgaaagatttagaagcagactcattagatgcagttgaaataatgatggcacttgaagatgaattttcaatagaaatcccagatacagaagcagaaaaatttgtatgtataggagatatagtaagatacatagaagctaacaaatagtggaggttacgttatgagaaagagagttgttataacaggcttaggatgtgtgactccagttggtacaggtaaagataaattttgggaaaacataaaaaatggtatttgtggcatagataaaataacaagatttgattcatcttcatttcaaactcaaatagctggagaagttaaagattttaatccagaagattatatgaataaaaaagaatcaaagagaatggatagatttactcattttgctatagcatctgcatctttggcagtgaaagatgcaaatcttgatatggatttgttaaataaagaaaaagtaggtgttataataggatctggtataggtggagttgagactatagaagaacaacacaaaatactattagaaaaagggaataaaagggttagtccattctttgttcctatgatgatatctaatatggctgcaggtcaagtatctattatgttaggagcaaaaggaccaaatactaatgtatcaacagcctgcgcatctggctcacacgctataggagatgcatttaaaatagtacaacgaggagatgcaactattatggttgcaggaggtagtgaagctggaattactccactttcatttgcaggtttttgtaacatgaaagcaatgtctaccagaaatgatagtcctgaaactgcatctagaccatttgacaaagacagagatggatttgtaatgggagaaggatcaggaatagttatattagaagaattagaacatgctttaaaaagaggcgctaaaatctatgctgaagtagttggatacggcttaacagcagatgcacaccatatgacaactccagcagaaaatggtgaaggtgcatctagagcaataaatatggcaataaaggatggaaatatacctcttagtgaagtggactatataaatgcacatggaacatctacttattataatgacaagtttgagactatggctataaaagatgtatttaaagaacattcctatgacttatgtgtatcatctacaaaatctatgacggggcacttgctaggagctgcaggagcgatagaagctattgtatgtgcaatgtctatatatgatggatatgttccacctactataaatgtagaaaatgtagatgaagaattagatttagattatgttataaataaagggagggaaaaaaatgttaggtatgctttatcaaattcattaggatttggaggacataatgcaacgctagcatttaaaaaatacgattaataaaaaaccttagctaataaaagttagctaaggttttttagttttaataaataaattaagataaatatttttataaataaattttaaacattttggcatatatatctttgggtgaaaatataattatataaacaaaggaggacaaggattatgaaaaaactttcagatgaaattttaaattcagtatcacctagtttaagagaaaagatagttaatatacaagataatgatataaatatagaagaaataaggcttagagtacaaaagccactaatagtaaattccaatagtaaagattatttttacaataaatcaattaataatttagatactagaaacttaaatccatatatagttacaaaggaagatatagaacaaacttttcaacttatgtgtaaatattcaatacattcttttatcgatgatataaaaaaagggtttataactttaaagggaggtcatagagttggaatagtaggaaaagtaattatagaagatggtaatgtaaaaaatattaagcatatatcatctttaaatataagggtttctagagaaataaagaattgttctgacaaagttttagggcatataataaaaaattttaaagaagtaaacaatactttgataatatcacctccacaatgcggtaaaacaactttacttagagatatagttagaaatttaagcaatggaaataaaggtagaggatttgaaggaataaaagtagcattaatagatgaaagaaatgagatatcgggatcttacttaggagttcctcaaatggatgtaggaataagaactgatgttattgaaacttgtcctaaagatatagggattatgatgcttttaagagcaatgtcaccaaacgtaatagttacagatgaaataggtagtgaaaaagaaataaaagctctttatacagcattaaatggaggggttagtttaataacaactgtacatggtgattctatagaggatataaaagaaagaaatgaattgagtaagttgttggataaagaactatttaaaaaagtaataattttatctgcaagaaatggacctggaactgtagaaaaagtatatgacctagaagagaagaggtggtattttgcaaattaaaatagttatgattggaatattagtagcttgtagttatttgataggtgaatacatatataaagcatatgtaaaaagacataagcaaataagtgaacttataaggattttagaagtaatgagaatggacttatcatttggattatacacattagaagaaatattttttagagtaggagaaaataaagaatttacaactagtaaattttttaaagatatgagcgaagatttaaaaaatgaaaataatatcacattagacaagatgctagaaaataatttttgttatatggaaaaagaaacgtatcttcaagaaaaagagttagatgaattaaaaaaactaatattgtcacttggaagaggagatatatattctcaagaaagaatgattgatttatctattgaaaaccttaaaaagttaacgtcagaaagcaaagaagacataaataaaaaaggagtagtgtataaaaaattatcaactataattggtctagttataggaatttttctaatttaggaggggtaatatggatataactttgatatttaaagtagcaggtattgggttgttaatatctgtacttaatatggtgcttgaaaaaacagatagaaaagattggactactttaactacgcttgcaggagtaataatagtccttacaatggttataacagaaattaatgatttatttaatgcagtaagaactatgtttcaattgtattaaggaggagattttttggatgtaatgaaattagtaggtcttgctcttatatctactatactttgtttgattataaaaaaagacagaccagaaatggcaatgtttataggtatattaacaggaataatgattttattatcagtaacgtataagttcaattttataattgaaagtataaatgaattagctgataaggcaaatatacctactatgtatatatctttaataataaagcttattgggatagcatatttaatggaatttgctattcaaatatgcaaagattgtggggaaggaaatattgcaaccaaacttgaatttggagggaaaattatagttatgacgatgtcattccctattttgatatctattatagatatgattttaaatataattccataggagaatgattacttatgaaaaaaattttggctagtataataatttgtatactaattggagttacatttgccaatatatcatttgcaaatgaaaaagaagctaaagaaagtgtagaatcatatataaatgatcagataagtaaaataaatttagaagatatacaaaaacatataaaagaagaaagtttaatagaagatgtagatataaagacttttataaaagacttaatatcgggcaaaaagacaatgttagatttaattgataaagaaggaatcaagttagttttatttgatgaacttcaatcaagtttaaaagtagcttcaataatatttgttttagcacttttatcatctatattaaaaagtttagacaattcattttcatcaggatcaataagtcaaatcacaacatatatagtgtttattgtcatggtaactttaatgctaataggatttaaagatgttttaaatatatgtaatacaactattaatagtatgataaatttaatgcagattgtaatgcccatactaattacattcttagtagttatgggatttccaatgacatctacagttatgactcctatatttatgggaggtgtaacttttataaatattatatttaaaaattttctttttatatctataactataggattttcaattttagttataaataacatatcaaaaagtataaaattaaaaaaactatcatcttttataaagcaaataaatttaataactataggtgcagtatttactatataccttgctcttgtttctatgcaaggtatgtatgtgaaaagtttggatggatttgcagtaaaaagtactaaatttgcgataggaaactttatacctgttgtagggggatttgtatcagattcatttgatataattttatcttcatctcaattgataaaaaatttatttggaggcgtagggttaattatattagtaggaatatgcctaatacctataataaagatagtttctataattttagtttataaaacatcggctatggttgtagagccagttggagaagagagtatatcaaattttttaaatgaagtttctaatcttatggggataatgttagcatgtataatcgctataaccataatgtttttcgttacaattgcaatagtaatatctattagtgttgtagctcagtaaaaggagggaaaaatgttagagagtgttaaagcttggatagtaagtattttaatagctgcatttatagttaatatagttaatatggttttgccttcttctaaaattaaatcatacataaatttagttttaaattttatattcatatttatagttataagtcctgtaatagactttttttcagaaaatataagtcttgaagataggttattaaaaacatatacaaaatataatcaagcttatatagagagtatgaataatttatcaaaagacacaggggataaaagcataaaatcaggatatgaagatggactaaagagtgtattaaagcttaaactagagggatctggatatgaattagaagacatagagtttgatggatcggatataagcaaaataaaagtaaaagataatagtaataaaaatgaaaaaaaagacatacaatttaacaagagtgaaaaggacaagcaagtatttaaagaaaattcagattataatttagacgataaagatgaaaaaataaaaaaagatttagttgagatacttgatatatcaattgaaagcatagaaattgattaataggagttgagtaaagatgtttaagaattttaaagaagaagataagaaaaagatatatagtttagctgctttatcatttgtatgtattatagggttagttattttttctaaggattttgaagtagaaagtaataaaaataaattaactgaaagtgaaaatacaaaaattaaggaaactcaaactaaggaagaggatgatttagaaagtaagctagaaaatatattatctcaaatagaaggagctggagaagttaaagcaatgataacatttaaggcaggggaacaaatagaaccagcatttaactcaaattctacaaaggaagaaacgacagaaaaagattctcaaggtggagaaagaactgttactacatcaagtgaaaataaaaccatgataacatcaagtgaaaataaaccagtagtactaaaaacatcagaaccagagataaagggagttttagtagtttcaagtggagcaaatgatccaattgtaaaagaaaaattatattctgcagtacaaacagcacttcaaatttcaggtcatcaggtacaaatttactcaaaataaaaaaaataatcataatagtaaagctcgtacatataaatattacaagaaaataaattttaattagggggagtacaaatgaagtttaataagaatgtatttagaagcagagggtttgttgtaatgacgttaacattaatgttagtagtagttggaacagtaaactataatttaagtaagaaatcggttttacaggcatctaaagagatggaaatgtatgaaaatcaacaacttgcaaaaaataatgataaaaaagaagctaaagtagtagatagtaaagaaactgtagttaatgaaaaagcaaaagaaactagtaataaaataaaaactcaaataacttctgataaaaatatgaaaaaggcatcatatgcagttgatatgaaaatgaatagagaaaaacaaagaaatgaattaacagaagatttaaatgaaataataaataatccttctacagcagaagaaacaagaaaacaagcatcaaatatgaaattacaacttgttaaggatcaagagatggaacttaagatagaagatttattaggagctaaaggattttcaaattcattagtttacataagtaatgatactgttaatgtagttgttaatgaagagaaattaaataagcaagatgcaactaaaatatttgatttagtagtaaacgaatcaaatgtaaagcatgaaaatattaaacttatgaataataaattaaaataagtataaaagcctcagctatactggggcgttttttgttgcaaagtaaattactatttggtattattatataataaaatagttaatatagggatgtgatatatgatggaaaataataactttggtcaagttaagatatcaaatgatgtcatcgctactatagcaggacttgcagctatagaagtagaaggagtagaaactacatcgactttcacagataaattactaaagaacaatggagttaagatacaaatagaggaagatgaagttatcttagatgtaatgataataattgattatggaatatctatacctgatatagcttttaaagtacaagaaaatgtaaaaaacacagttgaaacaatgactggattaaaagtttctcaagttaatatacatgttcaaggaatcaactttaaaaaagataaagttgaaaagacagaaacaaagtaagcatctactataagttaatatgaccctctgaaaatcagagggtttttttatgactaaatatgtatataataaattcaaaggaggaagtagcaaatgaaaaaagcaaagatgataacaacgagagagtatatgatgaaatttatataccaaatagacataaataaagaggatttagaagatataaactctaaattagatgattttttaaataataactttgaatatataaagaacagatatgaggaattaaaattacaattttcagatgaagctaatgttgaattaagtgaaactaagttagatgaaataatagatataaattatgctaatgaagtagctcaaaatataaaagaacataaagatcatatagatgaattaataaacaaatatgctaaaaattggactataaatagaatggctaaagtagatttagctatacttagacttgcagtatgtgaaatactatacgtttcaaatgtacctactaaagtttctataaacgaagcaatagagatatctaaactttactgtgatgataaatctcctaaatttataaatggtatattaggaagtatagcaagtgaatcttcacaaaaataaaaatataataataggaatagatactagctgctatacgacttctatagcagctatatctttagataagaatatagtatttaataaaaagataatgctaaaggtaggtaaagaatgtaagggtcttagacaaagtgaaatggtatttcaacatgtgaataatttaggtagtttaagtgagaaaatagaaaaattaatgactcaatataatgtagttgctatatgtgcatcagaaaaaccacgaccagttaaagattcatatatgcctgcatttacagttggatataactttgcaaagctatttagtagtatgaataatataagcctatacaaaacaacacatcaagaaaatcatatatatgctagtttacatactaatgaattaaagaataataaatttatatctgttcatatgtcaggaggaacaaccgaaatactattagttgaaaatgttaaaaatgatttaaaaatagaaatagtaggaggtagtaaagatataagttttggccagcttattgatagacttggtgttgagttaggatatgattttccatgtggaaaaaatatagatgaaaatgctttagattgtaaagaaaatataaaagtagggcttaaaacatctgtgaaagatggatatatgaatttatctggaattgaaaatcaggtaaataaatatgcaaaagagtatgatgaaatctatttatcaaagttattaatggactcaatagttagaagtttatataaatcacttaaatatatatgcaacaaatataatataaatgaagtagtatttgcaggtggtgtagcatcgagtaaatatataagaaagaatctaaatgaaaagttatataaagataaaataaaatgttattttacagaaagtgagtatagtactgataatgcagttgggtgtgcaaagataggattaaataaatttataggagaatagagatgaaattaagagctttagatgtcagtgaagttaattcatatataaaaagaatcttaagtaatgatgctattttatttaacctaaaagtaaaaggtgaaatttcaaactttaaaattcatagtagtaagaatgtatatttaacgctaaaagatagttcatctaaaataaattgtgtaatatttaaaaataattacgatgaaagtctaaaattagaagatggagttaaagtaattgctaatggatatatatccgtttatgaaagagatgggtcatatcaattatatatagattcgatagaaattgatggattaggaaatttatatttagagtttaataagttaaaagaaaaattaagcaaagaaggtttatttgatattaaatataaaaaacctataccaatgattcctaaaaatataggagtagttacatctgatactggagctgtaataaaagacataataaatgtaataaaacgtagatatcctaaagttaatataaaattgtatcctgtatctgttcaaggaaaaaaatcatcaatagagatatgtgaaggaattaaattttttaataatgctaataatgtagatacaataataattggcagaggcggaggttctatagaagaattgtggtcttttaatgaagaaatagtagctagggaaattttcaactctgatatacctataatttcagcagttgggcatgaaactgactttacgatagcagattttgttgcagacatgagagctccaacaccatctgctgctgcagaaatagctactccaaaattagatgaattgttatataaactagaaaatataaaaaatagaatggataattcaattgtaaaccaatcaaaattggataaaaataaattagatagtacttttgataagataaataccattgttggttcttatataataagagataaaattatacaaatagatataatatatgataaaataactaataagattaaagatacaatagatttaagaaaaaaagatttaaatactagtgctacggtacttaatagtttaagcccattatcaactttggatagaggatatagtattttacaaaaaaataaaaagttagtaaatagtgtagatgaattagataaaagagatttgatagaaattactttaagagacggaaaagtagactgtattgtagaaaaaataaaatttaaagaggtataaaaatgaatttatcttatgaagaggcatataaaaatttagaagatattttgcttaagttagaatcaggaaatactagtttagatgaatcgcttagcttatatgaagagggaataaagctttatagacattgtaataaattgttagaggaagctactctaaaaataaataaattcgataaagatggtaaggagataccttttagcatagaggaggaatagctatgaattttaaggatgagttaaaaagtagagttaataatgtagaaatattattaaatgaatatatgccaaaggaagaaggatatcaaaaaactatatttgaagctatgaattatagtttaagtgcaggtggaaaaagattaagaccaattcttacattagaagcttgtaaattagttgggggaaatgaaaaagatgcaataccatttgcggcagcgatagaaatgatacatacatattcacttatacatgatgatttaccagcacttgataatgatgatttaagaagaggaagaaagacaaatcacaaagtatatggggaagcaatggctatacttgcaggagatgggcttttaaattatgcttatgaaataatgcttaaagaatctataagaaaagatgattcaaataaatatttaaaagcgataaatgaaattgccaaagcatcaggcatatatggaatgataggtggacaagttgttgatattgaaagtgaaggaaagtcaatatctatggataaattagattttatacatatgaataagacagcagcaataataattggatgtatgagagctggtgctataataggtggggctagtgaaattcaattagagaatataactaaatatgcaaaaaacataggattatcattccaaatagtagatgatatattagacgtagttggagatgaagctaaacttggcaaaaaagtgggtagtgatatagataatgaaaaatctacatatccatcattaataggacttgataaatctaaagaaattgcaaaaaatttaatagaagaagctaagttaagtattagtaatattgataaagatagtgaatttttaaattcattagcagattatatagtggatagagagtattaaggaggaaaaatgagctttatttcagaaatttttagcaacaaagtattggggataagtatgtttgcttgttttttagcacaattttttaaagtgtttactggagaggaaaaaagaatacaaatatctaggatttttacttcaggaggcatgccaagttctcatagttcttttgtaacttcgctatctactttagttggtatggattttgggtttgattcaattgaatttgcagtagttgctgtattttctatgataataatgtatgatgcatctggagttagacgtgcagttggaaaacaagcagttatattaaataaaatagtagatgacttacatcataaaaaacatatagaacataaaaggttaaaggagttagtaggtcatactcccatagaagttttctttggagctattttaggaattattacagccttaatatttagttaatatttgttaaggtaaaactaattagataaaggtgagaaacaatgtataattatttagataatgtaaattctcctaaagatataaaaaatatgaacactaaagagttagatttattagctaaagatatcagaaaatttttagttagatcagtttcaaacacaggaggacatttagcatcaaacttaggtgttgtagaacttacactagctttacataaagtatttgatagtcctaaggacaaatttatatgggatgtagggcatcaagcttatgttcacaaaatactaactggaagaaaagatcaatttaatacattaagacaatttaatgggttaagtggatttccaaaggagagtgaaagtgaacatgatacatttgatacaggtcacagtagtacatctatttctgtaggaactgggattgcttgtgctagagatataaaaggagaagatttctccgttgtatctataattggagatggatctataacaggaggtatggctttagaagcgctcaatcatttaggatatataaataccaatatgatagttattcttaatgataatgaaatgtctatagatgaaaatgttggaggaatgtctaaacatttatcttcaataatcaaaaattctaccgtaaataaggttaaagacgaggtcgaaaaaatattgaatgtggcacctggaggaaatataatatctaaaacagcaagtaaagtaaaagatagtataaaaggtaaattctctttacaagaatgtgctctttttgattccttaggagtaaattatttaggaccaattgatggacataatatagacgaaataataaaagctttagaaaaagctaaaatgcaggatggacctatattattacatgttataactaaaaaaggtaaaggctataagtttgcagaggaaaaaccacataaatatcatggtgtttctaagtttgatataaaaacaggactaaaaccatcatcaacaaaaagcatatcagctgttgtaggtgataaactagttgatttagcaactaaagatgataaggtagtagctataactgctgcaatgccatcaggaacaggtcttaataaatttagtgaagtatatcctaatagatattatgatgttggtatagcagaacaacatgctgtaacttttagttgtggcttagccaaagctggaatgaaaccatattttgctgtatattcatcatttttacaaagagcctatgaccaaataattcatgatatggctataactaaaaaagatgttaaattacttatagatagagcaggacttgtaggtaatgatggagaaactcatcatggaatatttgatttaagttatttaaatagtattcctaacatggttgttatggctcctaaagatactaaagaacttgaattaatgatggatttatctttagatataaaagggcctatggcaattagatatccaagaggaaatagctactttgttgatagaggaagttataaacctataaaacttggcgaatatgagatattaaatcaagggaaggatgtacttatattagctataggaaatatggtcaaacaagctatagatgctatagatatattaaatgaaaaaaatataaatccaacacttgtaaatgcaagatttttaaaaccaatagatgaaaatttaataagtgaattattaaaaaatcataagtatgttgtaacagtagaagataatgttattacaggtggatttggaagtagaataaataaatttttaatagataataaatttgacaataatattgttaatatgggtatagatgatgagtttattcatcatggagatgttaatactttatataaacaatgtaaaatctcatctgaatgtattgctgaaaaagttgagagtttgttaagatagaaaggtaacttatatgaaaaaaagaatagacatattacttgtagagcaaggatttttcgaaagcagagaaagagctaaaaaagctatcatggctggattagtttttgtagataatcaaagatgtgataaggctgggtctgaatttaaggaagagtgtaatatagaggttaagggtaatcctataccttatgttagtagaggtggattaaagttagaaaaagctatgaaaaactttgatataactttagaaaataaagtgtgcttagatataggagcatcaacaggaggatttactgattgtatgcttcaaaacggagcgaaaaaagtattttcaatagatgttggatatgggcaactagcgtggaaacttagacaagatgaaagagttgtctgcatggaaagaactaatataagacacgtaactatagaagatactaaagagtttggacaatttgcatctatagatgtatcatttatatctcttaaattagttttaccaaaagcaaaagagctattagaacctaatggacaaattgtagctttaataaagcctcaatttgaagcaggaagagaaaaggtaggaaaaaaaggtgttgttagagaaaagtctacgcatatagaagttatagaaaaaatatctaattttgcagtagaatcaggatttgaaatattaggattagattactcacctataaaaggtccagaaggtaatattgaatatctaatacatttaaaaaattccaatgaaggatatgaatacaacaaagaagaatttaagctgactatagataaggttgtagataattctcataatttaatgtaataaaagagggggatttagattgatccttgaattatatatgaaaaattgtgccttagtagatgaattaaggttacacatagataaaaatttaaacatactaacaggagaaacaggttcaggaaaatctataattataggtgccctgggcctatgtttaggtggaaaatacgataggtcttttttaagaaaaggaacagaaaaagggttagtagaagcagtatttgatataaataacaataagttaaaagaaaagttattagaaaatggaatagatatagaagaagataaccaaataataataagtagagaaatatttgatgatggaaagagtgtatctagaataaatggaagaagtgtaaaagtatcttttttaagagagatatctacatatttaatagatatacatggacagcatcaaaatcaagttttattcgataaagatacacatatagattttttagatttatttggagaagaaaatttatttgaatataaaaatgaatatgaaagcatatttaatgaatataatgagattaaaaaagctttaaatttatgaatcattatctatacttttatataacaatccatttttattcatactttttttagcaacaactttaccatctttatctacgctatatactatgtttttatcttgatccaatatatctataaatctattactatctaactttaaattcttttggctaaatgctacatcaaaaatttcttttccactaccatttatacattttaatgaatttccatcataataaactaagtttttgttatactctacataattgctatttttatctatattaaccttttttatattttctaattctacagactttttatttaggatattactcaagttgccaattttgttgggatttattaaaactataagtaacaaaattgctactagtatccatttttttttcattggctttcctccatatcatttttaatacttaatattttctatataaaaataaaagactccttttaaaaagagtcattttaaataatttctaaatttttatataaacaaacacctctttgataatactcaagttctttttctttagatatatctgagtatagctgccctaattctatatacaaatctgcaagagtcttcctctcatttaaatcttttattatacttatacattttaataaatactctattgccaatttattattgttttcatttttatatatttgagaataaaacttaagtgcttgatattcaaaatatttatttttattttttattgcacttgccaatgccaatttagaatattttctggcttcatcataattttctaactttatgtatgattgtattatttttattattatatctatagtacattcatcttcatcatatttttttatatcatatgctctttttgaataatctaatgcgctttcattgttacctatattttcatatacttcacaaactcttaagtatacgtttgctaattcggttttattatcttcttcatctaataaatctaatgcaatcttaaattgttgttttgcttcttcatattttcctatccccattagcttattagctttagataccattaattcagcttcttcttttgagttaactataatatctaaagttttaattttatctatatattctaatgcttcatcatctttatttaactgtgtgtaacaaaatgacatattactatataaatctttttttacgctcatatcatttatattattttcttctagtatatcttcagcaaatttaaagttacttagagctcctttatggaatttttcttctatgtatatttttcctatgtttatatagcatttagctatattttctttatcattattttgtataaagaaatataatgatttttcaaaattaattatagctgcattataatccttttgttttaaatttatagtagctaacaataaattgcatttaccgtaattttctataagttggtattctgtacatattgacattactttatttatttcacttttagctttttccaactctttgcattttatataaatttcgctttggattattaagttatctgttagtttcttagcttgcatttctttagtttctaataaataatctacactcacttcaagacgatttgctaaatattctaataattcatagctagtatgagacttatctctttctatatgacttatttgtgctgcagttattctttctccagctaattcttttaatgttaaatttttttcttttcttaatttcttgattttttctcccaagcttagaatttccatacctgtcccccctcagaaaacattttcttataatgaaattataacttatatttattataaatacactaatttatttacttaatctgcaatatatttttatatttttacaagttatcatagtttttttgcaaatttttatgagtttttgataaaaaaagagattcacttatagttattaactataagcaaatctcttttattttctacatattaatttctttttctatctcttttaaagcttctacagctttatctatgtcatcttttgtattaaagtatccaaggctaaatcttacagttccttgtctaagtgtacctagtgtcttatgagcaagcggagaacaatgtattcccgatcttgtagcaatctcatacatatcatctaatataaatgttatttctcctgaatctatatctcctatatttatggaaattactgctgctctttttttactatctaaaggtccatatatttttatattaggaacttcagttaacttagttaacatatattcacataattcttcttcatgttttctaattttgtctatacctgtttctagaataaacttaactcctgcatttaaacctgctatacctggtgtattatgagttccagattcatatctatctggcatcatattaggttggaataaatcttccgaattacttcctgttccaccttctttaagtatatttacttctaatccatctctaatgtataacatacctgttccttgtggccctaataaacatttatgtcctggtgctgctatcatgtcaacattaattttttgtatatcaatatcatatacacctaatgtctgtgatgcatcaactaaatataatatattattttccttagctatgtttccaacagattctatatctactattgtcccacatacatttgatgcatgagtagtaacaattagctttgtattaggctttattgctttttttatatcattagggtctaaatgaccatatctatcacacttaactattgtattttctacaccatttttctctaatgcctttataggtcttattactgagttatgttcaatactcgttgttataatatgatcccctgatttaacaactccttttatagcaagatttaaagagtctgttgcattatgagtaaatactatactcataggatttgatacatttaaaagcttagctatattttctctgcattcatatatttctcttcctgctctcatagctaacttatgtcctgctcttcctggatttgctccatagttttccatacaatctaaaactgcttcatatacttgtcttggttttggaaatgttgttgctgcattatctaagtaaatcatattaagtcccctctcttatgcttcttgtccttctaataataatgatactatactatctaggtcttcgtcattataatactctatttctatctttccttttttcttcccttttgatatatttactttcgttccaaatatattagttaatctttcttctacatctactatataaatatctttttgttttatctttttctcagtaactatgttttcattttctaagatttttttagctaatttttcagtttctcttacagataattcttcttccattattctattagctatttgtaattgtatattatgatctggtattctaagtaatgctttaccatgtcctggtgtaattctattatcttcaaccattgccattacttttttacttaaatttaaaagtcttaatgtatttgttatgtgcggtctacttttgcctacagcttcagatatttcttcttgagtaacattataatggtctattaaacttttataagctaaagcttcttctatagcatttaaatcttctctttgtaagttttctattaatgcaatttccattaaatctttcataggtatatcttttatgactgctggcatttcttttaagttagcttttttagatgctctgtatcttctttctccagctattatcatatactttccaaaatcatctggctttacaactattggttgaagtactccataatttttaatagaacttgataaaacttctatcttttctccatcaaaaacctttcttggttgatctggatttgcataaattttatttatatctatattaacaatatcttttgaatctagctcttcttttatattaggaattaatgctcccaggccttttcctaatctatttgaacgtcttgtcgttttttccattctatatcacatcctcttctaaatctataaattcttctgctaattctaagtatgctattgcccctttacatctagcatcataataaatggctggcttaccatgacttggagcttcagcaagtcttacatttctaggtattaaagtagtgtatacacttcctttaaaatattttttaacttcttccactacttgaatagacaggtttgcccttccatcaaacatacttaaaactacaccttgtatttctaaattaggatttagacttctttttataagcgatatagtttccattagctgacttactccttctaatgcataatactcacattgtataggtattaaaacactatctacggcagttaaacagtttatagttagcattcctaaagatggtgggcaatctataaatatgtaatcataattatctcttaccttatctattgccttttttaatatatattctctttcttctatacctgtaaactctatttctgctccagctaattctgttgctgatgcaactatatctatattttcaaattcagttttaattattgcttcttcaatactatcattatttattaatacttcataaatcgtgttttcaacttcatttttttctactccatatccactagtagaatttccttgtgggtctaaatctaatactaaaactctttttcccattttagctacactagcacttaaattaacatttgtagttgtttttccaactccacctttttgattaaaaactgctattacctttcccataagtcttaccccctttaaccttttaaaaaaagattactgctaagcagtaatcttttattttttaggaatctttacaacaacctcaatatggtcacctttatcaacttctttatacttagcttctaaccctgtattagttatagcctcataagcttgttttatagtgtttaggtaaatcctcattcccattattcctttgacagtttgctttttatcttcactacctttaggttgtttaagatcttctagtatatctgctattagcttttctgttttcttaacatttaagtctgattttattaccttatctaaaacttctctcattatttcttcatctggtaactttaataaagctctagcatgtctttctgttaagctattttctactaactttatttttatatctgttggtaatcttagtattctaattttattagctattgtagattgatttttccctagtttttgtgcaagttgttgttgcgtgaagcaatgttcctttattaaattttcatatcccatagcttcttctataaaatttaaatcttctctttgtaagttctctaatagtgctaatacagctgaagattcatcagacatattatttattatagcaggaatagtttctagtccagccaacttagatgctctaagtcttctttctcctgctactagttcatattcatcgttacttttactcctaacagttataggctgtaaaataccatatacctttatagattcacttaattcttctaatgccgattgtgaaaatactcttcttggttggtatggatttggaactatattatttataggtatctccataactcttttatcttccataacatccctctctcatccaaaactaaatatatttaaaacacgaaattacctcagttacttatgtgtataatatttctgcatttacttacatattccttctaaaatattttttttactatatattttaaaatatttctttggaaataatgcatttctattctactttattgggctttttactggttttccagcttttcttggatattttgctggcgtactatttacttttttgaaaacaactatgttatgatttaaatctgtatcaggaagtttaacatctattttttctacaaattctaatcctagtacttccatagctttcttagattcttctaattctgtatctgcatttggaccttttaaacatacaaaatatccacctacttttataaaaggcacacaaaattccattaaaataggtaatccagcaactgctctagctgtagctatgtcatattgctctctataattttcatccttaccaaagtcttctgctcttccatgtattaattctacattatcaacttttatatttttacatacttcatctaaaaagtttattcttttatttaaagagtctaaaagtgtaactttagtattttctaagcaaattcttagtggtaaccctggaaatcctgctccagtaccaacatcaattatagacattccatcttttatatatccatttttaactgctgcaacagagtctaagaagtgctttatatacacttctttttcatcctctattccagttaaattcatcttttggttccaatcaactaatatttctctatatattctaaacttttctatagtatcatctttgcagctaattcctaattcctctataccactttttagtatttcagcattattcatttctttcacctctacctcttctttgttgttcaagatagataagtaaaactgatatatcagctggtgataccccagatatacgagatgcttgtcctattgatataggttttattgcatctagtttttgtctagcctctattcttaatccatctatagatgagtaatttaagtcttcacttaactttttattttctagttttttaaactgatctatttgctttaattgtttctctatataaccttcatacttagtcataattacacattgctcttttatagcgtatggaacatcttctccagcacctttacctgcagcttctatcatttcataatcaacctcaggtctttttaagaattcatataaagagtatccaacttttattggagaagctcctttttcttctagtaaatgatttatatctttaggagtaattctttcagtttttaatctctcaagttctttttctattaattcttttttctctaggtatttattatatctatcctcacttacaagacctatatcatatcctctttgagtaagtctcatatctgaattatcttgtcttaaatataatctatattcacatctagatgtcatcattctatatggttcattagttccttttgtaactaagtcatctaataaaactcctatatatgcttcagatctatctaatacaaatggttctttgccttgtatttttaatgctgcatttattcctgcaattaacccttgtgatgcagcttcttcatacccagaagttccgttaaattgtcctgcactaaataagttttccacaccttttatttctagagttatttttaattgtgttggatctatacaatcatactctatagcataagctggtctcatgatttttgcattttcaagaccttttacactcttatacatttgaatttgtacttcataaggtaaacttgttgatataccttgaatatacatttctttagtactttcaccttctggttcaataaatatttgatgagaatctttatcactgaatcttactatcttatcctcaatagacggacaatatctagctcctgtactatctatttgtcctgcatacataggtgatctacctaagttttcttttattatttcatgagtatttatgtttgttcttgttaaataacatggttcttgttttctagatagttcatcatttaaaaatgagaacggagtcacacgtttatctccttcttgaatttccataacagagaaatctatactatctctgtgtattctagcaggagttcctgttttaaaccttctcattcttaagcctaaatcaacaagtttatcagttaaatatttactgtatccaagtgcattaggcccttcattaaatgaaacttctcccatatatattttagagtttaggtatactcctgttgctaatattacagctttagcatgatatatacatcctaattttgttataacacccttaacaacatttccctcacttaatatatctacaacttcatccatcgctatatctaaatttggctcatcttctaaagtttttttcatttcttcatgatatctacctttatctgcttgagctctaagagaatgtacagcaggtccttttgctgtatttaacattctactttgtataaatgttttgtctatatttatacccatttgtccacctagggcatctatttccttaactaattgacctttaccagttcctcctatagaaggattgcatggtaatagtgctatagaatctaaagaaagtgttataattaatgttttatgtcccattcttgctgtagctaatgcagcttcacatcctgcatgtcctgctccaactactattacgtcataatttcctgcatcaaaatttaacatatgttctcctttcatgataaacactaatgtttcacgaaaaacattatatgattattttcctatacagaagttactaaatattgtatctaataaatcctctgttaccgtatctccatttatatatcctagataatcccatatatttttaaaatccacttcaataaaatctagtggcatatatgattcaatagccattatagcatcagctatagattgctttgctttataaagtgcatctttatgtctagagtttgttactactaaatctgatgaatttttaattgatccagcaaataccatatcctctattttgtcatgtattttttctataccctcatgttgtaatgctgatatagttataatattttcctcgtctatatattcttttactttttctatatctataacttgatctagatcagttttatttaataaaactatagttttattaggttgaacagcttctaaaatttctatatcttctgattctagttttcttgaagagtctaaaactactattgataaatctgctgaattaaagaattctcttgatttttcaacaccaattttttcaacaacatcttctgtttctcttattccagctgtatcaactatttttaaaggtataccttttatatttacaaattcttctattacatctctagttgtacctggtatatctgttacgatagctctattttctcctaatacagcatttagtaatgatgatttaccaacattcggcttaccaactattacagtttttaaaccatctctaagaattttaccactttcagcagtatcgtataatctatttatttctttttgtaattctagtgatttttcttttaacgtattgtaagttatatgctcaacatcctcatctggaaaatctatagaaacagttatgtgagctaacatctctgttatattatgtcttaaatccttgatttttttagataaagacccttctaattgtgattgagctactgtatgtgccatatctgttttggcatttataacatcaattattgcttcagcttgagctaaatctattcttccatttaagaatgctctcttagtaaactcaccttgttctgctaatctaacatctttagatagaactaattccaatatttttttaacagaaataaatccaccgtgacagtttatttctattacatcctcagctgtatatgagtttgggcctttcatataagctactaaaacttcatctattattttttctccatctaatatatgcccgtatattaaagttcttttattataatcttctattttttttcctgacatcgacttaaatatgcaatttgctacttgaagtgacttttctccacttattcttattattccgattccaccttcaccaggagctgttgctattgcagctatagtatcgtctataaacaaacctatcacctctttatcctatattttattcataaaccttaaggtattattttatcattttaaagtttattttgtaataatacataactaaaattttatataaactccacttaatataataccatgtattctaatcattcttgtatattttaaattatttcctcaatctaactattatatataatatttttcaaaaataaaaccccctatatattaggaggtttgtttttattattgctttttatactctattacaagccttctatatggatctacaccttcactataagtttttacaaacttatcattttgaagtgttgagtgaattattcttctctcatatggattcatataatctagcttcttagtttttctagttttagctacttctctagctaccttatttgcatatcttattaaagaatcttctctctttgatctatagttttctatatcaacaagaattttacaatgtgaatctttatttgctttatttaatgctagtcctgctaaaaattgtatagaatctagagtttctcctcttcttccaattaagcaagctgcatcttttcctgttatgttaacttttataacgtttttctcttgtctaacatctacatctgcatctatatttaggttattcattatatttgatataaaacctttagctacatcgatatctgttaaatcttgttttgtttcaatcttaatatcagtatttatttctactttattaatatctaattcttttgtaacttcttctttttgcttaacagttattttatatataccatctttacttcctattaatcctaggaatcctttagttggttctttaataacttctacttcaatgtcttctctacttacgctaaactgtcctaaagcttttgatattgcatcatcaatatttttactttttatttctaggctttgtttcatctactacaccctccccagaattagcaagcttagcttttaatggattcattattaagtagtattgagctaactggaataaattacttacagtccagtatagtgcaagaccagctgggaaacttattccccaccagaacatcataaatgacataaagtatgtcataaacttcatagatccttgttgttgatcacttggcatagttaacttttgagttataaatgttgttgcaccagctaaaatagctattattaaagtcttatctggtgatgataaagaattcatccataaaaatcctgtatctgcagctttttgtgcagcaaggcttgtgaaaactccatattttactggatttcttaatacattataaagacctattaatataggaaattgtattaataatggtaaacatcctgccattggatttattttagcttcttgatatactttcattatctcttgattttgtttttctggtttactcttatacttttcttgtatttcttttatctttggctgtatatcttgcatcgccttcatagattttgtttgctttattgttagtggtaataatagtatttttacaaacacagtaaataatactattgctaaaccatagttagtggcaaattctagtataaatttaagaacttgtcctaataagttactaattaaattcaattttagtacctcccaaagtgtctttttcacttaaatttattttagaggatcatatcctccaggatggaaagggtgacactttaatatccttcttatagctaaataagacccttttagtgccccatatttttttaaagcttctattgcatactgagagcaagtaggataaaacctacacgtaggtccttttaaaggagatatgtatttttgataaaaccttactatatatatacaaatttttgttgcataaccatttatattctttagtaagttatataattgattcaatttaatcccccatatcttctaaccctcattattaagcttagccttttttactaaactcttaaccgacttctctatatcactatactcagcatctttactagatattctagctataaatactagatcatatccattttttatattttgatcacaatttaacctaaaactttctcgtattcttctttttactttatttctaatattggctttacctacctttttagaaacagaaaatcctactctattaaagtctgatttattatccaatatatacattactaagtatttatttgcaaaagatttgccgtgtttgtatacttttctaaaatcagagtctttttttatacctttagtattcttgaaatccatactaaatcctcctaaaacacagctttaaatttataattttttacacaaaaaggctacttttcagcagccttttttaaaaaattaatgagttaatctctttcttcctttagctcttcttctttttagaacattttttccattagaagttttcattctctttctaaatccatgctctttctttctttgtcttttctttggctgataagttcttttcattttttgcaccgcctttcaagattgtttttccgtttataaaaataataactttaccctcaaagtaagcataacacgtacaattataaatccttttaagctgattgtcaacgtatttttgacgtagttttagcaacctttttgaagatttcgactaagttgattttgttgacttttttatcaacaaacggttaattttgtggataaattgtatataaatcattgaagtttggcatatattctgatattataaatatacttgttgataatgttcataaaaattattaacatattaaatttattcacaagttgtggataaaaatgtgcataactttcaatgtaaaagataatacttttgttataacctatatttttattattattgatattatttataactttatatacatattgtttatattttctataaattattaggtcttttttattttttacagattatccacatatttatccatattttttttgcataaaaatgaatttttaaataaattataaattttgttaataactttgtggaaaatgttaattactttgttcggaggttttaaattatggatatagtttctttatgggataagacattacaacttataaaaggtgaattatcacctcctagttttaatgcctttttcaaacaaattaagccattacaaatacaatcaaatactttaatactattagttccaaatgacttcacaaaaggaatattagaagatagatatctaaacttaatagaaagttctgtaaatcagctttctttaaaaaaatataatattcaatttgtcctaagtgaaaatgaagttaaaggtttagataaagaccacaatatagaagaagataataaatctaaaaagaactatcctaatctaaatcctaaatatacttttgacacatttgttataggaaatagtaaccgttttgcacatgctgcttgcgtagctgtagcagaagctccagccagagcttataatccattatttttatatggtggagttggacttggaaaaacacatcttatgcatgcaatagggcatcatataatggagcaaaaaaaagacccaaaagtagtttatgtatcatctgaaaagtttacaaatgaacttataaactctattaaagatgatagaaatgaagaatttagaaataaatatagaaatgtagacgttcttttaatagatgacattcaatttatagcaggaaaagaaagaactcaagaagagtttttccatacattcaattcattacatgaagctaataagcaaataattatttctagcgatagacctcctaaagaaatacctactttagaagatagacttcgctcaagatttgagatgggacttataactgatattcaagctcctgattttgaaactagaatggctatacttagaaaaaaagctcaaatggaaaatatagatgttcctaatgaagttacagtttacatagcaaaaaatataaaatcaaatataagagaactagaaggtgctcttacacgagttgttgcatatagctcacttactaatagaactatatcttttgaattagcatctgaggctctaaaagatataataacaacttctaaacatgaagaaataactgtaaatagaataaaagaaaaagtatcttctgttttctcagttaaaatggaagactttaattctaaaaaaagaacaagatcaatttcttatccaagacaagtagcaatgtatttatctcgtgaacttacggacttatctttacctaaaataggagaagaatttggtggaagagatcatacaactgttattcatgcccatgataagataactaaagatatagaaaacaatgaagattttaaagaaaaggtaaataaaattatattagatttaaaagggtaaattataaacaatacatatgtggatatcatcttaattaaatgtgtacatatttttttgtaataaatatatacagattatcctacaaaaaaacacaaagatattaacattttttacacatgttgatatctttgtatttattttgattgagatacttatccacattatcaacatcacctactattattactactaatttttttaatttatttttgtacataatcacttaaggaggttatccacaatgaagataatttgtaatcaaaaagtacttgcacataaaataggaattgttcaaaaagcaattaatggaaaaacaactcttgagcttttaaaggggatcttattaacagctcaaggtaatactgttaacctaacagggtatgatttagaaattggaatagatacttatgcacaagcagaagtcatagaagaaggagaaatagtaattaattctagactttttggggatattataagaaaattacctgatacttttgttgaaatagagacagattcagataataatgtgtatataaactgtttaaactcaagatttaaaataaaaggtgattcagcagaggaatatccaagattaccagatgtacataaaaatgagttatacgatatacctcaagatttactaaaaaatatgataaaacaaactgtttttgcaatttctcaagatcagacaaaacctatattaatgggtgaattactagaaatagttgatggaaatataagtttagttgccattgatggttatagactagctgtaagatcaagtgaaataaacaatatgatggataatataaaagttataattcctggaaaaacacttcatgatgtaaatggattactttcatcagaagacaattctataaaaataggatttgatgagaaaaatgctatttttataatcaatgaaacaaaaataataactagattattagaaggagaatttatagattataaaaaacttcttcctagagaatatggagttagagctaaggtaaatactaaagaattactaaacagtatagaaagagcgtcattactttcacaatcagaaaagaataacttaataaaattatcaataagagataattcaatggctataacttctaatacagaaagaggtaatgtttatgaagaagtatctatagagctagaaggtgattatttagatatagcttttaactctagatatttcttagatgcacttaaggtaatagacagtgaagaaatatttatagaatttacaacaaatgtaaatccttgcatcataaagccaacagatggaacaaaatatacttatttattacttccagtaagaatatcttctaatatataaattaaaattaaacccaactgaaaaagttgggtttttatgatataatatatttttaagtatatgttaacaattaagagtataagaaattttttaatatatatttgatataatgaaaggaggcaaaagtaatgattgaaataactatagattctgaatttataaaattagatcagttcttgaagctagtagatatagcatctacaggtgggcatgcaaagttcttaattcaagaaggtctagtaaaggttaacggagaaatagaaactagaagaggtaagaaattaagatcaaatgatattgtagaagtagaaggaaataaaataaagatactataaaaggggtgccctttgtgtatttaaatggcttaaatttaattaactttagaaattatgaggctctatatttagagtttaatcccaaaataaatttacttataggcaaaaacggacaaggtaaaacgaatattgtagaggctatatacttactatcatttggaaaatcttttagaacaaataaagacaaagaactgattaaatttgaaagtgaaaacttatatataggtggtaactttacaaaacatgatagaaagagtctaatagaaataggaattggtaaaaataacaaaaaaggtataaaaataaacaaaataaatatagaaaagatatatgaattattaggaaatttaaacgtagttatattttcacctgaggatttaagacttgtaaaagaaggtcctaaggaaagaagagtgtttattgataaggagataagtcaaattactcctaaatactataattatcttaccaattataacaaaatattatttcaaagaaataaactattaaaaagtagctatgtagacatggacttagtagcagtttatgatgaaagcttagctagatatggtagttatatatatattctaagacgagattttataaaaaaaatagcatctatatcaagtaaaatgcataaaaagcttaccaatgaattagaagagttaacaataaagtacaaaaatcaaataaatcttaccgaagaagatactgtagatacagtatatgaaaaatttataaaaaagcttaaagaaggacgtcaacatgatatagatactagaactactagatatggaattcataaagacgatttattaatttgtataaatgatttagatgttagactttatggatcacaaggacagcagagaacagcttctatttcattgaaactttcagaaatagagttaataaacaatgaggttggagagtatccaattttattattagatgatatttttagtgaattagatgaaactaggcaaaagttgctagtagacaatttagacaaagttcagatgtttataacaacagcagaagcttctcataaaaagatatttaatactgagaatactactattttcaatattgaaaaaggaaatgtaattagtatagagaatggagggaactagatgaaacaagaatacggtgcaagtcagatacaggtattagaaggattagaacctgtaagaaaaagacctggtatgtacatagggtcaacaggacctagaggtttacatcatttagtttatgaaatcgtggacaacagtatagacgaagctctagctggattttgttcagatatatatgtttctataaatgaagatggaagcatattagtaaaagataatggtagaggtataccagttgaagttcatccaaagactggaaagtctacattagagacagttttaacagtattacatgccggaggtaaattcggtggtggaggctataaggtttctggtggtcttcacggagttggggtttctgtagttaatgcattatcagaatggttagttgcagaagttcataaggatggaaaagtttacagacaaagatatgaaaaaggtgtttcaacttcagaaataaaagttgtgggagaaactaatgtaacaggaactataatacagtttaaaccagatgcgactatatttgatgaagttgagtataagtatgaaacattagagcatagattaagagaattagcatttttaaataaaggtgttaagatagttttagaagacaaaagagaaggaagagaaaagaaaaaagaattccactatgaaggtggtttaatagagtttgttaaacacttaaataaaactaaaactggaattcatcctgatatagtttatatagagaaaaaagtaaaagattacatggttgaagtagctttacagtatactgatggttatacagagaacatatattcttttgcaaataatataaatactcacgaaggtgggactcatttaagtggatttaaaactgctatgactaaagtagttaatgactacgctagaaaaaatggaatattaaaagaaaaagattcaaaccttttaggtgaagatataagagaaggtcttacagctgttatatctgttaagcttccagaacctcaatttgaaggtcaaactaagactaaattaggaaatacagcagtaagaggagtagtagatagcgtaactgttgaagaaataggagcattcttagaagaaaatcctacaacagctagaattatagttgataaagctttaagagctcaaagagcaagagaagcagctaaaaaagcaagagaattaactagaagaaaaagtgtactagaaagcacatctttaccagggaaattagctgactgtgctgaaaaagatcctgagaaaagtgaaatattcttagtcgaaggggattctgccggaggttctgctaagcaaggtagagatagacatatacaagctatattaccactaagaggtaaaatacttaatgttgaaaaatctagactagataaaatattatcttcagaagaaataagaaatatgataactgcatttggatgtagtgtaggtgaagactttgatttagaaaaagttagatatcataaaattgtaataatgaccgatgccgatgttgatggtgcgcacataagaacattacttcttacattcttctttagatatatgagacctcttatagagaacggatatgtttacatagcacaaccacctctatacaaagttaaaaaacaaaagaaagaatactatgtatattcagataaagaattaaatgttttacttgagcaacttggaagaactggaatagaacttcaaagatacaaaggtcttggagaaatgaacgcagaacagctttgggaaacaactatgaatcctgaaactagaactttattacaagtatctatagaagatgcttctatggcagatgaaatattctcaatgcttatgggtgataaagtagctccaagaaaagagtttatagaagaaaatgcaagattcgttagaaacttagatatataagagaggggatgaatatcaatggaagaaaataatagaatactccctattgaaataggtaaggagatgaaaaattcgtatattgattatgcgatgagtgttatagctggacgtgcccttcccgatgtaagagatggacttaaaccagttcatagaagaatattatattcaatgagcgagttaaatttaacaccagataaaccatatagaaagtctgcacgtattgttggggacgttctagggaaataccatccacatggagatagtgcagtttatttagcaatggtaagaatggcacaagatttctctactagaggacttttagtagatggacatgggaactttggttctatagatggtgactcaccagctgcaatgcgttatactgaagctagaatgagtaagttagctcttgagttattaagagatatagataaagagactatagattttataccaaactttgatgaatctttaaaggagccatcagtattaccatctagatttccaaaccttttagtaaatggatctaacggtatagctgttggtatggcaacatctataccacctcataacctaggagaggtaatagatgcaacaatacatcttatagacaatgaagaatgtagcgttgaagatttaatacaatttatacaaggaccggacttccctacttctgggataataatgggtaaagaaaatatttctgaagcttatagaacaggaagaggaaaagttaaggttagagctagagcatacatagaagaactagctaaaggtaagcaacaaatagttgtaactgaaataccatatcaagtaaataaagctaagttagttgaaaaaatagctgaattagttaaggataaaaaacttgaaggaatttcagatttaagagatgagagtaacagaaatggtatgagaatagttatagagcttaagagagatgctaatgcaaatatagtattaaataagctttacaaacactctcaaatggaagatacatttagtataataatgctagctttagttaatggtgaacctaaagtattaaacttaaagcaagttttatatcactatgtacaacatcaaaaggatgtagttacaagaagaactaagttcgacttaaataaagctgaagcaagagctcatatattagaaggattaagaatcgcgctagataacttagatgaagttataaagcttataagaggatctaaaactactcaagaagctaaagaaggattaatgaatagatttaatctttcagaagtacaagctcaagctatcttagatatgagattacaaagacttacaggtttagaaagagacaagatagaagctgagtatgaagagcttcttaagaaaataaatagattaagagaaatattaagtgatgaaagattacttttaaatgttataaaacaagaattatcaataataaaagaaaattatgctgatgaaagaagaactgagataagacatgctgaaggcgaaatagatatgagagaccttatagaaaatgaagaagtagccgtaactcttactcactttggatatataaagagaatgcctatagatacttataagagtcaaaatagaggtggaagaggtatatcagcacttactactagagaagaggactttataaaagaattaataactactcaaactcatagtagattattattcttcacgaataaaggtagagtatatagattaaatgcatatgaaataccagaagctaagagacaagctaaaggttctgctatagttaacttattacaattaaatagcgatgaaaagattgcaactatgatttctattgatgacactagcgatgctcaatacttattattagcaactaaaaatggaatagttaagaaaactaaacgtgaagaatttaaaaatataaacaaatcaggattaatagcaattggattaagagaagatgatgaattaattgatgttagagtaactgacggaagtgaagatgttatattagttacaaaagatggtatgtctataagatttgatgaaaatgatataagacatatgggtagaacagctatgggagttaaaggaataactctaaataaagatgataaagtcgtagctatgaacctttgtagtgaaggaacagatttattagttgttagtgaaaatggatttggtaagagaacatcaattgaggaatatagagctcaaataagagcgggtaaaggtataaaaacttataatatagcagataaaacaggatatattgttggagctcagatggtaaatgaagacgatgagatgatgataataaattctgatggtgtattaataagattaagagtaaatgaaatatctttatttggaagagtaacaagtggtgttaagcttatgaagactgatgatgaagtaaatgtagtatcaattgctaagatagagatggaagaatagggtgtacaaaccctattctttttgcataattatggatataataaatatataaatacgaaaggagacaagatttatgagcaaaaataaaggcaaatattttttatttgggtcgatagttggatttttactaggattatttttagcgcctaaaaagggatctgagttaagaaaagaagctaaagaaaaaatggatgagataaaagagaatccaagagaagtcttagatgggactatagaaactgtaaaaaataaaatttctaacatcgtagaagactgtgatattaacgatgtaaacatagttgaagatgaaataataataagtaagacttttgaagatgagggagataatatataatggatgcagtgggatggcaaataggagctattttatttggtgtatcagcattaataattgcaatatatttagctaaattaataaatagtgcaactaaagttgttgaaaaaacatacaaaatagtcgattataatgaaagatacatccacgaaactatagaaaatgttgcagctattacaaaaagcacagaggatatagtaggtttagctagcggaataactaatatgacaaaagtatttaaatttttcagaaggtaaataaggaggtatagttatgtctgtaaatattgaatcaagattagatagtaatttttggaatgtaggaatagatggagagttagatgtagctggagctgataaagtcaaagaacatctgaatgggttaatagaagagaaaccagtggatttaaagattgattttacaaatttagaatacatagactctacagggctaggagctcttattggtgtacttaaaagattaaaagtaaatgaaaaggatatatatatagtaaacgctagaaaaaatgtaaaaaaaatatttacgataacaggactagataaaatatttaaagtggagggataagttttggagcgagaaactataaaaatggaagttacagccaatccagaatatgtaagtattataaggttaacagtatctggattagctaacaaagtaggcttttctttagacgatatagaagatataaaagtggctgtatctgaagcatgtacaaatgctataaagcatagtttagacgataaatttttagttcaatttactatattagaaaatggattatcaatagaagtacaagataaaggtacaggatatgatgttgagtcattacaagagcctgatttagaaaatccaaaagaaggcggattgggattatttataattaaaacgctaatggacgaagtcaatacagtatctaatactgatgaaggtacaacaatcaaaatgactaaatatttaggagttggtatttaatgaggaacgtagctaatgctacaagctatatggatatgacaactaaagaattgtttaatatatatagcaaagacaaaaacgtagaaataagaaatattcttatagaaagacatatgtatttagcaaatatactatctaaaaaatatattaataagggtgtagagttcgatgatatatatcaagttgcatctttagcattaatatatgcaatagatagatatgatattgaaaaaggctatgagttctcaagttttgcaacgcctacaataataggtgagataaaaaaatactttagagataaagtatggacagttaaagtaccaagaagaatacaagaattaagtaaaaaaataagtgaggctaaattatttttagaacaaaaaaataaaaggagcccaaaagctatagatatagctaattacttaggatgtagcgaagaagaagttttagaagcaatagaagcttcttatggatatcaaccaatgtcattagatacatctagtaatgatgattcagatgataaagaaataacacttaaagataaaattgggcaagaagaaactagtttcggaaacatagaaaatatggattttataaataaatttatagaaactttgaacgagctagaagttaaaatctttaaagatagattctttttagataagactcagtcaattatagctaaggaattagagatatctcaaatgactgtatctaggctagaaagaaagataattgaaaaattaaaaaaagaatatgaaaagaatttgtaaaaaaataaaaaaatttgacaaaaagtgttgacttactgtttaaaaggtagtatagtattacttgtccttaagaaaagggcaaaacaaaatgaactttgaaaattaaacagtaggttaattataaaaattcttttttaagaattaatcagatgtgaaaaatttaaataataatataaataaatcttgtaatagtatacagaaaaaattattaaatggtgacatagctgtaagtaaagacgtagaaaatttaagtaaattgattgaagataaaaattatataataggaagcgacttaaatagtaaatcattagaaaataaaaaattagaagaaaaagaagttaatagtataataagtaaaaattcagagttatttaaagctaaaaattcaggcatcgtatcgtataaatttgatgggaatgaagataaatttaaaatcgatagaataaatgaaataaaaaaagaagatatagaaaatacagaaagcaagtataaaaatatacaacaaaaaaataaagttaaaaaagaagaaactttggcgagagttataaataatttcaaacagtatgttgctataagttgtagcaaagaagaagttaaaaaattagatgtaggtcagcaaattatattgtctagtgagattgaaaaaataaatagtaacgtatatgatatatataaggatggaaaagattatattgtaatattggagataagtgaacaaaatgtggaaatttacgatacaagagttaaagaatttgatataatatataagtcaatggaggggttaaaggttcctaagaagtcgataataaatgttgatggtaaaaaaggcgtatatgctatatcagaaactggagacgcaaaatttgtagagataaaaggaaatttatatgatagtgaagaatatataatcattgaccactataaaaatgatataaatggaataaatactataggtatttatgatgaaataatattaaatcctaaatttaaaaattttttttgataaagtaggtgattaaatggagtgtataaaatctaatatagaaaatataaaaactaaaattaataattcttgtaaaatatcaaatagaaatgaagaagatgttaaattaatagcagtaacaaaaacagtagatatagatgctattaatgaagcgattgagtgtggtgcaacagatgttggagaaaataaaccacaagaattatctagaaagtttgaagttataggaaataaagttagatggcaccttataggaagtttacaaaccaacaaggtaaaatatataattgataaagtatatatgatacattcaatagatagattatctttatgtgatgagattcaaaaaagggcagaaaaaattgacagaacaataaactgcttagtacaagtaaatatatcaaaagaagatagtaaacatggaatttatgaggaagatgctttaagttttataaaaactatagcaaatagttatcctaatataaaagttaagggccttatgactatggctccaaatacagatgataaggaattaataagatctgtatttaaaaaattaaaaaaattatctattgctatagataatgaaaatatagaaggtgtatctatggatgagctatctatgggtatgagtaatgattttgaaatagctgttgaagaaggagctacttttgttagagtagggacttctatatttggaaaaagaaattataataaaaaataattaatatatgtaatggaggatgttaataatgggaaatggtttcataagtaaaataaaagattggatgactgatgaagtagaagaagactttatggatgacgagatagaagaaatagaagaagaaatagaagtatcagaagatttaagcagtggagtaggagctatagcacaacctaaaagcaataaaatagtaaatatacatacagcaggacaaatgaaagttgttatagtagaacctaaaaaatatgaagaagttacatctatagcagaccaattaaaacaaagaagagctgtaatagttaacttagaaaacttagatgatgcagttactcgtaaatctatatttgattttatgaatggagctgtgtatgtactagatggaagtatacaaaaagtatctaaagctatatttatattagcgcctaataatgtagatatagatgcaaatatgaaaaaagaattagaaagtaaagcttttttcccatggcaaaataaataataaaaaaaggagtaagatataatatgataaaatactctttatttgttttaactgatattattcaatttgcaatagtaataagagcacttatgacgtggattccgggggcaatagaatcaaaggcttataatataataggaatgttaacagagcctatagaaggacctataagaaatattatgaataaatattttgaaggtcctatagatttctctcctatagtggctttatttgcattacaacttataaatgtgttaatagggtatatattgtaaattaaaatttaggaattatttatggataagataacacttacaaatcatattagagatattgatttaaaaaataaaatgtttaaggtcatagataaagcatattcttgtatgaaaaattatgatgtaaagtatactgattttttaaatccttatgaagttaaaaatgctatatctatattaaataactttaatgacattaaatatactgttgatggtggatttaatgaagcagaaagaaagttaatatgtatatatccatattatatggattatgaagatatagaagaatcaattaaagtattgcaaatagaaggaaattttaaatttaaagaagtaaaacataaagattatttaggtgctttacttaatttgggtataaaaagagagaaaattggagatataaatatacatgacaacttctgtcaagtaatagtaagtaaagatatagctgattttataataataaatttaagcaaagtctcaagaaataatgtaactataaaagagataagcaaaaaagatatattttacataaatcctaaatttaaggaagtatcttttacagtatcatctcagagattagattgtttaatcagtggcatatataatatttcaagacaagaaagtttaaaacttataaatgcagaaaaggtatttgtagattatgaaaaaataacctctgcgtcgaaaatattagaacgggaaaatcttatatctgtaagaggtaaaggtagagctataatagaagatataggagatattactaaaaaaggcaaaataaaagtaaaagtaaaactaatagtatagggaggggaacatatgctgactccagtagaaatagaaaataaggaatttaaaaaaggtatacgcggatatagagaagatgaagtagatgaatttttagatatagtaaaagaagattttgaaaatatatatagagaaaatttagacttaaaagaaaaaattagaatgtataatgatcaaataaataagtatgaaaatatagaagaaacattaaaagctacacttataactgcacaaacagcagcagaggatacatgtagtgcagctaataaaaaagctaagataatagtagaagaagctgagcttagatcaagacaaataatagaacaagctaacaatagagtaattgaaattagaaaagaatatgactctcttgttaaagaatttaagatatttagaaataaatttaaatcactactagaagatgaaataagaagtgtagatgacattttctcagatatagatgaaagcagtgtagaaaaaatagatgaacttcaaaaagaattatcagatgcattagagtaaaaagatattgactatttgaaaaatttattataaaatttcatacatatacaaaattatacttataaataaaagctatgatggagagagtagtctttagataatttcacagagagttggaaaaagctgagaaccaataaatttataaaggtgaaaatcactcctaagctgcaggctgaacggtaaaactattaagctgtgccggttaaaaaccgttatattgaaagagtgttacatatgtaatatttaatttatatatgtaaaattagggtggtaacgcgagtaataactcgtccctttatggggacgggtttttttatgtaaaattttaaaataaaaaaaggaaggtggattagaatggctaaatttaagtcattagttgattcttctgtaaaagaagctgaagctaaagtatcaaaatactgggatgacataaatatgctagagaaaactctagaaaaaggaaaagatgatccaagttttgtattctacgaaggacctcctacagcaaatggaaaccctggaatacaccacgttatagctagaacacttaaagattctgtttgtagatataaaactatgaatggatatcaagtaaaaagaaaagctggatgggatacacacggattaccagttgaaatacaagttgaaaaagaattaggtttatcagataagcaacaaatagaagcttatggaatagataaatttaataaaaaatgtagagagtcagttttcacatttgaaaaacaatggagagaaatgactgaaagaatggcttatgaaatagacttagataatccatatataactttagacaataactatatagagtctgtatggtggatattaaataagtttaataaagaaggatttgtatatgaaggtcataagatccttccatactgtccaagatgtggaacaggtcttgcatctcatgaggttgcacaaggatataaggaaataaaaaataatacagtaatagctaagttcaagagaaaagatgctgatgaatatttcttagcatggacaacaacgccttggacattaccatcaaacgtagcattaactgtaggacctgaaatagattatataaaagttaaacaaaatgatgaagtttactatgtagctaaagctttagctaataaggttttaggagaagactacgaagttatagaagaattaaaaggtaaagatttagagtacgttgagtacgaacaattaatgccatttgttgaagctgataaaaaagcattcttcgtaacatgtggtgattacgtaacaactgaagatggtacaggaatagttcatactgcacctgcatttggtgaagatgactacaacttaggtagaaagtatgatttaccagtattacaaccagtttcagaagcaggtaaatttacaactactccatgggaaggtaaattcgtaatggaagatggagtagacgttgagataataaaatggttacacggagaaaataaattattcggcaaagaaaaggtagctcataattacccacattgctggagatgtcaaactccacttttatactatgctaagccaagctggtatatagaaatgacaaagttaaaagatcaattaatagctaataacaaaactgttgagtggtatccaaactttgttggagaaggaagatttggtaactggttagaaaacttaaatgactgggcaatatctagaagtagatattggggaactccacttaatatatggaaatgtgaatgtggacataaagaatctgttggatcaagaaaagaattagcagaaaaggctatagaaaatatagatccagaaactatagaattacacagaccatacgttgatgatatacactttaagtgtgaaaagtgtggaggtactatgacgagagtaacagacgttatagactgttggttcgatagtggatcaatgccatttgcacaacatcactatccatttgaaaataaagaaaactttgatgagttattcccagcagatttcatttgtgaaggaatagaccaaactagaggatggttctactcattacttgctatatctactttcgttacaggaaaagctccatataaaagagttttagttaacgatttagtattagataaagaaggtaagaagatgagtaaatcaagaggaaacactgtaaatccttttgaattatttgataaatatggagcagatgctctaagatggtacttactatacgtatctccaccatggactccaacaagatttgatgaagatggattaaaagaagttcaaagtaagttcttaggaactatgaaaaatgtatataacttctttacgctatatgcaaatactgatgaaataaacccatcagaattctttgttgaatataaagatagaccagaacttgacagatggatattatctaagttcaataacttaaagaaagaagttgaagaaaacttagaaatatttgaattaaataaaactgttagaatgatacaagagtttataaatgaagatttatcaaactggtatataagacgttcaagaagaagattctgggctacagaattaactgaagataaaaaatcagtttataatacaacttacgagatattaacagagctttgtaagttaatagctccatttactccatttatagcagaagaaatatatagaaacttaactaatgaagaatcagttcatttagcttcatatccaaaagctaatatggatttaatagataatagcttagaagaaaaaatggacttagttaaaaacttagttacattaggaagagcttcaagagaagctacaagaataaaagtacgtcaacctatacaaaaagtattagtggatggaaaatatgaagatactataaatgacgttgtagacttaataaaagaagaattaaatgttaaagaagttgtatttgctaaagatttaggagaatacatgaactttacattaaaaccaaactttaaagttttaggacctgtacttggtgctaaaatgaagttctttgctggtgcattaagtaagcttgatgcaagtgaagtagtatctaaacttgaagctggagaatctataactgtagatatagatggtgaagagtttaacttcaataaagaacatgttttaataaacatatcagctaaagaaggatttaatgttactatggaaaataatttatttgtaatattagatacaactttaaatgaagctttaataaatgaaggatatgcaagagagttcatatctaaagtacaacaactaagaaagtctaatgattttgatgttttagataatatagaaatagattattgctcagatgatgaaatagctaatgctataaatgaatattctgagtatataaaatcagaaactctagctatagatataaatagagttgaagatgaatctatagaaaaacataacttaaatgatcatatgactggtataaaggttataaaaaagtaattttactgtaataaaaattcctagataaattgtctaggaatttttttatttgcaataaattttaaaaattatgcaaaaattgttaaaatcattgtatacaaattaaaaataaaaagcaatattaactatatacctaataaaataatgtgaaaattgacgaaaaatatagaaataaataaaaaataagaacttttgtaaaaattatgaaaatgtttgcctgatatggtaaaataagaaagtattaaaatattaaaatattattttaaaagacaacagggaggaagtttaatgagtacagcaagtaagaaaaaaactaaagtacaagcttttatggactcaatagaaaagcttggtaacaaattacctcatccagtacttatgtttatgtacatagctgcatttgtattggtattatcggcagtgctgggatcatttggggtagtggctaagacaccacttggagaattcccaataaacaacttattagggcaagatcctatagaagtattaaaagtaggtgcaaatggtactgcagtagcagaaagatattcaaatggattatcttatgtaataggtactgctatagctaactttatgaatatgtatgcaatagggactatacttataataatgttagcgataggacttatggatcaaagtggatatttatcaatagctatgaagagtatagtttcagcaacgccttctaaattagtaacaccagttgttattttcttaggggttatgtctaatatggcatctgatgcaggatatgttgtattaatacctcttgcagcattaatgtattatactttaggaagacatccattagctggacttgcggcaggttttgctggggtttctggtggattcagtgcaaacctttttgtaagctctactgatgcattattattaccatttactcaagcagcagcggaaactggagatgctatggtaggaactagtttagcagggggactttcagtaacaagtaactggtttttcatgatgggatcaactcttgtaattataatattaggaacattagtaattgataaattcgtagaaccaagattagggacttataacacaaaagaagctgatgttgaagctgatcatgaaataactcaaaaggaaagagaagcctataaatttacaaataaaatattattactagttataggacttatagttttagctgcattaccaatagatacaggtaataagataccattagttggagatttatctactaatgttaaattatgggtagttaattcagatggaacagcaactcttaatactgtagatagtttcttagattctatattcttcaaaggcgatatggtaatcatgttaatgtttgttatattcgctataagtggactagtatatggatttaaatcaggtaagtttaaaaagagttcagatatagtaccagctatgtgtaaagcaatggctgatatggctccaataatagttatattattctttgttgcacaatttataaactattttaatgattcacatttaggagtattagtagcatctttaggagctgatttagtttcacttataccaaaaggtaacatgtttatgtctatggtattaatggtagcatttatattcttaacagcatttgtaaacttattcatgggtggagcatcatctaagtggggattacttgcaccaatatttgtacctatgttaatggttgcaggattctctccagcaggtgtacagttaatgtatcgtattggagattcatctactaacgtaatatcgccattaatgagttatcttggagttatagtagtatttggacaaaagtataaaaaagattttggtgttggaaacttaatgagtatgatgatgccaatatcaatggcatttttaataggatggactgtgtttgctataatttgggcattatcaggagttccaataggaccaggaactcaattctttattaattaatacataaaagagcaaaggatatattctttgctcttttttaattttaagaattaaatagttgactttttaataattaaaacatattatataaaataaacaataattaaaaataaaatatatatatcctatgaaaaggattagtaactaggtatagatttaatacagagaattgaggatgctgagagctcgatataaataaatctagtgaatggaccttggaggaattaggtgaaatttaaaaatattaaagagtagctgatatcgtgactgcacgttatagcagattatataaagagatatacatttaataattatgtatataatttaggtggtaccgcggaaactatatccgtcctattaacttaggacggatttttttattttaaaaatacataggaggaagataaaaatgaacaaactaggaataataggtgcaatggatgaggaagtagatatattaaaagatataatggatatccaagaaactatagaaaaggcaagtttaaagttttatgtaggaaaattagaaggaaaagatgttgttttagttagatgtggtataggaaaagttaacgcagcattatgtgctcaaatattaataagtgaatttaaagttgatgcagtagttaatacaggagttgcaggagcattaaatgaagaattagatgtatatgatatagtaatttcaacagatgctattcaacatgactttgacacaacagtatttggagacaaaaaaggtatgattccaagaatggaaaattcaatatttgtagcaaatgaaaaattaatagatgctgcatataaatcatcaaaggaagaagtaaaaactcacaaagttttaaaaggaagagttttaagtggagatatatttataagtagcaaagaattaaaagacgagttagtaaaagaatttaatggatactgtggagaaatggaaggagcagctatagcacatgtatgtcatgtaaataatactccgtttgtagtaataagagctatgtctgacaaagcagatggaagtgctgatgtaacttatgaagaatttgtaaaacaagctgctcataattctaaggatatagtaattagtatgctaaaaaatatataggaggagttaaatatgagtgaaaagaaaataatatttagtggagctcagccatcagggaaattaacattaggtaattatttaggtgctataaaaaactggactgagttacaagaagaatataactgttattatagtgttgttgatttacatgcaataacagtacctcaagaagctaaaaacttaagagcgaacactatgcaattattagctcaatatttagctagtggattagatccagaaaaaaatactatatttattcaatctcatgttagtgcacatacagaacttatgtggatattaaatacaatgacttacatgggtgagttaagtagaatgacacaatttaaagataaatctcaaaaaaatgaggcaaatttaaatgcaggtttatttacttatccagtattaatggcagctgatatattattatatcaaactgatttagttccagttggagaagatcaaaaacaacatttagaattagcaagagatttagctaatagatttaacaatagatacagtcctacatttaaagttcctgaagcctatataccaaaagctggagctagagtcatgagcttacaagaacctactaaaaaaatgagtaaatcagatgaaaatgaaaatggatatatattattagttgatgatccagattcgataagaagaaaaataaaaagaagtgtcacagattcgataggtatagttcaatataatgatgaacaaccaggtataaagaatcttttagatatatattctaaattagacaacaaatctatagaagaattagtagctatgtatgaaggtaaaggatacggagattttaaaaatgatgtttctgaagttattgtagaaactttaagacctttaagagaacaatatgagtatttattatctaataaagattatttagaagatgtatatgctaaaggagctcaaaaagcagaatatcaagcaagaaaaacacttagaaaagtttataagaaagttggattaatagaaaagaagtttctataatctaaaaatttaaagtcctatttattaggactttttttgcattttaaatataaaaattgacataataaaagtgtaaacagtttttcaatataaagagggcgtgttaaaagttgaaaaagtataggactggcaacaaattttgtagtgatataaaaaatatgaaagaaatagatataagaattaatggaaataaagatgatgggcactattttaagaagcttcaagttgttaataacaaactagataatctaatgtatataattgaaagaagtagaataagagattttatgattttaacagatagcaaaagaagattatttacaattaattttatagctggagtaggaaaaggatttggtcaagccataggatttagcgtattaacagctatagttttatatttaatttctaagtgggtaaacctacctatagtaggagcatatatagccaagtttttagatattatagaccaatttaggaaaaattaaaggaggacattatggataataaaaaatatcaaaaagctttattaaaagagaaagataatttgattaaattagtttctaaaatggaagataatacggtatttggatatacaacaaatcatactagtgaaaaatatacatcaggtgaactgtcaagctatgataatcatttaggagatataggaactgaagtatatatgcaagaaatgcaagatagtttaactagacatgaaaaacttaaactaaatgaaataaatgatgctttatataaaatagaaaatggaatttatggtatatgtgaaaaatgtaataaaaatatagatgaagatagattagaatttattcctgaggcaaggctgtgtgcaaactgtgcaaaaaaagaagatagtcatcttaataatgtagaaagtgtaagcataaaagataattttagtggaccaaacttatatagaagccctgttgaagatttagtaaatatgaatagagacatgagaggtagacgttagaaaagaggttaaaatatgagaaaattaataataccaattgtatctatttttttattaattagtattatttatggaataaacacttccaatataagtgggttagacgatcatcaatcagcgatgattaacaataaaaatataattaaacaatatgaagatatagtaataacaaagggaaatgaatctaaaaaggcaattgcattaacttttgatgatggtccagatgaggatttctcacctcaaatattagatatactaaaaaaatataatgtaaaggcaacattttttatggtaggacaaaaagttggatggaatccccaaatagctaaaagggcatctgatgaaggtcacgatatagggaatcataccttttcacatataaatatatgtaaaagtacaaatgaacaaataattaatgaaataaataaaacacaaaaaataataaaggatgtaacaggcaaagagccaactttatttagacctccatatagagcgataaatgaaaacttgtttaatataataaaatcaaaagatatgaaggttgttttatggtctgatttggatactaaggattggagcaatccaggagtatataatattataaaaacaatagaagacaacgcaaaaaatggaactataattttacttcatgattataatcaaattagaaataataaatctcaaactatacaggcattagaaaaggtaatacctaagatgcaaagtttaggatatgagtttgtgacaatatctgatatgataaaataaattataaagcaaaaagaaggcatataatattgccttctttttgctttataatctatattgccccttgtaatattaatatatataataatatgtatataaatattataaggaggaaaatttattgacatacatactaataatattaggattaatcggtttagatcaaatatcaaaatatattgctataaaatatttagctggtataggaagtataccaataataaaagatatatttcatttaacatatgttgaaaatagaggtgcggcatttgggatgtttcaaaataaccaaataatatttgttgtagtagcatcgattgcatgtatatttggtttatattatttatataaaaaagaactaaacttattaggtaaaacagctattattcttataatatctggggctataggaaatcttatagatagaataagattagggtttgttgtagattattttgattttagaataatttgggattatgtatttaatatagcagatgtttttgtagtagcaggaactatattattatgtatttatataatattttttgaaaataacaagtaggtgaagatatggaagagataagacagtttttagttatagatgaagaagaaggctctagattagatgtatatttatcggaacaattaggagatatgtctagaagttatatacaaaaattaataaaagaaaagaaagttaaagttaatggaaaagtagagaaagctaaatatttagtaaaagaaaatgatgatatatttatagagataccaaagccaaaaactcttgaaattatagctcaagatatacctatagatatagtatatgaagatgatgatttattaatagtaaacaaacctcaggatatggtcgtacatccagctccaggaaactatgaaaatacattagtaaatgcaatattatatcattgtgaaggcaatctatcgtctataaatggagttataagaccaggtatagtacatagaatagataaagatacatctggccttttaatgattgcaaaaaataataattctcacaactatttatcagagcagttaaaagatcattcaataactagggaatatgaatttatatgtcatggagttataaaagaagataaaataactgtaaataaacctataggaagaaatcctaaggataggctaaaaatggcagtagttaaagatggaaaacatgcagttactcattttgaagttattaatagatatgaaaattttacacatgtaaaagctactcttgaaacaggaagaacacatcaaataagagttcatgcactatctttaaatcatcctttattaggagatccaatatatggacctaaaaataataaatttggagttaaaggccaagttttacatgctaaaaagcttggatttatacatccaacaactaaggaatatgtagaatttgattcagagctaccagaacattttaagaatataattaaaaaattaaataaaaatagttgagaaaatataactagtattatataattataaaaaatgaaaattacctttaagtgatacagagatatcataaggcaagattaaaagtacaaatataattataactatatttatatttggaatgtgtataggttaattatagcttcttgcccaaaaggtaagaagcttttttagttacctagtaaaggaggattttaatgaaagaaaaagctcaattaatggatgataaggctataacaagagctataacaagaattagtcatgaaattatagaaagaaataaaggtatagaaaatgtagttttagttggaataaaaactagaggagtacctattgcaaatagaatttcaaaaaagattgaaagtatagagggtaaattagtcaatacaggcgaagttgatataactttatacagagatgatttaaaaaaaattgatgtagatccagttataaatggttctaatatagattttgatataaatgataaagtagtaatattagttgatgatgttttatatactggaagaacagtaagatctgcattagatgctataatggatataggaagacctaagtctatacaattagcagtattagtagatagaggacacagagaattaccagtaagagcagattatgtaggtaaaaatgttcctacatcaagacatgaaataatatcagttatgttaagtgaaactgacgaacaagattcagtaactataaaagagtaaaaacataaaattatataaggttaataccttttaattcagtacagagatgctgaaaaagggagaattatttctcccgcattaaaaaatagggaggtttttttatgaaaaaaacaatattatcattgcaacatctattagctatgtttggagctacagttttagttcctatattaacaggatttgatccagcggtagcaatattttgcgcaggaatagggactttaatatttcatacatgtacaaaaggagtagtaccagcatttttaggatcaagttttgcttttataccagtaatattagcagctaaggaagctcacaatggagatttagcttatgcacaaggaggtataattgtagcagggcttatatatttagtaatgtcagctataataaaaaaaatcggagtagataaaataaaaaaatacttcccagctcaagtagttggagctatgatagctgttataggacttaatttaatacctacagctttggatatggcatcacataattttattatagcagttataacattaggatcagcagtagctataaatgtatttggtaaaggttttgtaaagcaattaaatataataattgctgttgccataggatatataatatctttaatgttaggaaatgtagatacatcttttatgagcagtagtgcatcttttttacaaataccagcatttagattacctaaatttagtttagaagcaacagtattaattgcacctgtagttttagcggtattcatggaacatataggcgatatgactactaatggaactgtagtcggaaagaatttcatagaagaaccaggacttcatagaacattaatgggagatgcattagctacaatagcagctggttttttaggaggaccagcaaatactacttatggagaaaatacagcagtacttgcaataactaaaaattatgatccatcaatattaagaagaacagctatatgtgcaatattacttgcatgtgtaagtaaatttggtggatttttacaaagtatacctacagaagttatgggaggtataagtataatgttattttctatgatttcatatgtaggattaaagactataaacgatagcaaatgcataagtaataaaaagaatataataatagtattaactataatgataattggattaggaactacttatttaggtaataaaggaatagttataggaattcctataacaaaaacagttactataacaggacttagtttagctgctatagtaggaataatcttaaatagagttttaaatagaaatgaattcaaagttgaaaagaaagaagaacaatcagttcttaattctcaacttgtataaaaaaacagggattaaccctgtttttttaatttaacaactaattcttctgatggtgttacataaatagtgctattagtttcgtatataaccataccaggcttagaaccatttggtttttttacatttttctttaaagtataatctacaggaacttgtgaagacattttagatttactgaaaaatgcagctagcattgcaccttcaaatattgtagattctggaatttcttttccttcggttttaattattacatgagatccaggtatatttttagtatgcatccataagtcatcattattagcaatttttaatgttaaaaagtcattttgcttattatttttaccaactaatattgtaaatccatctgaagataaaaactcatttggtttagttgttagattgtttttatctttttttgattttaccttaccacgcatataaccaagtttttgtaattcttcttttatatcatcaagttctgctaagttatcacagttatctatactaagtattatattttcaagataatttatttcttctaaacttaatcctatttgagttgttatttcttttttagcatgttttagtttattatatcttttaaaatacttttgagcattttctgatggagtaagatttttattaagatctattttaattaaaggacagtcttcttcataaaaattttgaacctctacaaaatccatacctttttcaatcatatatatatatgcagttataagttcgccttttattttatagatattagcattatcagattctttaagttcaattttttgttttttcaatttgttgtataatctgtctagtttaattgatatactctttttaaaatcagaagctctttggtttattctttctttagcatctttattagcataaaaactttctattatagatgatatactttcatcatgaacaacttttaagctatcaaataatgttaaatctatagaactaaaatctataagtttatctatagaagaatctattgctaagcaaggattataattaccatctttaatattaaaaattacgttactaaattctttatataaattatcaaaatctataccatcaatacttgaagctggtttagaaatatctaaatttgatctaaaacatatctctttagatacaataggacttatacctaagaacttagagtatatacattttgatatacttccatcaaactcagatattgtttctttaaatttatccttagatattttatcaagagggtttaacttatcttgagcaggtggtaatacataagtcataccaggtagtagttgtctaactctacttacactaggaggaattctctttatagaatcaactattttattttcttcgtgagtaagtattatattactatgtcttcccattatttctattattatatctttagtagttttagcttttagctcatcaagagattcaacagttatttttataattctttcaaatccaacttgagacacactaactatattcccactttgtatatactttctaagtaacatacaaaacataggggcatttatgggattttcttttttataatttgcagaaagataaaccctagggttagatgcacttgcactaagtacaagtttaaaattttctttattatttcttatatgtaaaactatttcgtcattttctggttgatatactttatctattttaccgccaactaatttagatgataattcatctgaaatagcgtggataactaaaccatcaaaggccataatatcattcctttcaaaatttattgataagtagattattacacagatgtataataatgtgaatataatatttagaatatagtttaaaataatatataggttataatcaatataatttccttttatgaacaaaatattgtataataagctaagaattcaaatttataggggggatataaatgaacttctggaaattacatggagtcggcaatgattttatagcaatagatggtagatttgataatatagatcctaataattattcagatttagctaaaaaagtttgtcatagacactttggtataggtgcagacggattactagttgttaaaaattcaaatatatgtgatgttgaaatggtatattacaattctgatggatctagagctaatatgtgtggaaatggtctaagatgtttttgtaaattcgtatatgacaataatatagtaaaagaaaatgaatttagtgtatatacacttgacggtataaaaaaaatatctttaaatataaacaaagaaaaaattgatactataaaagtaaatatgggaaaaccaaatttcaatcctaatataattccagtaaaaacaaataaagaagtctttataaatgaaaagttagtaatagataataaagaaatagaagttagttcggttcttatgggagttcctcatacaattgtgtttgtagatgaaataataaaaaaagacatatataagtatggagaattaatagaaaaaaatgaaatattcccacaaaatactaatgttaactttgtaaagatagatgataaaaataatattcaggtttatacatgggaaagaggttgtggttatacattaggatgtggaacaggaatgactgcatctgttatagtagctaattacttaaataaagttaataaaaaagtaaatgttaaatcagaaggtggaagtgtaaaaatagaaatactagatgatgtatacatgataggaaatgcagttaaaatatgtgaaggaactttggaggtatagtaaatggctattagtatgacaggctttggaagaggcgaatataaaaatgataattatcattttacagtagaatgcagaactattaatcataaatatgtagatataaatatacgtcttccgagaaaaatatcttttctagaggataaaataagaaatgtagttaaagaatatgtaaaaagaggtagagttgatttatatataaaacttgacttaataggtagtgaagatgtaaacttaaaatttgatgagaagttagctagtgaatatgtaaatatattaaataatataaaatcaacatttaacttacaagatgatataacagttatgaatatagctaaatttccagatataataaaaagtgaagaaaaagaagaagatgaagacttattatggtcaatgctaaaggtagctttagacgattgccttgttaagttaaaagatatgagaaaagaagaaggtataaaactttctaatgacatagatatgagatgtgatttattaaaagattatattgaacaaatagaaaactattcatataatgttgttaatgaatacaaagaaaaattaaataatagaatagctgaaatactagacaatccaagtcttgttgatgaaaatagactagctcaagaagttgcaatatatgcagataagtgtagtataacagaagaaatagtaagatttaaaagtcatatcttacaacttaaaaagacaatacataaagatgaatctataggtagaaaaatagatttcttaatacaagaaatgaatagagaaacaaacactatagggtcaaaatcatcagatcttaatataactaacttagtagttgaaataaaaagcgaattagaaaaaataagagaacaaatacaaaatgtagaataggagagattattatgagcatgaaccttataaatataggatatggtaatgtagttatggcgaataaggtagttgctatagtaagcccagagtcagctcctataagaagattaatacaagaaagtaaagaaagtggaaggttaattgatgctacttatggtagaaaaactagggcagttataataactgatagtcagtatataatattatcatcagttcaaccagaaactgtagcacacagattcaccgataaagacgatcagcagatagagaattagaaaggaagatataaatgaaaaggaaaggtttattactagttgtttctggaccatctggagcaggtaaaggaactatatgtaaagaatttttacaaaataataaggatgttaaattatcaatttctgcaactactagaaatccaagagaaggagaagtagatggagttaactatttctttgtaactaaagaaaagtttaaagacatgataaataacaatgaattattagaacatgctcaaatatatgataatttctatgggacaccaaaagctgctatactagagaacttagaaaatggaaatgatgttgttttagagatagaaatgcaaggtgctagacaaataaaagatgtatatccagaaggtgtatttatatttatacttcctccatctcttaatgagttaaaaaatagaattgttggaagaggcacagaaacagaagaacaaataaataaaagatttggttcagctgttgatgaaatatgccaaatagaacactatgattattttatagtaaataatgatgtaaaaacttcagctcaagaattagaacacataatatcagctgaaaaaaataaagtttatagatataaagaaaatataataaaaaaattcaaggaggaattataagatgataaagccatcaataaatgaagtattaaaccaaatcgataacagatattatttagtagtaacagtagctaaaagatctagagaattaatagatggagcaacaccatatgttcctacaactaagcaccaacaaataaaaccagttacattagctacacaagaagttgcagatagaaaaataacttttagaaaattaacagaagaagaaatagaaatagaagaagctaagcaacatttagctcaagttcaaaacataatagaggagtaataatatgttaaaggacaaaacagtagttttaggtgtttctggaggaattgctgtatacaaagcttgtgacttagtgagtaaattaaaaaaagttggagtaaatgttcatgtaataatgactaaatcagctactgaatttgtagctccacttacgtttcaaacattaagtcaaaattatgttgtagaagatatgtttgaatctccaaaaacttgggatgtagaacatgtttcattggcaaaaaaagctgatttatttgcattagttcctgctactgcaaatctaattggtaaagtagcaaatggaattgcagatgatatgctaacaactacagttatggctacaaaagctaaagtgcttatagctcctgcaatgaatacgaatatgtatgaaaatcctgtagttcaaagaaatatacaaacattaaaagatttaaattatgagtttgttgagcctgaaagcggaagattagcttgcggagatatcggttcgggtaaattggcatctgtagatgttatatttgaaagtataataaatcttttacaagaaaaaaaagatttaaaaggtacaagcataatagtaacagcaggtcctacagttgaaagtattgatcctgtaagatatataacaaatagatcaacaggaaaaatgggatatgctatagctaaaaaagctatagaaagaggtgcagatgtgactttaatatcaggacctactaatatcataccgcctcaaaatctgaaaaagtttataaaaactgaatcagcagatgatatgtataatgctgttttagagaacatagatgaaaatcaagtaataataaaaagtgctgcagttgcagattataaacctaaaaattattctggtaaaaaaattaaaaaatcagatgatgatttaagcattaagctagatagaacaaaagatatagcattagaaataggtaaaataaaaaaagataaaatcttagttggatttgctgcagaaactaatgatttattagaaaatgctaaacgtaaaatagataaaaagaacttagattttatagtagcaaatgatttaactcaagagggtgccggatttggagtggacaccaatatagttaaagttatagataaagatggaatcataaatgagtatcctaaaatgaaaaaagaagaggtagctgacgttatcttagataagataaaaactctattaaatatataagcatctatattaaatatagatgcttaattttcatttatagataaatagtatattattagggtacttataaataatatgtttactgtaaatgataagaataagtatataaaaatataaatagaggttaaaatatgaagcaatatgcaaaagttatagtaagaaataattctatacatacagataatttatttacgtatgaaataccagatttttttagtgaaaatatatgtataggacatagaatattagttccttttggaatgtataataaaccgttagaagcatttgtatttgatatagttgattttagcatggaaagtaatatagattttaatgtaggaatagattttagtaaatgtgattttatagagatgattgatataagtagtatattttcaaatttaatagataatgcaatagaagcgtgcaataaaattgatgaaaatatagaaaaatacataactataaaaagtacttttataaaggggtactatgtagttaggtgtgaaaatagcaagacaaataaagtaataattaaaaataataagatttttacttctaaaaaagataaattccttcatggaataggaattgatagtataaaatcttcaataaaaaaatacaacggagaactaaaaattaaggatagtgagcataaatttatagctaccattcatataccagttgaataaaatactacacaattgtttacttataaaaatacccaattaagcttttagtatgctagttgtcggtaaaaacataccacttgtcggtattatattgaatcaaaaatttagaaatgttaccttttacacaaagaaggtagcattttttatatgcatttaaaacaattttatacaaaaaatagggggaaaatgatgagagtaagttttagattagctatagcatatttgaaaaaacaaaagggaagaactttatcattaataattagtattgcattagctgttatgttagtatttacacttaatgtagtaccagagtctaagagtaaacatgatataaaaaaagcttataaaaactttagcgattatcatgtagaatacagtgatattaacttagaaactgtagaacagttaaaaaaagataagagtataaaagttataaatgatgttgtaaacctaggtaatgtagtaagtaacaaaggagtatctataaatttaaattcgtatagtaatgattttattgacgcttatggttatgagcatggtccttatggttatgaacttataaaaggtaatgaacctaaaaatgaaaatgaaatagtaatagaagaaaaagctcttaaagagatgggattaagtgataaactaggtcaaagtattgattttactattattaaaaaatatacggatgaaaataatcaaaatcagatttatagcaaagaaaagtcattcaaattagttggaatagtaaaaaagccagatggattttatgaggaaaatttatattataaagtaaaagcatttactaaatacacagaaaatcaaagtatattacctaaagaattagtaagtcattctggggtacttaagtttacgactagcacacctagtatgtctatggtaaataaagcaatagctaaatataaattagacgaaaatagattcatgataaatgttcaactaaatgaagcgatacaaaattatgatatgaccaaaggtggagaaattaagattaaaaataagctgatgcctatggttgcatctgcattagttatatataacatatttaatattatattaatagatatgacaaaacaaataggaatggtaagagcaataggtatgactaagaaaaaggtaggatacatggtatgtatccaaagctttatagtcctacttatgggactagcagtaggatttttactgggaacaatagcatcatatataggtcttagaagtatatacaatgaaccgataagtgtttatataagcaaagaaagcataatagagcccataattatggcagtggtttcagtagctatagctagtatttttactatttataagtgtaaaaaaatatctccaatagaagcaatcaaaagtactaataattcaaagtcaataaaaaaagatagattttatcacaagttaataaaaaaagtatttgggattacaggatatatggcatacaaaaatatatggagatacaaaacaagagcaattttatcaatactttcaataagtatggcaggctctttatttataattaatatggttggatttaatcaatacgatgggagtgtagacaaacttagcccacttattatggagatgggagaaagtgatataatacttagccataattctaataactcaagtgaatattttaatgaatacacaaatgatgaggtaaataagatatctaagatagatggggttagacagataactaaaagtatgaatattacaggatacttaaactcaaacaaagaaaatataagcgactattatatacaatataaccctctagataacaatgaatcaaatttagaaataggaacagctataaaaggatacgataaaagtactcttaaaaaattagaaaaatatctagaagatggaacaatagataatctaaaagaagaaggggatacaataagtggagtagtatctaaccatttttattcaggttcagcagtatcaaatgactcaatcacattaaaaaatttaaaagtaggagatattattgaagttaagattccagtaactaataataaagaagtaaaatatgttaatcaaaaaattaaagttgcaggactattaaatactgactatgttttaaatgcggaaggtggaaaagactcacgtttccaagtgatattagatgaaaatagttttaaaaatttaacaggaaaaaaaggctttaataatatatttataaaattacaaaaggataaagaagaaatagcagtttcaaaggtaaaagaaataataaatgaaaatagctttaagaaaatggaaagtaaatatgagaatagaaagttgtctacttatcaaaatgaaaaacttaaaaaagaggtattagtgagtgtagtacttacaatgtttatttcatctataaatatagcttgtgtagttataacaaatataatgattagagttaaggaaatttcaacactaagagctattggaatgagtatgaaaaatattaagaaaatgataataaaagaaagcattatatatggccttttaagttcaataatagctggagtattttctagctataacacttataaaagtatgcaaagggcaaatgaaatcttttcaaaggggatgggaattaaacaagcatatgaatttaaagtgcccgtagtagaaatacttcagtttggggtagctgcaatacttatatgtgtaattgctggatatttagcaaaaaacagagtttcaaaattaagcataatagaaggtcttagaaatgaagagtaaaggtggggttgagatgaacatattagatacaataaatttaagtaaaacttatggaaaaggagaaaataaagtagaagcattaaaaaatattaacttatctattgaaaaaggaaaatttacagcaataataggacctagtggtagtggtaaaagtactctacttcattgtatagcgggtattgatagtataacaagtggaaaagttatactagatggagatgatatatctaaattatcagatgataaattatcaaagcttaggagtagaaaatttgggtttatatttcaaagcttcaatttaataccagttataagtgtttatgataatatagttttacctatttcacttaatgaaggaaaattagataaagattatatagatgaattaatagttaaattaggaataaagtctcaaataaaaaagttacctaatgagctatctggaggtcaacaacaaagggttgcaatagctcgtgcacttgctaataaaccttcaataatatttgcagatgagcctactggaaatttagactcaaagactacagatgaagtaatggatattttaaagatgtgtgttaaggagtttaatcaaactttagttatgataactcataatgatgatatagctaatatggcagatagagttataactattaaggatggtaaagttttatattaatatagttgtgatttttaaggtaagttttttcagttaagctgatttgcttatcttttttcgttagaatagaaattgttgagttaacaagtgaattaacaaggtaaattggtataatgaaatgaaatatggtaatatatggatagtgaacttagaattaattctagatttacataaattattatctaatatatttaaactaggagcagacaaatcatgaagctaaaatcatttatagaattttcaatttatggattaaaaacaatattcctaaaaaatactaatccaatactagctactataatacttacagattattgtaaccttacttgtaagcattgtgcagtcaacaatataaacaaaataattcatccttatgaagatataaaagaggaaatgttaaagctttatgatgaaggcgttagaattttatttttttgtggtggagaaactcttctttggaaggataaggggaaaagtgctaaagacttaattatagaagctaaagaaataggttttgaattagtcaatatagttacaaatggaactatagatttagatattaaagaagcagatattatatttttaagtattgatggaactaaggaaaatcataattatataagaggtaatacctttgatactatattacaaaatgtagaaaaggctaatgaaagtaatatctgcgtttatatggctattaataatagaaattataaggatataaagggattatgtgaattagttaaaaatactaaaaatctaaatagtatttcctttaattttcatacaccatatgagggaacagaggatttaagtttaagtaaagaacaaaaatttgaagtagtaaatactataaaacaacttatgaaggaagggtatccaatatttaatttatactctgcattagattattatttagataacaattggagtagaccttgtaagcaatgtttggtagtagaaaataaaaaaagatttatatgtggaagatgtgtagaaatagatggactatgtaatgaatgtggatatttatttgctgtagagttctctttattgtttagtggaaatcctaagataatctatgaaactttaaagacatatctgaaatttgtatagaaggagagaatatgttaactaaaattttaagacccgtactaaacaggagctttaagccatttgaatttgtaaaatgcaatgataataatgatttaaattatgtgaatttaaacaataaagataatttagggttatatatacatataccattttgcaaaagtatatgttctttttgtccatacaataaagtgctatatgacgaaaaaaaggctttcgaatataaagaagctctattaaaagagataaaactagccaatataagatataaaaagcaggatataacatctttatattttggaggtggaacacctgccttacttatagaatatcttgaagaaattatagatactgtaaaagaaaactttaatttaaaaggtagcttagcgatagaattacatccaagtaatataaatttaagtttattgaataagttaaaaagcttaggatttaatatgataagtgttggaattcaatcatttaataaacattgtttggaaagcttaggtagaaaagaaaataatgaagcagaaaaaataaagctagtcaaagaagtgggatttgaaaccatagatgtagatttaatatttggaatacctaatcaaagtatagaagatttaaaagaagatgtagccttggcctttgaaattggagcaactcaaatttctacttatccatttattgatttttcttatgctaataataaaagaaaacctctgagttctaatgaaaagaaaaaaatgctttttgaacttgtaaatatggcagaaaaaataggcctagatagaacctctgtatggacttttgctaggcctaatacagaaaaatattcttctataactagagagaattttataggattaggtccaggagctgcctcattatttgatgataagtttagattaaatactttctcaattgaagaatacataaatgcagtaaataaaaatgaatttccttgcgccttggtgttaaacttcaccaaattttcaagaaaatcttattggttattttggaatgtttacaatatgaatttagataaagagctttataaaaagatgtttgatagtgagttaagtaaagactatagatttgaattgagtttagcaaaaaaaatgaatttattgaaggaagatgagtttggatataaagttactacaaaaggttcttattatttccatgcagtagagcaaatttatactttgcaatatattgataagacatggagtattgcacaaaataatccatggcctggcaagataaaattatattaaatagtgggtattattgttgtgaagcatatccaccattaaaattcacgtaaaccatattgataaaagaatcaatatggtttttatttttagaaagaatcatttaattataaacaagtttgctcgacgatgtattaatttattgaatacaataaaaaatttaaatagtatttgcaacaatatatattttaaaattgtatttatatatgaaaggaaaaagacataaatatttattggaggtaaaattatgaaaaataaaataagtatactagtagcagtattattagtttcaataagtggcatcttagtatttgcagacaataactcatcaaataataaacaagattcaactttagtacaaataacaccagaacaactagacgttatgggaacaataacaaatataaaacatgaaggagataacataataataagagtagaagctgttaaagatgagaacattaaaactggaatttctacactagacttaaaaccagaagctagatacgatatagcagacgttataataaataaaaatacgataatcaaaaaatcagactcagataaattacttaaagcatcggatataaaacaaaatcagagagtagaagttaaatttgaaaaaatagaaggtagatcttatccagtatatgctaatgcatatagtattatgattactgatatgaataattattaaaaatataaaaaattctaaatatttacaatactgtgaaattgtgctataataatttataataaataaaacttaatataaattacctcatctaaaaaaagattgaggtagaggtcgcatttgctaagagtaatattgaagaggtaggaatccaatgactcaatataaaaggagtaagtgccgaagtgctagtgtccaaagctagtgctgggactgtatttaataagtacagtactgtcatcaaaattatcccgagttttgatggagagctatcttaagtaagatatagggaagatgtaggtatgttgtatttggcatattcagctcaacatgtactcatgttgagcttttttaatatatgcgtgaagcaaacttttacatctatataaactaagatagagaaagggaaaaagacaattaattgtcttacttaaaaaaaatggggggagattaaaaatgaacattttaagaaaaagaaagtttactatgccaaatacacttactataatatttttactaatagtagtaatggcaattcttacttggatagtaccaagtggaagttttgaaagagaagacatagaaggaagaatggttgttgtagctggaacttatgaaaaagtaaaatcaaatccacaaggggttacagatgtatttacagcacctataaatggatttatagatgcagctgaagtagttggatttgttttaatagttggaggagcttttggaatagttaataaaacaggagctatagaagccgttatagctcatactgtaaacaaaatgaaaaaattccaattcctaataatacctatatcaatgatactatttggattaggcgggacaacgtttggaatgagtgaagaaacactgcctttttatatgatatttataccacttatgactagcatgggatatgattcactaacagcagtggcaacagtttttataggagcaacagctggatttggagcagctactactaatcctttctctgtaggaatagcacaagcactttcaaatatagcaccaggttctggaatagagtatagagttattatgtttgtaatattcatggctataagtatagcatttgttatgatgtatgctaataaagttaaaaaggatcctacaaagtctttagttcagaatatatcattaaatcaagaagcaatagatagtagtgatataaatataaaagagtttacaaaaagagaagctatggtaatagcaatttttacaataggtatggcaactatggtgtatggagttttacaattaggttggtacatcactgagattgcaatggtatttacagctataggtgtaatatcaggattagcagcaggacttaaacaagatgaaatagttagttcgtttacaagtggagcaaaagatttaatgtcagcaggattatgtatagcatttgcacgtggaatagttataattgcagaaaatggatatataatagatacaatcttaaattctgcagcaaatgtattaaatggattaccaaaagctatatttataaatttaactttcttaatagaaggtttaatagcatttttaataccatcagcatcaggacttgcatcacttacaatacctgttcttgcaccacttggagatttagtagatgtatctagacaaatgatagttacagcttatcaatttggcataggtataactaatttaataacacctacatctggagttttaatgggagcactagcactagctaatattccttggtcaaagtggattagatttataatgcctttaattttagttctagtaattactacaatggtatttttaacaacaggattatatatagggttttaatatagcatttttagcagaataaacttttaggaggtcaataacaaagggttgcaataaatcatgaacttacaaacaaattttttgctataaacataaaataaataatatgtagtaaatatgggtttagtgagattcatttccaccatttaaaaccatgaaaatagtattggctatatagtcaatactatttttgatttaatatatcttaattatggaaaagatatgccaaaattcccaattaattatataactaaaattttcggaatacactgcaaatttttacaatatacgacaataactattgatataatatctgagggaaagagggtgataaagtgatagatcaaaatgttgtaactcgggtagaaaagaaatatgaaataaatgcatttactgcaatgaacttaaaaagcattttatgtaaaacattaattcaagattcgcataataccaatgatgggtatatggttagatcgttatattttgatacattttacaataatgactattttgacaaagaaaatggattagaatatagaagaaaaataagacttaggacatatgatccaagggcgcaatttctaaaattagaacttaaacaaaaagaaggtgaatatcagcataaacattcattaactataccaaaaaacatagctcaaagacttttagatggacactatgaagtattaaaagaactaaacaatagttttgcagataaattgtacactataatgcagactaatttatataggccaaaatgtatagtagagtataaaagattagcttatatagttaaagaaaacaatacaaggataactatagatagtgatttgaaatctagtgagtcaaatatggatatatttaatccttcactatctctaaatacggtaactagtaaaacaatactggaagtaaaatacaacaattttttattaagttatgtaaaagacataatagataatactaataaatctcaaacatcagctagtaaatattgtatgtcgagatatattagctacttataagggggaaaaaactagaaatgaaagaaatgattttaaaatactttcaagaaagtaattcatcaatgagtattgaacaggtattacttaattttttagtatcaataatattgtctatagtaatatatttggcatatagatattctcattcaaaggcagtatatagtcaaagatttaatgtatcgctttccatgttaactatagtaactactatggttatgaatgtaattggaaataatatagctctatctctaggtatggtgggggcactgtctatagttcgttttagaacagctataaaagacccaagagattcagtttatatcttttggtgtatagtagtaggtatttgttgtggagtatctgaatatacaatagcaggtataggaagtgcaatattatttatattcttacttatatttgggcatataaagtcaaatgataggtatttacttgtaatacatgcaaaggcaaaagttgaagaagaaatagaaaaagctatcttagtattttataatggtgaagctaatatgcgtgtaaaaaatactacaagtgaaagagttgaatatatatatgaactttcacaacgtataataaattcttctaaagacaaaggacatatcaataaaaaactatatgaactagatggagtagaaagcgttaacttagtttgccaaaatgaggatataaatagatgataagaaaaatattagctagtaaaagaaatctaagtatattggtagcaataggattactagtatcaagtatttcactatctatacttatagaaaaaaattctcaaaaaagagtacataatcatagacaaaaagatataaaaaatcagccaagagaatttgatatgaaagaggattatactataagtgattcttttagtactcatttgccattagtagttatagatactaatggtgaaagcccaaagtctggtgttacttgggatccagaaaaaaggtactttacaccggtagatatagatccatacgttgatggaagtataagtattattgataatgagggaagcataaataatattaaagataagcctactaataaatcagatatattaatcaagcaaagaggtaacacctcaactagatttcctaaaaaacaatatttaataaaaacaataaataaagatggaagcaaaaataagcaagatatattaggcatgggagaagaatgggaatgggtactgaatatatcttatatagataaaactctacttagaaattatatggctttaaatattgcaggagaaataatgccatatactccagatgtaaggtactgtgaagttgtaatgaaggatgatgataagtatacttatgaaggtgtataccttatgatggaaaatgtaaaacaaggagaagatagagttaatatttctaagtatgataataaatttacaaaatcatcatatttactaagaagagatagatttgaagaagatgctatatttttagataattattcaactaaaaatgagcttcccgtaggatatttagaggttaaatatccacaaaaggatgaaataacagaaaaaactatagaatatataactaacgatataaataagtttgaagaatgtatttattctaatgacattgataagttttacaagtatagagattatatagatgtggaatcatttatagattattttataataaatgaattttttgctaattatgactctggatatcattcaacttatatatataaagaaaatggttctaaaattagcatgggtccagtttgggattttgatatgtgtttagataatgatataaagttagaaaatgcattaaaagttgattctacagctatgcatgatgcaccttggtttaggcaactattaaaggatgctaatttcactaaaaaagttatagatagatataaatatttaagaaaagacatattaagtgagacgaatttaataaaatatatagatgatactgtgaactttttagggcctagtatcgaaagagataaacgtagatggaaatatgagggcgaatataatactgaaattgaaaaaattaaattagttataaaggaacatggaaaatggttagatgaaaatatagattcattataccaatttagtgaatttagtgaaaaagggataaataaaagtgaattagaaaaagcaaaagatttcatattaggtaatgataaaaaaacaatagctattagtatactatcagtaatattcataagtatatttatattatctataatccttgtacaaagagattaaaaaataaggaggattgctgtgaaaaagagtactagtataaagaggaaaattttattagtagcatctagtataactgcatttatatacatattctggagattgttttttaccattccaacacagcacggaatgatatccttaatagcaggattatcacttgcaatagcagaaactgtaggggtaatagaagctttttcacattataaaaatttaagctcaaataaagaaccagaaatgccagaaataccgatagaactttacccagatgttgacgtattaatagcaactcattcagagtcaacagaaatattatataaaacagttaatggttgtacacatatgaaatatccagataaaagtaaagttcatatttatatatgtgatgatacaaatagaatagaaatgaaaaaacttgcagataaaatggggataggatatatagggttagctgaaaataagcatgcaaaagcaggaaatctaaacaacgcattaagtaaaactacatcgcctcttatagctacctttgatgcagatatgataccacgaagtgattttttaatgaagactgttccatattttagtttaccacttatgaaaaaggataaagataataaatggataagaagggaaaaagtagatgaaaattataaaatcgggtttatacaaacacctcaaagtttttataatccagatttattccaatataatttatattcagaacagaacattcctaatgaacaggattacttcttcaaggaagtaaatgtaggtagaaatcgtacgaattcacctatatatgcaggttcgaatactttaatatctagagaagctttagaagaagttggtggtatagcgataaaaaatataacagaagattttgcaacaggtataaaaatacaaagtaaaggatataaatgttttgcaatatcagaagtattagcacatggattatcaccaactgattttaagagtttgataaaacagcgtcaaagatggggaagaggatgtgttcaaaccataagaagttttaaatttttattttcaagtttaggtattagagctaagttaagttatatcacatgttttttatattggactacattttttaggagatttatatatataatatctccaatattatattctttatttgggttacttatagtagagtgtagtgtaaaagagctaatgtttatttggctgccatcatatttactatacaatatatctttaaaatatttatctagtaatttaagaaatcaaaagtggagtaatatagttgatactatagtttttccatacttggtaataccaatactacttgaaactataggtattactcttagaaaattcaatgtaacatcaaaagaaagaatatcatcaaagaatgtagcttttaaatattcaataccccatattattttaatatttgcatcagtatttggtttagtattctcagtagaagattttattaaatacaaacatttaggtaatctagtaattatattttggttagttatgaatatgtattttctaattatggctgtatttttcatgctcagtcgtataaattacagaagtgaggaaagatattataccaatctagatgtaaatgtaagttttaatgaaagattattaaaagctactacatccgatatttcagaatatggaatgagctttacaatagatactccagagtacataccatatgatgaggatatagatataaatattaaatatttacattacaaagcaaatttaaaaggtagagtagttcatgtggataaatttatggataaatggaaatatagcatcaaactaaatcatgtatcacaaaaagataaaaatgagtattatcagatagtatatgataggggacatactttggcgaataagatgaaatcaaataccattaaggaaatcaaattaaatatgattaatagaagtaaaaaacatagggcttctaatagaaagttgccaaggataccattaaaagtaaatgttagcacaacaattggaaatatagttgaagtagttaactttaactacgagtatatactatttaaaggaaagttagatgataaaaatattaatatagaattgagagatgatttagttttaaagtgtttaaaatgtgataaatctacagtagaagacaataccttatacaaaatagatgactggaaaaatatttcaaatgatgaacgctttagagagatggtactaagttgggatagtgctatagaaaataaagaggaacttgctaatgtttgataaaaaaataagaaaatctagatttaatgtaattatacttattacattattaataagtatattgttaaatatatttttattacaaaagccaaattatagtgaattagatgtaaataaaaacagctcagataaaaatggacaattatcagtaaagggaacaaatcttgtaaatgagaaaggcgatatagtaagattaaagggaatgagtagccatggtcttatgtggtatccagaatatataaatacaagaagtctaaatacattatctgaatatggagctaatactattagattggcgatgtatacagatcaaaataaaggatatgtttataataaaaaagaatcaatgaaaaatttacttcaaggaatagaaaatgttttaggtgcagatatgtatgccatagtagattggcatacactaaaagataatgatcctaacatacatatagaagaagctaaagagttctttgatgaaatatcaactagatataaagatgaaccaagggtgatatatgaaatatttaatgaaccaaatgggaaaacttcatggaacgatataaaaaaatatgcaaatactataataccgataataagacaaaattcaccaaatgctataatccttgtaggaactcctaattattgtgtagatataaagagtgctataaatgatcctttagactataaaaatataatgtatacttatcatttatacacgggaacaagtgatggaggttataaatatttattaagtgatgcattaaaaaacaatataccagtatttatttctgaatggggatttagtccagaaaaaaatagtggagaaataaattttaaaaaaggaagagaatttctagaatttttaaatcagaataatattagttggattaattggtctttaagtaacaaagatgaaccacattcatttattagacatgatattgataaattgagcaattggaatgatgatgaattaacatctgttggaaaatttgttaaagatgcattttctaattattaaaataagtttttaaataagataataacttcacgaaaaagatattgactaaaaagtcaatatcttttttgctttagatcttaggataaaataatattttatgacaggtaaattttatattatatagaaataaaagtcaattatgtatatgtctaaaaagttttaaaaaaagtaaaattttttataacagatttgtaactaaaaacctgttgaaagtgtactgttatatgttttatactacaaaagtcgacaaaacaaattaatttaaaataaattttcacataggaggataaaatatatgttaaaacgtataattccagtaatgctatctgcaatattacttatgacaggttgtgcaaacactaaatcagaaacaaaggatactaaagaattaacaaaacttacgtattctaatttaatagatgaaaaaactcaaaatgaaataagagacatattaatagaaaataaaatagataaaaaacaagcagattattttattaaacttgtaaaaaattataatggcaaatcagatataaataagctaaaaacatctaagcaaggttttacaagtataaaaactcagcaagttccatacgatgaagtgtatttagacgaaaaatgggaccctaataaattgaactatatggattttaactgtagattaactgcattttcaatatttaaaaattacattaaatcagaagataaatttacaggtgattccactagattagtatttgataaagatgcaataaataataatcctataagtaaatttagcaaagaagatacagataaatttattaacttatattcagctgtaaaagtggaaaatacataagatgtaaataagcatgcacaagctataaaaaaagaatggcaaaaaagaaaaatatcatttgtagataataaaaatatatcaatgataaatgtatttttacatgaaccagaagataatgaagtatttgtaggacatgcaggtcttttattacaaacaaaatatggattattatttattgaaaaatatgcatcagctttaccattccaagtttcaaaatttaaaaataaatcagaattaaagaaatatttaatggatagattggataatgatacatctggtaacggttcatcaaagccaataataatggaaaataatgagttaattaaatagaataaataaaaagtctcaacttaatttatgtaatttatccctaatatttaaatctacgaaaaatactactataattttatagtagtatttttaaattataagaaaattatcttaatttagtatataatcaatatataaaaggactatacttttagttaatattatttaaatgtctaaggttggtgaagtatgggtatatcagttaaagaaatgcttgaggcagagttttttaaagaatacaaaattttagcaggcaaaaatggtttaaacaatcaaattcaaggtgtaactgtacttgatgctgatgatggatttcattggtcaagagagaaagagtttgtaattagttcaggctatgtttttatgaaaaatccaaatctatttgaagaatacattaactctaaacacttcaaaggaacagcttgttttggaattaaattggggagatttttaaaagaaatacctgaaaatattattgaacattttaataaacataaaatacctttaatagatattccatacaaagattcttggatggatataatgaatgccttaaatgttacagtaatgaataaaaatataaatcgttttaacattaaggaaataaattctaataagtctttagatttatcgtatcaagttagaaaaattaataaaattttaaatgcagttgaatatgaaatgaatttttccgcaatgctttatgatttatcaaacaataaggcctattatagttcaaataaatttaaagaagtttctaaggatttaaatatagaagacttttggagactttcttttgattatagtaaagagattttgtgcaaggatataaaaatgtcaagatataggttttatgatagtaaatatgaagctccatttagttggataacagttcctataactatagataataaagtaaaagcatactttgttgttattgaagccacaggtcttattgattattttgaccaattttctttaagaataggatttttattaatacaagagttatatgaacaaatttttgttaaacaaattatggaagatagtgaatttgaaaaattcatagaaaatattttaaatggcaaactagaagacaaagacaatataataaatatagctaatgatctaaatattagtataaataataaattttatactattgtaatgaagcaaactaacgagaaagttatcttgtcaggactaagagaaactttaaagaattgtacaagaaatgcttttggatttgaagattataaaatatcttttgtagatgataatagttgtttatttttaattaaagaaaatagtggattttcagaaaaacaaaatattaagtttataaaagaaaagttatctaatttaaaaaaacgcttggaattagaaatagataatttagaactaagttttggtatatcagatattccagactttatttatgaaacaaagaaaagccataagagggcagagaaagctattaatattggaaaacttttatatcctaaagaagagttttgttcttactcaaacttagggccttttgcttggatggatataaaagatgacgaagttaatattatgctaagagatattagcgttttattagaggatgagaagtataaagaatatatacatacattaaaagtgtatttagaatgtaagatgaattttagtcttactgctaaaaatttatatttacatataaatactgttcgaaaaagaatagaggatattacttatttactaaagatagatttagaagatcctatgaataggttgaaattagaaattttactaaagttattttattagacaagaaaataaataaataaattattataagatattcgtaatagatacggatatcttatttttttgcaaatataattaatatagtatgaaaaaaatttcttaatcattatagtaaaatgaaaatttattcatttgtataatatctgtcaaatataagaaaattatttacgttgatgtaagtttgctttaactgataatattaaatcaaaaaaaataatgttaaaaaatgataataagttaaaggggtgtttaaatgtctgaaatattaaacaaagctaaagatattgaagaatatgtaattaatttaagacgagaatttcataagtatcctgaattaagtagaaaagaatttaaaactcaagaaatggttattaaagaacttgaaaatatgggaataccttataaaaaaataggaaatacatcagtggtagctattttaaatggaaaaaaagatggaaaaactatagctttaagagcagatatggatgcacttcctataatagaagaatcaggtgttgaattttcatcaaaaacacatggattgatgcatgcttgtggacatgatgctcacactgcaatgcttcttggagcagcaaaaatactttctgaaatgaaaaatgatataaatggaaatattaaattcttttttcaagaaggagaagaaacttttacaggagcaaaagaaatcataaaaggtggaggaatggatggagtagatgcatgctttggactacattgtatgcctgatcttgaaactggatatgtaaatattgattcaggatataaaatggcaggttgtgatactatttatgttaaatttgaaggagtatcagggcatggatcttctccacatcttgcaaaagatactatttatcctgcttgtgcttttgtttcaggattacaggcaatagcaactaaaaatattgatccacaagagccagtagttcttacagtaggaaagtttataggaggaactaaagctaatataattcctaaatatacaaatcttgatatatcaatgagatactttaaccctaaagttagagaaattgttcaccaaagtataaaaagacatgcaaaagcaattgcggaggcttatgaaattaaggttgatgtaaatgtagaggaaagtgcaataagtctttataatgatgaagaattatctataattgcaaagaattcagctaaaaaagtatttggtgaagggaaaaccgtatccgggcctaaactaatgggatcagaggattttccttattacttaaaatatgcaaaaggagtatatgcatatcttggatataacaataaggagaaagatagtatttactatccacatcatgaaaagtttaaaatagatgaagattgttttaagtatggtacagcactacatgttcaatttgctttagattttttaaataaaaactaaaaataattttataaggggataattcaatgggatcaaaaagtgttggagttaagaataatgacattaagaagatagaaaggtataggtgggtagtttggttaatattagcatctgtatatatatttgtaacatttcatcgtatgggtgttggtgttgtaaaaaatgatttacaaaatgaatttggtattggagcactagagtatgcaaatataggttcaatgtatttttacgcatattttcttatgcagataccatcaggaatacttgctgataaactaggtcctaaaaaaacagtatcaatgttttctatattagctgcaataggttctataacttttggtatggcacctaatataaatgtcgcttatgtagggcgctttatggtaggaataggggtatctgttgtatttatatgtttggtaaaaatacagtcgcgttggttttattcaaaaaactttgcattaatggttggtttatctggagtagttgcaaatttaggatcgatgttagcacaaactccactagcactagtttcagcaaaatttggatggagaaatacttttatttttatgggagtagcaatggtatttttcacaatcttaacccttatatttgttaaagatgatccaaaagatatggggcttccaggaatggatgaacttgagaatagaccgctagattcatctaatataaaagtcatgccagcattaaaatcaatcttatcaaacaaaagaacttgggttatatctattgcatacttcggtttatcgacagcatatactgtatttatgggtacatacggagtttcattcttaatagaaaaatacagtttaacaaatgtacaatcagcaaattatgttatagtgactatatcaggtgcacttgtaagttctttagtacttgggcaaatttcagatcactttaaaagtagaaagctaccattaactattgcaggaactttaactttattatgctggatagcacttgtatatgttgatatacctattaatatccttgttccattcttatttatatttggatttgtttcatcagcatttactatgtgttggacaatgggaaatgaagtaaatgacagaagactttcaggtatggctacaggtgttgtaaactgtgtaggatttttaggtgcagctgttgttccagttattatgggtaaggttttagataattatcaagatacacctttagttggttatgaaaaggcatactttgttttaattatgataatagctgtaagtgttgtggcttcgtttttcacaaaagaaacaaatgcacaaaacatatatgatataaaataaatcttaatcacagatgatttttatctatagtatcaaacctaatgtcgaagcttaatctttggtatgatatttgagatttatatatactatttaaatatacgaaaagacattgattaaaaaattaatgtcttttttatgttgatacaaacttattcaaattataatttataaagctatacaactagaattatattgcagttttgatatataattaactttagtaagtagcaagacaataattgggggaggacataatgttaaaaatagcaatatgtgaagacgaagtaaaacaacaagaaatattagaacaatacatagataaaatattaacagaaataacaaaggactatgaaatactaacatttacctcaggagaagagttacttgaaaactatcctgaaaatgtagatatatttttactagacataaaaatggacaaactaaatggaatggaaatagctaaaaaaattagagaaatagacaaaaaagaagtggaaataatatttacaacatcactagtaaaatatattcaagatgggtatgaggtaagggcatatagatatttactaaaaccaataaagtttgatgatttgaaaaaacatttgacatcatgtataaaagaaataaacgagaagaaagagaactatatagtggtaaacggaaaaaatgatgtttacaaaataaatataagtcatattacatatatagaaattcaaaataaagatatgacaatacatactatagataaagattataatataaaaatgagtatagataaaatagaaaaagagttaagtagatataattttttcagatgtcataaaagctttttagttaatattagttatattgaaaatataaaacaatacatagcaatccttgaaaataaagatgaagtacctataagtcgttatagattcaaagaaacaaaagtcagatttttaagctatataggaagtgtattataatgggagaagttttgattttatcaataataatgaaaaacaagttgattgtaatgaaaataatataaatttattttgtgatattaatttttcaaagtgtaattttatagaaatgatagatgtatgtagcatattttcaaatatactagataatgctatagaagcttgcaataagataaaaaatgatgaaaaatatataaaaataagaggaacttttgtaaaatcatattatgttatacgatgtgaaaattctaaagtgaataaaataaaaataaaaaataatagaataataagtagtaaaaaggataaatttattcatggaataggtttaaaaagtgttaaatcatcattgaaaaagtatgatggagaattagaaatagaggatttcgaagataaatttttggtacaaatttatataccgatagataaaaacatgacagttggggtttaaaaaataccagttgtactatagatattgaagcaaaaaaagcaaggtgttatctttaaaacataaaagataacgccttatttttttgcaaaaaatttattagtaaagtgtgatataaggggtgtaattataaaagggaggttatattttgaagcttagtttaaaattagcgattgcttatatgaaagaacaaaagggaagaactattgcactaataacaagtatagcattagcagtaatattagtacttacgttaaatgtcataccagaaacacaaagtaaactagaaatagaacaagcatataaaaattttagtgactatcatgttgagtacaatggattaaaaagtgatatagtgaataaattaaaaaaagataaagaagtaactgaaattaatgatattttagggctggggaaaatcgtaggtaaaaatggaatatcattacaattaaattcatgtagtaaaaattttttacattcttatggatataaattaataaaaggaactacgcctaagaatgcaaatgaaatagtgctagaagagaaagcattaaaagaaatgaatttgaaggatgatttaaatcaagaaattgattttaaaattgtaaaatattatgtagataaaaataatgaaaatcaaatatttagcaaggataaaaaatttaaattagtgggtatagtaaaaaaaccagagggatattatacaaattcagatgggtacacaaacgaaaatgaatattatgaagtgaaggcttttacaaaagataaccctaatgaagaaattttaccaaataacttagtcactcataatggtacattgtatctaaatacatctaaacctgatattggaaagatctatgaaatgataaacaaatatggtttagatgaatcaaattttagtataaatgcaccattaacacaagctttaagtaattatgagatgtcaaaagaaactctatatacaaaaagacaaaagttatatcctatgttgtcagcaaccttagttatatgtaatatatttagcattgttttaatagatatgacaaaacaaataggaatattaagagcaataggtttatctaaaaacaaagtaaggcttatgataattatagaaagtattgtagttttatcattaggacttttatgtggatttttattaggaatattagcatcttatttaggctttgctattatttatggaaagattgtaaacctgtatttaagtaaagctagtatattagaacctatgataatggctagtatagctgtgttaatatctagtttagttccaatatataaaagtggaaaaatatctccaatagaagcaattagaactagtgataaaatcaataaaagacaaaaaaatagattttactataaattaataagaaaaatatttgggtttaccggagagatggcttataaaaatttatggagaaataaagttagaactatattatgtgttatatctataagtttaggtggggtgctttttatagatacgatagctatgggaaagagtgaggataatagtttagacaatagtagtatgcctgttatgatgatgggaaagagtgatataaaattagctcacaattttaataatgcagattctaattttacaaaatatagtaaagatgaaatagaaaaaatttcaaagataaatgaagtacaaagtttaaatccaattatggagttaaatggatattttcttataaattctaataatttaacaaaaaaatataaaagttcaaagggaatagatgatgaaaataaaaaattagaagaatatttagaagttgaaggacacagtagtgatagtttaaaaaatttagataaatatattgaagagggaaaaaacatagataaaaaaagtaaagaaaaatatccaaaagctttagtaacaaattatttttattctattcaagatgcatctcctcatactaagttacttaacaatattaaagtaggagacttgatagatataaaaataccagttataaaaaataacaaactagaatataaaaatgaaaaagtagaagttgctggaattttaaatggagactatgtattaaaagaaggtggcctttcaggcggaatgaaagttgttttaaatgaagatgattttaaaaatataagtgggcgagaaaattacaataagttaaatattcagattgaaaaaggtagcgataaaaaagctgagaatgaaatagaaaaggttataaaaaacaacccattttcaaaaattgaaagtaagtataattataaaaacttctatataaaacaaactgaaaaaaacacaaaagaaacattagtaattgtagctttaatacttttaatatcttctataaatatattatgtataataaaagctaatataatgactagaatgaaagaactttcaacattaagagcaataggtatgagtagtaaaaagcttaagaacatgattataaaagaaaatataatgtatgcaatatttgtatctatagtatcgagtgtatttgcaactcatagtatttacgaatttacaaaaatggtgaatgaaatacacaagcaaggattaggtacaaatgaggctatgatgtttaaattaccaatacttgaaagtatagagttcttaatagcatctatagtaatgtgtttaatagcagtatttttatgcaaaaagaaaatagaaaaaataagtatagtagaagggttaaatacaaatgaataaaggtggggattttgtgatgaatatattagatataataaatttaaataaaacttatggtaaaggtgaaaataaagtacacgcattaaaagatataaatttatctatagaaaaaggaaaatttacagctataataggtcctagcggaagcggcaaaagtagtcttttaaactgtatagcaggattagataatatatcatcaggaaaagtttttttaaatggaaaagacatttcaactttaaatgaaaataagttatcaaaattaagaagcgaagaatttggattcatatttcaaagctttaacttaataccagttataaatgtatatgagaatatagtacttccaatatcaatagatgataaaaaagtagataaagaatatataaataatataattgagaaattaggacttaaagataaaattaataaatttccaaatgaattaagtggagggcaacagcaaagagttgctattgcaagagctttagccaataaaccaaaaattatttttgcagatgagccaacaggaaatttagatagtaaaataacagaagaagtaatggatttattagaaagttgtgttaaaaaatttggacaaacattagttatgataactcataataatgaaattgctaaaacagcagatgtttgtattgagattaaagatggagaaatagtaaaaaattcacagaaataatcaaaaaaatagctaagatagaaaataactagattttctacttagctgttttttgttcccatcttaaatcatttcctataaacttaaccattctaaatctatcaaatactctagaaaatattctttgagcataaatatcgcctaattgcataggtgataaattagttgaaattatagttttctttcctgataacaatctagtatttaagatattaaataactcactgttagtaaaagaattagtaagttctgttcctaaatcatctataattaataaatcacaatcaaataaattattataattatctttagttatatgatcatgtgtatttttaaacttatagtcttctataatctcaaacattttaaatgcagtttgataaataactaaatgacctttatctaaaagttctttagcaatacaattacacataaaacttttacctaaaccagtatctccatagaaaagcatgttttcatcattatctttatcgaagtttataacaaacccttcacatatagataaaatttctaatatattttctcgtggagataaaccagaagactcatctctttgagtagagaaaatagagtcatcaaatgttgaaaaattttgatgatataaaactcttgataaattagacatattataagcttcatttactattttttgctttaagcaattacatttatgtccatttgataaaaaacctgtatctttgcacataatacaatcatgtttaaggtttagatatccttttggaactttattatctagaagcataagttcttttttttgttttaattcatccattcttaacttagcttcatttaatatagattctttatcatttggatttaacaaaactaatttagcaagttttaagcctatttggcctatttcatcatctatatctttaatttcaggtattctagaataaactttcttttttctttcatttaattcacgttcagattgttctctttttctttcataggaagtaagtatttctcttaatgttgactctttcatgcaatcacctacctaaaataaattatctaaatttacctttttgactttcttgaagtattttctctaattcatcaggactatatttagtaaaagtctgatttatattatggaatctagttttaacttgcttagcattatttttagattcatttgaattagctctttttatatctgatttacgtttaaattcatcttcagatactcttaagtcttctaatgttttaatatttttttcattccaacttttaactataccattaatataagatatagaaggattagagatatttttagacttagaacaagcttctaaaataagttctatatcaaatttatatttatcaaaccaaatatccataagttctttctcagatcttgtaggttgtctagaaaatccaagttcgttaaatactgttttatacatcataaatcttttgcttctttcagcaaaactgttttgtacttcttcaggagtatacagattagcatcgtaccaatttctaataattccttctatataacttactggtttagatgttcctgtttgctctttaacatgctcataagcacataatatcatatctgtactcatattatacttgtccatcatatccaagattgagattttttcactaggttgaagatgtctaccaataacttgatttatacaattaaacatttttctaacttgaagattttcacctgccgaaacaatactattaacgtcagattttatagagtgattcggatttaatatattatccatatatatttttttcaaatctaaaaattctattgaaaaattaaaatcatcactaccttcatttttatgctttttaactaattttttttcttcccagaaatcccaagctgctaatacatcagataagggtatatttaaattccttgcaatagaattattattaaatttagggttagaagtcatatcgcaagcatatctaaatcctaaaagataaacttgtacgtataatccattagccattggcataaatatatctataaatatgttatcaatagtagtttggcctaaatctatttcattgacttctttaaaaaacatttcatcacctcaaattgattatatcataaaatctattacaaatttatgatgtagataattaaaaaaaatattcattaaacacaaaggggaggaatttaattgattattgactttagaaaaaagactagaatatttatatctttatttatggtaattactatttttatgggaggtatagtttattttaataaagaaaaatatacacaagttttaaacattaaaaatgaagctaaaagtagttatactatggatgtaattcttgaagatgaaagtaaaaggttaatgtgtaatcaaaatataaagtacataaataatcaaaataaaaatctaaaaagtttatattttcatatatacccaaatgccttttcaaaggaagaatttacaccatttgaggaatcgcaaatgaaacaagcatatccaaatggatttaatgaaggatatatagatattcaaaatatattaattggagataaaaaagtaaaatacactataacaggtgaaaaagaagatatcttagagttaaaattagacaaaccactaaagcctaatgagacagtatctatagatatgaaatttaatgtaaaaattccaaattcaataggtagatttggatatggtgataatacaataaatgttactaattggtttcctattgcatgtgtatatgatgataaaggatggaataacaaaagctatgaaacaataggagatccattttatagtgatactagcgactttaaagtgacaatattagctcctgctgagtataaaattgggtccacaggaaaagttactgaatctaaaactgatcataaaaagtcaatgcatacaattgaggccaaaaatgtacgtgattttgcttttatactaagtaaaaagtttaatgtaaaaaaagattatgtaggagatacagaaatagtgacatacaatttaaataataaattttcagatttagctactaaaatatctaaagagtctatagagatatttaatgatatgtttggtaaatatccttataatatatattcagttatagcaagtgatttttatatagggggaatggaatatcctacattgtctatgatagatgaaagtttgtatacaaataaaaacaagtttttattagagtatgtaatagctcatgaaacagctcatcaatggtggtatagtgtagttggaaatgatgaagttagtgaaccatggctagatgaagctttgacagaatattcaacaatactatactttgaaaaaaaatacggaaaaaatatggcaaataatttaatggatactatggcaacacaaacaaaatcttattctagtaaagacatttttaaaccttgcgatcaatataaaaattcaacagaatatagtttgaatgtatatactaaaggagcagttatatttaatagtataaggcaagaagttggagataaggtattttttaatgttttaaaagaatattacaatacatataaatttaaaaatgcaaatggagttcaatttgttgagttatggaaaaaaaacggagtagatatagaaaatataataagtaaatataagtaaatttaaaatagagccttaaaaaattttttaaggctctaattttttggtataatataatctatgattattagagaaagaggtgaccgcatgctagaatatagttctataggaagtgggagtagcggaaattgtcattatattggatataagaatactaaggttctagttgatgcaggccttagcggtaaaaggataacaactaatttaaaagatttagatatagatataaacaaaataaagggaatatttataacacatgaacattcagaccatataaaaggtgcaggaatattatctagaaaatttgatatacctatatttgcgaatgtgaaaacatggtgtgcaatgaaagacaagataggggatataaaagataaaaacatgaaagtttttgaaaatgataaaacttattctttagatgatttaataataagaccattttcaacatcacatgactctgctgattctgtaggatataatttctataatgataagcaggaaaagatatctatagcaacagacatagggtgtataactgaaaatctaaaaaagcatttatataaatcaaaattagtagtattagagtctaattacgaccctaatatgcttatgatgggatcttatccgtatgcattaaagaaaagagttatgtctgaaacaggacacttatctaatgaagaagctgcaaagttttgtgtggaactagtaaatcaaggtacagagtctatattgcttgcacatttaagcaaagaaaataacttccctgagttagcatatgaaacttctaagggggtattattacaaaataatatgataattggacaagatcttaagttagatgttcttttaagagaagatgcatcagatatatatagattataatgattggagaaatttatgaatataactgtaataagtgtaggaaagcttaaagaaaaatacttaaagctaggcatagaagaatttagtaaaagattatctaagtattgtaaattagatatgatagaactagatgatgaaaaatgtcctgagaatttaagcgataaagacatggagattgttaagaataaagaaggtaataaaattttaagtaagataaaaaataatagttatgttatagctttagcaatagatgggaaaaatttatcatctgaagaattagctagtactattagtaacttggctgtcagaggcaatagtcatataacttttgttataggtgggtctttagggctttcaagtgaagttttaaaaagagctgattataagttatctttttctaagatgacattccctcatcaattaatgaagttaatacttttggaacaagtatatagagcttttaggataaataataatgaaccgtatcataagtaattgatacggtttttatttatagttagactttaataataaatatagaactaattgtaggattatactaaaaatttatatattaaaattagtagcactctccttataaatgaatatcataatattggggaggagatgattaaaaatgagttcaccaaaaaataataatagaaatgtacaaaacttacgtgataaatgtgaaagatttataaattatcatactatgtttacaatgcaagatggaagcacatttgatggaattattgaagggttagatggtgattgtgttattgtgttagttggtgaagatgtaatagaacaagaaggtgcaaatcaatctaatttacaaagacaacagggacgccctagaagatttagaagatttagacgtagacgtatcccacttgctagtttacttgcattatcattattagcttatccttttatcgcaccaccgtttcctttttagacattgatatttaaaatataaattagaattacgctaacaaaactgcatcactaattggtgatgcagttttgctatcgtgaaatattatttaagattatatatactagattttagtttaagtatttttgagtactaataattattaataaagtttattaataattattagtacgtttacatatagggtataaatttaaatatagatattaaatttattagagatagggtgaagaatatatgaagattaaattatatgtaaattggatagatagatgtgatatgacattagaaagtatggaaaattatactgataaaaggtaagcatttttcaaataaaattataggagaattaattaaatggaaatcgtatattttattgttgcggctttttctactataataggatcatctgtcggattaggaggcggagttataatcaagccagtattagaaactttaagtgattattctcttcctacagttaatttattgtcatcttcaactatatttgtaatgtctatagttactgtgttttatcaattaaagaaaaaggataagataaatcttaaaaatacaattgtagttgctctagggtctatagttggtggagttataggacaaaatataatggatattatagcaaaaaaagggattaatatggggattgttagtaatatccaaaatataattttgatagttatattaataattgtttttatttatatgaaaaataaagataatataaaaaactataatataaataatattttattaattggatgtttaggaatatttttaggatctatatctgcatttttaggaattggaggaggaccacttaacgtagctgcttttactatattattttctatgtcaacaaatgaagcagcaaggaactctataatagttatatttttctcgcaagggtctaaaattctttcagtggcgctaacaacaggattttctagctataaactagaaatgctgccattgatgatgattggaggagttattggtggaattgttggttataggataaataagtctgtttctgaaaaaaatataataacaatatttgatactgtacttataattatagttttattaaatgtatataatatttttaaataaatcattaactttaagggttttactaagataaattcaatgaaagtttgtcaatattaaaagactatgatattatataaacctatgaataattaggaataataatgaacggaggatattaaattatggaaaatttaccaaattgcccaaaatgtaattcagaatatacttatgaagatggaagccttttagtttgtccagaatgtgcttatgaatggactttagaatcttcaaatgaagaagaaaatgttataaaagatgtaaatgggaatgtattaaatgatggagatgctgtaacagtagtaaaagaccttaaagtaaaaggtagctcatcatctataaagataggaacaaaagtaaaaaatatacgtttagtccctgatgcaacagatggacatgatatcgaatgtaagatagatggatttggagctatgaagttaaagtctagtgttgttaaaaaagcataatttaatttaacaacataatcaaaatctacaatataaaagcactaatcttttaaaagattagtgcttttattatgatattgggtatcacgctaagaattaacttataacgctaccttataccgtaattattatatttctagtataatatagtaatagacttgaatcaataataaatgataaaaaataataataaataataataatgaattaaagtgagaggtgaagcatttgtttttagaggaaaggtatgaaaagattattgaattaattaaggtaaatgggagagtgaaggttaaagatttatctaatttatttgaagttacacaagactgtattagaaaagatttaaaagagctagaatctagaggacatttaaaaagagtgtatgggggagctattctacaaagaaattatgatgagattaaaaatattgataaaagaaaaaatattaatgtagaggaaaagaaggctatagcagcaaaagcaattagtttgatagataataatgacataatatttttagatgtttcaactaataatttagaaattgcaaaggaattaaatgaaacagataaagaaattacagtagtgacaaatatgatagaaattgtattagaattaagaagtaataagaatataaaagtaatttgtattgggggagaatttaacaaagaagtaggagctatagtaggagctgctgctgataggtatataagaaactttatctttgataaatcatttataggattgtgtggtattaatatagaaacaggatatataagtacgattaatttagaagatggaaatactaagagaactataattgaatgctctagtaaaagttatttagtaatggagaatgagaaattcaactatgaagaattttataaatttgctaatttagcggaagtagcaggtgtgataactgaagataagataattaatgaaatttaaatatttagtgactactaaatttataaatatatcaataattgtataaataaaaaatacatataataactatgtatgtgattttctaaaaaatttgcagatgccaaaattttaaatactagaatagttagataatatgaaagttttaggtaggtgtttatatggagatatttgcgataggacattctaattatccttatgagaagcttattgaaatgataaaagagtatggtatagactgtgtagtagacataagagaaacaccatattctaaatataatactcaatataatagagaagtattaagagaaaatttaaaatctagtggatttacatatgtatatatggggcatgaatttggagctaaaaggcagactaaagaatcatataatgatgatgggtatgcagattttgaaaaagtaattaaagaagagttatttttgaaaggaattgaaagaattacaaaaggtctacatatgggttataaaatagttttattaggagctatgcaagaacctataagatgtcatagaagtataatgctagggaaatatttaaatgaaaaaggttttgatgtaaaatatataatgcatgaaggtaatatagttaatcaagattatattgaagaagatttgcttaataagtattttagtgatagaaatcaattaagtatagatagtttgttaggaactgataaatcaagagaagaaatgatagaagaaggttataaattagctaataaagaaattggatatagaacagaaaatatagggaaataaatattagataaaattatagtatattgggggatagattatgataattgattgtatggattggcattatagggataattatccagatagattagataaagtgcatgcagcaactcatataggtatatttatagcatggattattgaaaataatttagaaagtgaaattttaagaaaagattcatataatgatatacataatctacgagcaagaaaaataactggtagagagtttttcttaaataattgtaataagatatttcaagataagtttatagataaaaaagctttggaatttactttaggatactatttgagtagcagagaagattattgtcaatatattgctgattataatgaagtttttaaaaatgataatataaactcatcttatgaagtaaaagatatatgggaaaattactatagggtattttcgattatagataagagatataatgattggaaaataaaaaatgaatatatttaagtaaaaagactatcttaattgcttatttagaagtagacattaagatagtcttttttattaactaagcatgttgtaagttttctttacctatacctttttcttttaatttttctatcatatcagtagtcattttacttaaatcatagtcaaatttaaatccccattcatttatagcacaagatgcatcaatagaatttggccaagattcagctatagattgacgtactggatcgacattgtatccgaattcaaattcaggtatatgtttttttatttcagcagctacttcttctggcgagaagttcatagcagttatgttaaatgcatttctatgaattaacttagaactatcagcttcaagtaaatctacaacagcttgaagggcatcaggcatatacatcatatccattttagtgccttctgctataaatgagtcatattttttattttttaatgcttcataatatatatcaacagcataatcagtagtaccaccaccaggaggtgttacataagaaataagtccagggaatcgtacacttcttgtatctactccaaatttattaaaataataatcagctaataactcaccagctactttagttactccatacatggtattaggtctttgaatagtatcttgaggtgttaaattttttggagagttaggaccaaaagcagctatagaactaggtgcaaataaagtagctttgatttccttagaaacttctaaagcatttaccaaaccacccatatttaatttccatgcagattgaggtttttgttctccaacagcagaaagtaaagaggctaggtggattatagtatctgcattatgttttttagccattttccccatagattctatatccataacatttaatgtttcaaataaaccattgtttgaaacttcactatcttctgctatacgtatatcagtagctaaaacattatcttttccatattcttttctaagtttagcagttaactctgaacctatttgacctaaagcacctgttataagaattcttttcatttaatttccccctataaaatataattaaaatatttattttataactcctaattctttacctactttttcatatatagctaaagcttcatctaacatttctttagtgtgagctgctgttggcatatttctaactcttccagttccttttggaacagtaggaaatactatagatttagcatatactccttcttctaataatcttttactaaatagttgagttttagtttcatcacctatgatacaaggtgttataggcgtttcactatttcctatattaaatcctaaagattttaaaccagctttaagataatttccattttcccatacctttttaactaaagtatcatcattcataagtatatttattgcctcagtacaagcagcagcagcacctggagttaaagatgtagaaaataagaaaggtctccctctaacttttaaccaatctattaaatctttagaacctgcaacatatccaccaacaacacctatagctttagataaagtccctatttgaaaatcaactttatctgacaccccaaagtgtttacaagttccagctcctttaccagttactcctgaaccatgtgcatcatcaacgtaagtaattaaatcaaattcttcagctatttcaactatttctggaagtttagcaatatctccatccatagagaaaacaccatcagttataaccataattttattataaattccactttctctagcttctttagctttaacttttaagtcattcatatctgaatgtttaaatcttattattttagaaccggatagtttacacccatctatgatagaagcgtgatttagttcatctgataagattgcatcatttttatccattacaccctgaatagcacccatattgcaattaaatccagattgaaaagctattgcagcttcagtacctttaaatttagctatagtttcttctaaaatatcatgtatctctaatgttccatttattgttcttacagcaccggcaccggcaccgtatttttttgtagcatctatacttgaatttattaatctttcatctgtagctagcccaaggtaattatttgaagataaatttatcagttttttttcatttattgttatgataggtccgtttgaactttgaagggagtcaattttattatataagcctttagattttaaatcatttaggtttttattaagaaaagtagataaagctttgttttttgtacttgtatctgaactcatttattatcctcctcaattatattactatactaatataattttaagttttaaatttaatagttgtaaataataatcgaaaatcaaataattgtaaaaagaaacataaatgacaattaagaaacacaatcataaaataaaagctaaattaacaaaaaaagtatataaaatattcatccttatactattaaaaatataaaaaatttgatatgctattaattgatttgcaaaacaactttaacaataaaggaaggacattataatatgaataaatttaattttattaagggattaaaagagtatgccattgtaactataggtgtaattttagtagcaattggaatacagtatttttttgcaccaaataatatagctggtggaggcttaagtggtttagcacttataataaactactatatacccaaactatctataggtactataatatttttaggaaacttaatattatttgcaatatcatttatagtaataggcggagattttggattaaaaactatatatgcgagttttatgctatcagtagtgatagagtttatggataaaatattaaaatcaacagcgttaacaacaaatttattagctgctgttatactgggaacgttagtaacagcaataggtttagctatggtgtttgctattaatgcatcaactggaggaactgatatactagctaagatattaaataaatacacaacatttaacataggtatatcacttttaatagtagatttatttgtagctattgtaggaggatttacttttggattagaaaaaggtatatattctatgatggttatagttttaaatggattattgatagatagggtaatagagaagatagaaaaaaacagaaaaaataaactaactgaagaggaagagactacaaaaaaagtagcatagttattaaactatgctacttttttttataaataacttgtgttaatttcaaattttcctgggaaatatttaaataatgaaaggaaatttgtttcacgaaaaaccataatataaataaaaaattcttaagttaaatcttaacttaagaatcaacataactagtttttgtataggagatattaaaactgtgtaaatgtgtattacttagtaaggatatataaaagatattttcaagaacgttaataaatatatatctgtatttagtataaaatacacagtttttaatcatagaatatctccgcaaattaactagaattacttgaataaatattatcacaaaaattttaaaaaaagtgaaaattggactaacattgcttttttatggagtgaaatgattaaatattttttatcttatctttatcccatataaataattgatttgaattatttaatgatttaaataaatttcttttaacattaggtatatcaacattaagtttttgaatcaattcctttatattttgtctattagtatgaccatcagcaggacatggattttctataactggataattataatctctagttacttttttaatcatatactcatctatatataccataggtcttattacagttaagccttgtctatcaaggtatgtttttggagaaaaacagctaactcgaccttcataaaacattgacattaaaaaagtctcaacagcatcatctttatgatgacctaatgcaactttattacatcctaatttttttgctgtatcgtttaaagcaccacgtcttaagtttgcacataatgagcatggatttttttctttccttatgtcaaatattatttcctttatatttgtttggacttcatgaaactcaacttctaaattcttacataaatcatataatggagaattatcaactccaccaggatttaaagttattgctataagttcgaatttttgaggtgaaaattttctataattatttaaaatatggagaagcgttaagctatcttttccaccagatagacctattgcgattttatctccatcttgtatcatatcaaagtcatttatcgcttgtcttgttttgctaagtagtttttgcatgtatatattcctcctaagaatatagattattcattaaaaacttattatatcagactagaatttttataacaatcacaacaatatatatttaatttaaagtatgttttctattaaatattaaaataataagagtaaaaaattaaaataattaaatttatatagtatatacaatttaataaaaatattgaaacatatatgttaatgaatctttagaaaacgatatcaaaaagtttaaataataaaaattttctagaaaatattgcaaaacgtcaaaatatgtgcttttttgtctagaaaaggtgtatatctttgtgttaaaatatgaaagtgattcttatgggagggcgaaaacaaaaatggcaaataatacacaaccatatgctttagtttttggagtatcagtatttgatatcttcggatttacgcataataattatagatgtaatgattcaaatccaggaaaagttaagacttcttttggtggagtttgcagaaatatagcagaaaatatggcaagagtaggaataaatacgaagttcatatctatattaggtgatgatgaaacaggaagaagaatgatggaacattctaaagttatgaactatgatatggaagattcattagtaattaaaggtgaaagtactcctacatatatggcagttttaaaccatgagggagaattagaatcagcagttgttgatatgaaaataacagatatgtttactacagaatttatagattctaaagctgatataataagaaattctgagtatatgtttttagattcggataaaccagacatagttgaatatatattaaagacatttaaagatcaaactaagtttgtattagatccagtgtctgcatgtaaagctaaaaatataaaacacttaataaaatatttccatactataaagcctaatagatatgaagctgaaataatgtgtggatttgaaataaaatcagaagaagatttaagaagagcaggaaagtattttatcgacttaggaatagaaaatgtatttataagtttagatgaagatggtatatactacaataatggagttgaagaaggaactataaaagctaataatgttcctgttgtaaatgttacaggtgctggagattcatttgtagcaggattaggatacggatatatgaaaaatataaaattaaaagatactgttaaatatgcagtagctatgtctgttttaacaatagctcatgaagagactatccatcctgaaatgagcgatgccattgttttagaacatatagaaaaaattgattggacggaaaaagaatactaaaatttatataattaaaatgataaaagctatagatttatgcaattacataaacctatagcttatttatttactaaagactaaactagaatgcccagtttccatctttgaatatttgaaccttttcaccgttagctttttcacctattatatccatatcagcagaacctatcataaagtcaacatgagttatactaaagtttataccgtgtttatctaattcatcttgtggtatatttactccattttctatacaactcttataagctgtacctattgcaaagtgacaagatgcattttcatcatataaagtattgtaaaatactatatttgtatcagatattggcgatttaaatggaactaaagctacttcacctaagtagtgagaaccttcatcagtatctattaatttagataaagtttcatacccttgctcagcagtaaagtctactatttttccatctttaaatgttaatgtaaagttgtttataacatttccaccataaaccagtggtttagtacttgcaacaacaccattaactccaaatttatgaggtaatgtaaatacttcttcagttggtatgtttggattaaagtttacgccattagggtctttagaagcaccacttgcccatatatgaccttctggtaattccatagttatatctgttttaccagatttaaagtataaagttttaaatttactatcatttaaaaagttcattctaacttttaaatttttattatgttgattccaagcttctataggatcttcttggtcaactcttgtacaatggaatattgcttcccacattttatctatagcttcttcttcagaaacaccagggaatacttttttagaccagtttgctgtaggtacagaaactatactccattttgatttatctgatagagtataagatctccattctttaagtgcttcagcagaagctttttggaaatttgctactctttgagggtcaacatcttttaaaagatctgggtcttgagcgtatattgttaagaatgctcctccatttttagctatatcaacatattggtcagatacccaagttgggaactcattgaaagtttcttctggagcatttaaatattttataagagtacattcttcatcagaccactctacaaatacttctttagcacctaaatcataagctttttttacaacctttcttacaaaaggagcacattcaataggagatctaactaataacgtttgtccgggttgtatatttaccccaactttaactgataattcagcatatttttctagatttttttctaaattcataaaggtcacatcctctcaaaaatttacattaatgtaaaaatatattcattcaatttaagtatagcaccatttctatgttactccaaaatactttttattattaaataaaattgtatttttctaaaataaaaaagaattcaaaatattcatgcatactacttagtaatataatttttaaatacccatttttgaaaaatttaacaaaataaagtaaataatgtaaccatttaaagggtaatgaaagatagtataagatattaaattttgatataatattacttattatattggtagttaggaggcaatagatggagttatatgacgctattttttatagaaaatctactaaaaaatactcaaaaaataaattaagtataagtatgtttgaagaagttaggaatatatgcaatgatatagaaagtttggatgaaagtataaaagttaaagcttatcctatattaaaaggggatagtttaaagtttataataaaaaaaggtcatagaatagtagcaccacactatattttattaacagttcaattaccagaagaaagtgatcaagaagaaccaataaattactttgatagtgttggatatgctggagaaaagttagtgttaacattaactgaaatgggattagctacatgttggatagggaatagttttaataaggaattaattttagattttgttatattagacgaaaatgaaattccatcaatgcttatagctttcggatttccagagggaaaagacggtttgtttagaaaaaaagaagaaaagttagatagaaaaccattaaaacaaatagctaaaaatatagatgaaaaatgggaagatataatagaatgtgtaagattatcgccatcatacaaaaattcgcaaccatggagattttatcaaaataatgaatctcttgatatatatatgaaaaaagattctaatgaggatataaaccaagtgaatatggggattgctttaaaacattttgaaatagcatgtaaatataataatatagattttgaatatataaagctaaatcttaaagataaattaagaaaagaatattatataagtgtcgtataattaaaaagtaactctattaatttatagagttgctttttaatttttggataaatttatcaaaatatgtaaaaatttaacaatatgctaatttatgttataatgttgttaaattaattagaaaggtatatgggatatgtttcatttttatatacttttaacaagtgttggaatttgcttaagttttataaatatttataattttaatagaaataaacttaagtttataataataatcaattatcaatgaaaaaaaaggtagaagattttgagtatgtatataatactataaaagatggatacccatacttagatgtaaataaaagaattaataatatagattggttaaaaaataaagataaatatataaaaagaattaaagaaactaaaaaagatgaagaatttatagaagaaatgtcattaataatatctgacttaaacaatagacatactgaattaatagataataaaaaacgatatgaaacttttaagaaagcatattcaaaaaacaattggtacgatttccttgatgataaaaaaattgtagatagatataatttaattggttctaaacttgaaatcccaaaaggtatttttgtaaaaaaggagttaactttaaaagatgtagttaaagatgaagttggatatatatacttgccatcaatggcatcaagaaatggatctataaaaaaagatttaaaaatgattgaagattatattaaaactttaggagattataaagctttaattattgatataagagaaaataaaggtggaagtgatacatattggaaaggtatagtatctaagcttattaaaagtgatataaatgtaaatggatataggatttttagaaatgatagtaaaatagttaaaaactatataaataaaaaaaatataaaattagagcctataaaaaatctaccaaatgaagtaaagaaaaatgcaccaaaagaaatatttaaaaattttagtaattttgaaaaagtatcttatactataaaagcagataataatttaaagtttaatgggaatatatatttacttgtagatgaaaaagtttattcatcatctgaatcatttgctatgttttgtaaagacaataagtttgcaactataatagggcaaactactggtggagatggaggaggcatagatcctgtcttatttaaattaaaaaacagtaacttaatagctaggatggcaagttgtatgtatttaaataaagatgggatatgcgatgaagagtttaaaacgactccagattttgaaataaaagattatcaaagaactgaagattttagagatgataattgtataaaaaaagttttagaacttgaaaatattttataatactgatttaaggaagctttttatacatatatatcttatttatctgattttaatttagaaatagaagatgaaataggggatttataatacaataattaaaataaaaccaaagctttaaaaatgttaatcttttaaagctttggttttatatttttatataaaaattttaatgatagatataagttgggttaatctattgtataagatattaaaaatacactttaaacaatattagttatattgttatgaaacattagttacaattatgtttaaatatgtaaataaatggtatataaattaatattaaaattaattatcgggagtgagtacaatgaagtttagcaagtcagtaataataggaatcggtatagtagttatatgtggagtaggggtaagttattctttagcaaaacatgataaagctgaatatttaacagaagaacaagcaaaaactattatattagaaaaagtgccagatggtaaaatattagaatttgtttatgataatgaagattcttcacctaaatatgattctaaagttgtaaaagataatataaaatatgaagttgaagtggatgctcaaacaggagatataattgagtttgaacaaaatgttttaaaagaagatagtggaaacaaaagttcagataaattaataagtcaagataaagcaatggatataatgcttaataaagttcctaaagcaacaatcgaaagctttaatttagataaagatggaaataatcctgaatacaaaggaaaacttgtaaaaggtgatacaaaatatgaaatagaagtagatgcaaaaactggagatataaaagaatttagtcacgaaaaaattaaagtaaaagatactcatgatgatcaatatggacaaataaaacttgatgactaaataaaaaaagtgtagttatctaataaatattagatggttacactttttttattttatattttgtaatatctaaatatattgaaaatatagaatgtttctatttaaatatatattaatatagaaatattctatatttgttgaaaattgtcgattgttttagtaatattataaaaataaattctaacaattttaaaaattagctaatactatttattataaatataaattttatgtaattaccaaaacataggagggcaatatgatatacaataatattttagaacttataggaaaaactccattacttaaattaaacaatatagaaaataatatatatttaaagcttgaaaaatacaatataggtggaagtataaaagatagagcagttttaggtatgattgaagaccttatggaaaaagaagaaattaaaaaaggagatacaatagtagaagcaactagtggtaatacaggaattgctttatctatgattggaaaaataaaagggcttaatataataatagttatgccaagttctatgagtaaagagcgtagagatttaatgaaagcttatggagcggatatagtacttacaggggaaggtggaatgcaagcatcaatagataaagcattagaacttgtaaattcaaatgaaaattataaatcattaaaacaatttgaaaatgaaagtaatcctaataaacactacaaaacaacagctgtagaaatatatgaagatgttaaggatatagatatatttgtatgtggtataggaacaggtggaactataagtggtgttgctagatacttaaaagaaatgaataaaaatataaaagtcattggcgtggagccagaaagttctcctttaatatcaaaaggttatagtggagctcataaaatacaaggtataggagctaattttatacctaaaaacttagatatgagtgttattgatgagatagtagctgtaagtgatgaagatgcaataaacactgttaaattaataggtgaaaaagaaggcgtgttagtaggtatatcatctggagcgaatatatttgcaagtattaaaatagcaaaagaaaataaagataaaaaaatagtaactatagctcctgatggaatagaaaagtatttatctatgaacatattttagttgaactttaaatataaactaaaaattggaggataatatgtttaaaaagataaatgatgacattgaatatatacttgaaaatgatccggctgcaaggtctaagatagaagttttttttctttatccatcagttcatgcattaatatcacatagaatagcacactgtttttataaacacaaaatgttttttatagctagattaatatcacaaataaatagatttataacaggtatagaaattcatccaggagcaaaaattggtagtgctatattaatagatcatggaatgggtgttgttataggtgaaactgcagttattggaaatcgagtaactatatatcatggaacaactttaggtgggacaggaaaagaaattggaaaaagacatccgacagttggtaatgatgttataattggcgctggagctaaggtattaggtccgataacaataggtgataattcaaaaattggtgcaaattctgtagttttaaaaaatgtacctgaaaatagtacagtagttggaataccaggtaagataataaataataaatagattaaaaaggatgattctaaaatttagagccatccttttataaatttgtaaacttaaaaaataatgtacgtcgtaatataagtttataaactaaaatctaatatattctagttcattagaaatacttatgttaaaaatatatgaaagagaaatttcatttaagaatttttctttttcttcatcatttaattttattaaatcaagtctttgatgatattccattacgaatgcttttaaatcaggtattttatcaaacatataatagttaagaccatcatcttctatattatatttaccttttattatctcaaagattgttctaccaccaaataaatcagctaaatatctagtataagcatgagcaactaataagtttggatctatattagatatttcatttaatctagcaacaaaaacttttgttgaatcacaaagttctatagaatcaagtttgtcacccaatagaaattttgaatcttttaataaagattctgctctaaaaatttcaggaattataaattcttttaaaacttcattgtccttgtgtttttctagattttcctctattgccttgtaaacaaaataaagattgtagatatactctccataagtttgtgtagtagcatctccactaactaatctttttatgaatcctgtattctcagccatactatgtaatttttttgtgcttttttgaatagcttttaggaaattcatatccataaaatcatcttctttcttttaaatttgtgattatctatttagttaattaccccttgagttttaatgctaaactaaaaatttaatttttgtatatatttttaatatatttaaataataaattcataagattcaagtgtataataaactatattaaaatttaaaaattaactttgataattaaagataggtgataaaatgaatgattataaccatataaaattaaaagaattagaaaaatggaaagaaaaaatgagaaaaaaaccatctattataaataaagtatctaaagaaactcaaaataaaataaattctatattacctgagaaatataataacatagtaacaacagctataaaaaatatgactaaagtagttttatttggatctaaatatactacaaaacctccaataaaaaatctttcactagaagaaagagatgaacttgcttatgaaaaaattagattatataaaaaaacagctatgttagaaggagctggaactggggctggaggaattttaatagggcttgctgattttccattgcttcttagcataaaaataaaacttctttatgaaattgctagtatatatggatttgatacaaaagattataaagaaagattatatatattaaacatttttcaattagctttttcaagtcaaaatcatgtaaatactatatttaaaaaaatggagaattttgatgaatttaaagatactttatcagatgatataaatgaatttgattggagaaattttcaacaagaatatagagattacatagatttagccaaacttcttcaattagttccaggtataggagcttttgtgggagcttatgtaaatcataaattggtagataaattaggtgaatatgccatatattcttatcatatgagattattaaatacagggaattgtataatagaaaaagaaagttggatatctaaaaaatataagataattatgagtaaaagaagttttaaataagttgtataaattagagtttagtacaaattaaaaaaaattggattgttttttattgaaaaaggattgattttacaatgaatttcaacttataacagtaaatattaaaaatattgtaaattttaaggaattatgatactgtgtatatacaaataattaattttggaggagatttaaaaaatggctttttttaataagttagcaggatacggatcaatagataattcagcaggggataaaataaaagattacttacttgatggggaagaaataatacaagcatttacatttataagagattctataatattaagcaactatggaatatatttagtagatgttcaaggggttagtggaaaaaaagtagaagtaaaatttttcccttctaagaatgtaaaaagtatatcttttgaatctgcatctacatttgatttagacgtagatataaaaattggagtagatggtaatacaactataggacaaaatggaataccatataatgcacctatttcatttaaagttccaagagctcaagctcaagaagctaaagagatagttaagcttgttaaaaaacattatttatttaaataaagtatttatataaagtataaaaagcacttaatgaatttattaagtgcttttttgtttattttactccaaataaatcgtatttcattccatattctatatttataaatttatttatgataagatgttaattaataaaggaaaataatgtattaatgtaaaagttatatttataaattaatgtcaataagtatatagttgatataaaatttattaaacttttttatatgaatacaaggggaggaagtttatgatagaagtaaacaacttgtgtaaagtctttacaagagtcgtaaaagatgagtcttcaaagaaaaagaaaagactgacgaagctaaaaactaaaaaagaagattttttagcagtaaacaatgttactttcaaagcaaaagaaggagaaatattagggatactaggtccaaatggagcaggtaaaactacattacttagaatgcttggtggaattttaacaccaacatcaggaagtataaatgtagatggatatgattactcaattgataaaaatgcagctaaaaaagaaattggatatttatcaggaaatacaaagctttataatcgtctttcaccaagagaattattaactacttttgcaaatctatatgaaatgcctaaagaagaaattgaaaaatctataaaacaagtaatagatataatggatatggaaagttttatagacaatagaatagaaaatttatctacaggtcaaactcaaagaacttcaatagcaagatgtttgattcattcacctaaagtatacatatttgatgagccaacactgggtctagatgtaataagtagtaaatctataatagattttatgaaaaatgaaaaagaaaaaggaaaaactgttttatactcaactcactatatggaagaagccgaaactttatgtgatagaataatgatgattcacaaaggtgaggtaatagcaatgggaactcctaaagaattaaaagaaaaaactaatactaacaatttaagagatgtatttataactcttgcaagtgaaagaggtgatttatttgaggactaaaatagtaaagcagatatttaaaaaggaaatattagatatattaagagataaaaagactatatttatgatgataatattacctatacttttatacccaatacttatggtaggtatgactcaagttatgatgatgtcgatgaatagtatggaaaaagaaaatataaatatagcttttaataaatcaccagacaaaatactttcaaaagttatagatgatagtaataaatctagaaaaaaagataatagtgaagctggagattttaaaatagtaaaaactacagattataaaaaggatttaaatgatggtaaaatagctgcatatattgatatgactgaaaaaaatggaattaaggagtttaaagtatatatagactcatctgaagagtcagcatctatggcacaagataaaatagatgatgtattaaatgaatataaagaagaattagttaaagaaaaagtatctgaaagtggattagatgttaaaactactctagaacctattagttataaaactgtagatgtagctaaaaatgaagaattagcagggcatttactagggcaaatacttccttttgtattaataataggattacttatgggtgctatatatccagcaatagatgttatggcaggagaaaaagaaagaggtacattagaaacattatttactcttcctataacaaatctagagttagttatgggtaaatatatggcagtatctctttgtgcagtagcttcggctatactaaatattttatctatatttataactatagcatttttattaactagccaaggtatggcaagtgaaatgggaatgattaatatagatatatctcaaatgataattccaggtatagtaactttaatatgtgtatgcttatttgcaatggtagtttcagctgtaagtatgtgtgtatgttcacttgctaaaagttttaaagatgctcaaaactatataacaccagtaactttattagttatgataccttcttatgtatctatgatacctaatataacattaaatagttttacagctactataccagtagttaatatatcattacttattaaaagtgttttaacatttaatagtaatataagtttaatagctttggttttaatatcaaatcttgtatttgttataatatcagttttaatactttctaagatgtttaattctgaagagatattatttggaagtagtaagagtttttcattactagaaaaaagaagtaatatcaaaaaaggtacaatgcctggaataggggatggaattactttatacgctttgggtgtagtgttattaatatatgtaggaactctaattcaaattaagtttggaatgactggattaatgcttactcaagttatgattatagcattacctttaatatttggatggtatattaaatgtgactttaaaaaggtacttaatataaaagaacctaatatatcacaagtattaggtgggataattctttgggttggaacttttataatagttaaccttgtgacacaattaatactttatttattcccacaaaatatgcaaattgttgaaaatttaaatgatgttttaaaaatagataatggcttcttaaacctattagctatagcagtaatgccagctatatgtgaggaaatattctttagaggatttttatttacatcacttagtcatgataaagaaaagaaagctcaaatatgggcagtaatatttagtggtgtaatgtttggatttatgcatatagactttataagagttatacctacaagtatacttggtattgcacttggatattcagtttataagagtagatgtatatttatacctatgataatgcactttttaaataatgcaatagcagtattatcacttcatactacaaagcatgatggtataatggttaaaatatctaatttattaactgtaaattttaaggatttagatatattaaaactaggtttattaatagttataagtatagttttaatattaataggttcaaaattattaggaaagaaaaaaacagcataaatataatttaaataaaaccagctataaactataaagtttaggctgttttttttacgcttaagtaaattacacttattaaaaaattatggataatctataaaaattagttataccaatgcactatgttttaagcgtaaaaaaagattttgagccacgtgtgggcgaaccattttgagcaacggacgaagtcgttggagacatgagcgaagcgaatttttattattaaaaatattaattgatattattgaaattataaattttacttatgattatacaaggagtataataaatacataaataaaaagaaaaaattaacaatttataatagataagctctttacaaaaggaggaattaatatgaaagacattactgtaataggagcaggagtagtaggatgtgctatagctagagaattatcaagatatgatttagatatagctgtaattgataaaaatgaagatgtagcagaaggcatatcaaaagcaaatagtggtattatacatggtggatataacgagaaaaaaggaactttaaaagctaagcttaacttagaaggaaatgaaatgatggatgagttagctagtaagttacaatttccttttaaaagaaatggtgctttagttttagcttttagtgaagatgaattaaaaagagtaaaagaacttaaaagcaatggagaagaaattggagttaaaggtctagaaattttaaataaagaagaagtattaaacttagaaaaaaatataaataaagatgtattaggagctttatacgtaaaaagttctggtatagtaagtccttatgaaatgactttagcatttggtgaaaatgcagttgaaaatggtgttgaatttatattgggacaaggtgttataggtataaaaaaagaaaatgaagtatatgaaataagtctagaaggtggaaatactttaaaaagtaaaatggttataaatgcagctggcctaggtggaggattcttaaataatttagtaagtgaagtaaaatatgagataaatcctgtaaaaggagagtattgcttatttgataaagtagcaggtacactatgcgaaaaaactttattccaagttccaagtgaactaagtaaaggtgttttagttacgccaacagtagatggaaatcttttagtaggtccaaatgcaaaatctagcaaaagtatagaaacttcaagagaaggtatagatgagatactagataaaagtaagaaaactataaaagatatacctgtggatagagttttaaatacttttagcggattaagacctaaagttagtggaggagattttataatagaagaagctaaagatgctaaaaactttataaatgtaataggaatagactctccaggattaacagcagcacctgctattgctaagtatgtaattaatttagtttctaataatattaatttaaatgaaaaagaaaactttaaagaaactagaactaaaatgattagaatgagtgaattaagtatagaagaaaaaaataagttaatagctaaaaatccatcttacggaaaaatggtatgtaaatgtgagtttgtcacagaaggtgagattatagattctataaaaagaccattaggagcaactacaatagatggtgttaaaagaagaactcgtgctatgatgggtggatgccaaggtggtggatgtattatacctataagtatgatattaagtaaagaactaggaatagatataagtgaagtaaataaaaattctaaatcttctacagttgttggatttaaggaggattaatgacatgagagattatgatttaattatagttggtggtggagcagcagggattttatgttctatagatgcatataaaaaaggaatagaaaatattttattaatagaaaaggatcctgtattaggtggagctttaaatctaggaaattataacataggaaaagaaaagaatataacaggtaaagagtacaaaataactttattaaaagaactagataaatgtaatatagatatcaaattaaatactatggtattaaaaatagaagaaaataatgaagtactttgtacaagtcctacaaatggaatagaaaagataaaaggtaaaaatataatattagcaaatggtggtaaagaaggagcaagaaaagctgtaaatatggtaggagatagatgttctggaatacttactgttggaatgactaagaagatatttagtatggataatatgatacctggtaaaaatattttaatagctggaaattcaactttatatatgataaaagatgaattaaaaaataaaaatataaaaatagtaggtataatagctaaagataaagatattaatacttatggtttaactgataaaatatatgataactacagtatagaagctatatatggagatggaagaataagtagtgttaagttagctaaagatgataaagaagaaatagttaagtgtgatactttaatatttgcaaatcctatgctttcagatggattggtagctatgagaagtggtattaaactaaatccaaagactacaggaccagaagttgatgataaatttatgacttcaagaaataatatatacgcttgtggaaatggaatatatatacatgagtatatagaagatatagaaaaagaatgtagtcaattaatagaaaatatatattaaaatttaatataaataattaagttttaaagccaattttaagttataaacttttagttggcttttttaatttgttataaaaaaatgattatggtattatatattaaagatatttttaaaggagatacataaatgaaaataagaggatttgaattagtaagcaaagaagaatttgaaaaagcaaatgcacatatagcatatgaagagttaactctacctaaaagagcaactaagtttgctgctgggtatgatataaaaagtacattaaactttacattacaaccaggtgaagatatagttataccaacaggatttaaagcttatatgcaagttggagaaatgttagcattatatccaagaagtggtatgggatttaaataccaaatacaattagcaaatacagtaggtataggtgatggagattactataactgtgaagctaatgaaggtcattactttataaaattagttaatagaggtaaaaaagcttgggaagttaaagtaggagatggtataggacaagctatatttatgccaatacttttagctgatggagatgactttgaaactggtgaaataagaaaaggtggatttgggtctactgataaaactaataaataaacaactttaatagagttatatagcgtgagtgattatggaaaatatataagttttgctccatgaaagctgaaaagatgctttcaaatgtcactgcaacttatatattttccattcgctaactacgctagtgagcttaattaaaaaaatttatataattgtgtttaagttttgaaaaacgaggtatatatattatggaaaactaaacaaatcaactttaagatttaaaacagatctccttaaggagaaaagaatactttgaaagctcacatgctagataatgagactttgtcaaagacgattaatattatacaaaatctaagtttgatttgtatagttttcttttttattataaaaattagggtctaagattagggacttagataaatttaaaaagacacaaactttattaattagtttgtgtctttttaaatttatattctatttacaatctaacaggcttctatcttgagatgtatatatagtactttttcctgcaaacacataacttatcacacatgcaataaatataaagccaatattagctgatccaaataattcaagtcccattacaaaagatgttataggggtttttgttgctcctgcaaatacacctatcattccaagacctgctaaaaattcaataggaagcccaagcatccctgcaagaaagtttcctaaagttgctccaattacaaataatggagtaacttcaccaccttgaaatcctacagcaagagtaagtgatgttaaaagtaattttatcataaatgcttctttaggaactggttggttaaatgcattacttaataagtccaaacttaatccaaggtaaattctagttccaagaactaaaactattataattattataactccacctacaaagctttttaatgatgtgttaggtattttagctgcaaaaaacttttttaaggaatgagtaagttctgcaaaaagtttgctagtaagtccaaataaaacagcacaaaagataactttaaaaaatatatcaactccatttaaagatgcccccatactataatggctatgttgaactttaaaaagctctgcgataaaatttcctatgtaacttgatataaaacaaggtattattgcttcatatctcattttaccaatagtagtaacctcaagaccaaatattgttcctgcaattggagttccaaagacaacaccaaaaccactacttacaccacttattatgagtattgtataatctagtccttttaattttaaaagctcacctatttttgaagataaactagctcctatttgaactccagtaccttctctaccagcagatcctccgaataaatgagttataaatgtaccgaaaaatacaagaggtgccattctaaaaggaattctaccttcaccttcattaattctttcaattattaagttgtttccttttgctgaatcttttccgtatttagagtataaataacttacaaaagctccacctagtggtagcatgtataatagccatgaattagcttctctagtactagttgcccattgtaagctttttaggaaaaatgatattacaactccaactgcaactcctgatatagatgctagtaaaaaccatcttaaaaatacgattgatattagttcactttctttaatgtgtttttttaattcgttcacgttttgtcctcctaatatattttcttcaaaaaaatagactcctactcttaaatttttaataagagtaggagtcattagcatctagtgcgtttaatggcgaactccatcgccgattttatttaccaacttattatattataaatgcttaaaaatttctataaaaattttaattaaaattattttctaaggaagtgttgacaacaagaaaacaatataatagaattaatgatattaattatcattagaaaatgataattaatataaaaataaaaaaaggagaatttatatgcgattagtttattcattaatatttatagtggctttatcactagtttttacatcaagcataaagaaacactctaagattttttatacaattgcttcaataattggagcaggaacaataatctatgaaatatataggttattaacaaatgtaaagttacacggatttataggtgaatttgaaaaagcatctatgaaaggaaacttttcaatagcatttttcatattagttatgtttgcaggagcattaaatcctaaatggaagataactaaaaagttattaagtataagagcagaatctgcaatactagggtctatacttatattcccacatgtaataatgtatttagttcgttttatggtgaaattatcaaatcataaacttataacaacactttatgtggtttatttaatagttgggttaatagcatttataataatgataccactatttaaaacatcacttaaaaagtatagaagtaaaatgaaatttgcacagtggaagaaattgcaaagatgggcatatccattttatttactagtttatatacatatagtactttcaattttaaatggaaaagaaattgatatgttaaaattaactttatatacgatattatttggtagctattttatattaaaattaataaaaacttcaaaaataaataaaaagaagtctacaagtaatatgtaaaaatttataaaaataaaaagatgtagttttgtagatttacaagattacatcttttttattgcaatataaaaggatatttagagatataagtcgaattttatagaaaataaattagcataaatttgaggaggataaattgtgaagaagctttttataatatttgccatgatagggacattagggctaggaggttgcacaaacaaacaagaaatcactataaacaaggatactgcaaactcaaaagaacaaataaaagagcggttaacaggaaattcaataggaatttatgatgtaaataacttagaaaaaggaaagtacaaagttagtattacttcagaagtatataatgatggtaagttgaaagaatctagtaatatattaactagtgaaatggagataaaaaataataaagataatttaaatattggtattaataagactgataaggatattttaacatttgatattagtcaaaataataaagatgaatttatggcttcaacatcacaaggactaaatttatctaaattcaatggaggaaatattggagttacatggaatatgcttgaaaatgcttctgaaagagcgcataaaatagagattggtaagaatttagcaatagcatcttttagtacaggaaaagatagagttacacatggaatagctttaggaaataattttgtaaaaccaagtgaagctagtggtgatatttcaaataatatggttgatgttattatatatttaaaaataagtaaaatttaaaattgtagatcaaagaataaataaaagtagtagatagtatcagtaattgatgttatctactatttttgtattgattaaaattattaattgttatgtaaatattatttaacgaatatatatttaatgaaagaattttaaaaatattgaaaaaataatcaaggggggatagcttggatactacgaaaaagttagaaagtaaattatggaacaaaaacttttttctactttggcaagggcaattagtatcagtgctaggcgatgttttatacattatggcactagatttttggattttagaaatgacaggttctaaatcacttatgggacttttaagtgcaataacaatgatgccaaggataattttaggaccttttgcaggtgtatttatagataagtgggatagaaaaaaagtaattgttttaactgatttaataagaggtattgttgtaacctttgtagggatagctggggtaataggatttattcaagtttggatggtttttgttgtaggaattattaatggattatgttcagcattttttaatcctgcaataaattctagtaaaccagatatagtaccagaagataagcttataaaagctaattctgtaacgagtttagcacaagctggaatagatatgataggatatgcagcaggaggagtactttacgtattaataggagctccttatatgtttttatttaatgggctttcatatttattttcagcttttactgaaatgtttataactattccaaaattaaaaagagaagaaaaagaaataacttttaaagaagattttaagataggacttaattttataaaagattttaaagtatataagaaaatgtttatatgttcttctatgataaatttttttgcaaatgcaggtatgatactgttaattccatattttaatgaaactaaatttttaggaacagagagatatggctttgctatgatgtttttatctatgggtatggttagtggaagtatattattatcaattaaaaatataaaaagagaacaaaaatttagggtgtttattttttcacttttagcatgtacttcattatttttattaagtatgattactaatagttatatagttttggttatgtgtttattttttagttttttctttaatgttattatgaatactattttttcaactactagtatgattattgtgccagcaaatataagaggtaaggttatggctataacttcaactataagtatgggattagcaccaattggtcaattgatagcaggaattttaggagatttaatgccagttagggttgtattaattatgactttttctgcttgttttattgtaagtttattttatgttaagataaaaaatttaaaaagatttatagaatatgatagtgaacatgataaattagaagagcttatgaaaatatagaagtagctatgggggatattatgcttaaatttataatttgtattattatatctataattattttaagtatggcttactcaattggaattaaaaaaagattaaacttaatttcattagtagatgaaaataaactaaaaaataaaactaaaaaagaaataaataaagcaagtataataatgggaatggggtatttaaatatatttatattatttatgattatgaatttatcatataaatttagtttaatagcatttacattattaatactagatatattttgtatgtttatatatatttacaaaatgttttagaatatcgttagatattaaatgaaaagataaacctctaaactaatctagaaattaataattccatatagaataaaaaagtatttttacacaaataataatttcagaaaagtttaaggaggtaatcattttgtttaaacatgataaagctttactaaaagaagtaaaagtagaaagacctaatccacaatatgctgttttaatgcaagaacaattaggtggaggaaatggtgaattaaaagcagcaatgcaatatttatctcaaagttttagaataaaagacaaagagataaaagatttattccttgacattgcagcagaagagcttagccatatggaaatggtagcccaaacaataaacttattaaatggtcatgacgttgactacaattcaattgaatctggagaaatagaaactcatgtattatctggattatcgccatttttaataaattcatcaggagcaccttggactgctgattatgttactgtaacaggtgatttagttgcagatttattatcaaacatagcatcagaacaaagagcaaaggttgtatatgaatatttatacagacaaattgaagataaatatgtaagagagacaatagatttcttacttaatagagaagaagctcataatgctttatttagagaggcattaaataaaattaaagatacaggttcaaatagagatttcggagttactgaagactctaaattatattttgatttatcaagcccaggacctaatcatgatacaaagattgatatcaatccaccatcatttgaaaatccaataaaaaaataagattaaaatatttaatacatattttagtttacaaaaacacctgcataagtcaggtgttttatttatatttggaaaaaacaattataatagttttcgccattgaataaacaaaacttatatgaaataatataaattaaagaaaatataaaaaggagtgtagtttatgaaaaaaactaattataaagagctgggagttgtacttcttaacaaataaggagttacaaaataaaataactccttatttgttaagtttgtaaatatacaacttaaaaataaaggagaataaaaaaattgaaatataaaaatgctaaaaatttattaccaaaagaattactacaaaaagtgcaagaatacatccaaggtgatgttatatatataccaaaattaaaaggcgaaaaaatgccttggggagcaaaaaatggagcaagaaaagctatttacacaagaaataaagatatatttaatttatatgtaaatggatattcaatagaagagatagtaagtatatataatttatcagagtctagtataagaaaaattatatctaaaataaaaaaagaaactattgaaaataccaatgcactagacttaggagggcttacaaatgaataatacaacttttgaaaaattacaattaagtgaatttaaagaactagtaaaaatacattgtgtaagctcacttggaaaagaactaatagataaactaagtcctagtaaaagtttaagcgtagtaaaaagaaggttaagcgaaaataaagaagctaaaaatgtattagtaaatagtaatcacataccattagaaggcctatttaacataaattctataatagaaaaagttgataaaggtatgattttagatccgatggagcttacaaaggttcaagactttttaagaggatgtaaaaaaataaaaaactttatgttggataaagaattttatgctccaaatttaagttcatatgcactaaatataactgaatgcgattttatagaaagtgaaataaattatatcataaaaaataataaagttgattcaaatgcttctaaagaacttaaaaagataagaagaaatattgaagtttgtgaagctaagataaaagagagattaaataaatttataacttcaagtagtaataaaaagcacatacaagaatttataataagtaaaagaggagataggtatgtaatacctattaaatcttcttataaaaatgaagttgatggaactgttttagatacttcatcaaaaggaaacacagtttttatagaaccagccaatgtatctaaatttagcatagaacttgttagtttaaaatcagaggaaagtatagaagaatataaaatactttcttatttaactgaactaatatttgaaaaaatagctcaaattaaacttaatttagaaataatatctgaatatgatatggtttttgctaaggctaaatatagtttaaataatcattgcataactcctaaggtcaatagtcgaggatacactaaaatagtaaatggaaaacacccattactaaagggaagtgtagtaccacttaactttgaaataggaaaaacatatagaagcttaataataacaggaccaaatgcaggaggaaaaactctatcattaaaaactgttgggctattaacattaatggttcaatgtggatttgatatatgtgcagatgaagacacggaaataagcgtatttgaaaatatatttgtagatataggtgataatcaaagtattgaaaatgcactaagtacattttcttcgcatataaaaaacatagctgaaataatgaatgctagcaataaatcaactttagtgatatttgatgaaataggaagtggaacagaaccaaatgagggagcgtctttggcaattgcaatactagaagaattttatcaaatgggatgtataacaattgcatctactcattatggtgagataaagaattttgcaaatatgcatgaagaatttgaaaatgcaggcatgatgtttgataaggatactttagaacctttatacaagcttgttattggaaaatcagaagatagtaatgctttatttatatctaaaaagatgggtataagagataaagtattaaaaagagctagtgcttatatgaaggataaaaactataatttagacttggttaaaagaagtaagattgaaggtaaaaacgaagttgttgaagagactaaagagatagttaattaccaagttggagataaagttaagttattagataaagatgattttgcaatagtttataaagaagttgataaatttaataatgttgaagttttatataaaaatgaatttataaaagtaaatgtaaaaagaacagaattatatttaaaagctcaagagttatatcctcaagggtatgatattaatagtttgtttacgtcctatgaagatagaaagttagaaaaagatattcaaagaggttctaaaaaggcacttaagaaaattcaaaagcaaataaaaaacaataaataatatgtaataaattatcaaaataaatattaatatattctaaattaataaagaatccaatgagttaaattgttgggttcttttgtttttaaaatagatacttattcatatagtcaatttatatcaaattttccaatattatgatatattatttatatcattttcacttttatcccaaaaacttgattcttctttaaagttatttattagttcatttaaatcattacatatatcttctacgtatgcatatttttctgtatattctaaacttaataatggaacttctaatttacttataaatgcatctgagaaatctttttttatattctccaattgttttctactttcttcttctttaaatgatatggaggtttgaactttttttatattatctatgtctacaattgaaaaaggaatttttaattcatttagtttatcttttattttatttaattcttctttattatctattgctgctatttgaattgaatacatatcccaatttgctacagtagctaatttagaattttcacttttaaccgctgatgcagtttctttgcttttatcagatttatctaccaaatcatcataagaaaactcttggatatttgattcttttttatcaaataagtttaagttgcttattttttcagataaactaaaatctttagattttataaataaaattcccccagctatactaactataactagtcccaaagtaaatcccttagccacattatttcttcttttattaatacctctatatatgtttcttcttttattcattagtttgtccccccatataaatatatttactaaatatatattcatttaaaatatatttattcctatattttcaactttgctactataggaaaatgatctgacatattctttatcaaaacatcatagtagtcaacttcaatatctggtgaaacaagcatatagtcaattctatcaagtgaagttgcatatgttaatacattgtctttgttaaactgtatagcaacatctttaaatacttctttatttattttaatattactttgattaaagtctcctgtaactatatatggatcatttaaggtttttacaaattgctctacctcagctaattgcttttctctttctttttcacttaatcctaaatgtagatttataatatttaatttccttccaaatccaagtcttactactgtatgcaacattcctctttgttctgtttgactgctcaaatatatatgatcttgacttattattttgtatttagaatatgttgcaagtccataatttgaccctagctttactacatttgctccaaagtgtgaatacatttctaaatcttcttttaaactacttacttgaaatcctgcttttgctgactcattaacctcttgtaaacatattatgtctgcattttctattcttaaaaaatctattatatcaaataagctaggaaacatatcttcatttaatccactatgtatattataactaactacctttacttcttttttaggagtaaatttgtttatttcaaaaaagcagcctgctataatcataataattattactaatataactcctaccttttttaacactttataatcatctcctgacttatcaaaatctagtaagttactgttgaaaaaattaagacgctaaattcatagcgccttaatgtttaattttacttagtttatccttaattatgcagtttataacttttttcctaatatcttctgctccttcactttcattagtttctatattcaatattcttgcaatagacttcatatcatttctggctctagatctatactcctcaattaagtgagtttttatattttcaggttcaagtacataatcattatcatctttaaagtaatacacatactttttattgtaataatctttgtttaaatatatatgatttgcaatttgctttaatattgatttatatgattgttttttattaacttctaactgtaggtatttagcaaattttataagttctaatttagatttaaatatctcttcattttttattaattttcctatatcattaaaaccttcttgacatgatcctttttttataatcttcttatatttttgtatatctaatgattcttcattaaactcatttaagctatcatctattattgagtttactttaccttcaatatatctcatagcacctttattagatgcagacctttgaagttcttcttgggtcatatcaagtataattttttttaaatcttcattatactctctagattccatgataacccccctttagttacttttattatattctttaaatatataaaagtgactttatatgaggttttaatataaagattgtaaaacctcatatttaatattatgttttaattttatgttatattattttttattaaaatttatttattaattattttttataaattacgtatatattttctaattttgcaaatactataaatgtaaatcaaacatactcaatctccccattttagacttctattatttcccccaatagaagtcttttttttacgaattattatatttttaaattttaaaaacattattgtgctaaaatattaatagggataagattttaataaacaggaggataagtcatgaatataaatattataggtgtacctactttttatggatgtgataagttaggacctcaacttggtccagacaaactacgtgaaaaaggaataatttctaaaatcaaacaatacaatcacaatgtatttgatattggtaacatctatgtaaaagaagttaatgaaaacgaaaaattaacttcaaatcctgatatgaaatattttgaagcactaattgaaataaataataaccttgcacacgtagttaattgttctttagcttctaattgctttccactaataattggtggagaccattcaatagcccttggaagcatttctggagttagcaaatttttcaataaaaaatttgcaatagtatggtttgatgcacatggtgatattaatacatttgagacatctgaatctaaaaatgttcatggaatgccattagcttctttaatgggatatggtcattctaaacttaaagatttatattataaagatacaaaagtaaaagaagataatgtataccatataggtggacgtgatatagattttggagaaaaagaatttatcaaaaatactgacatgaatatgtattatcctcaagatttatctaaaaaagggttggatacaataatagatgacattttagataatatacataataaagatataaatgctattcacataagctttgacttagactttattgattcaaagtttgttcctggaacaggcactagggttgataatggacttactgttaatgattctaaatatttattagctaaactagctaaatcaggtttagtaaagtctatggatttagttgaacttaatcctatgttagatataaatgatactactgctgatatagcactagatataatagacagtgtatttaaaaatttaaaataaataaaaataccagtaattttactggtattttttatttattattctattccttttaattcatatcctaaatcttctacaacttcttttagcatatcttttgatacagtttcatcaacatcaactaaagcatatttaccttctaaactaacttctattacatttactccttgtatatcttcttcaagtgcttcctttaaatgtcttacacaattcatgcaagtcattccatctactaataatttttttctcataatcttaccaccttttatttgttattgttctaaattcaaatgataaataccttcatatatatcaaaatcattaggttttaaattaccttctactcttttatttgttactagataatcatcagttatagctaaacttataaaagctactttatctctagtatatttttgaatagatttatatatagatttagtattatctatattatttgaatttcttaaagaatttagataccctgttagcttttcatctgtatatccactataattaattacatctgttgcatcaggtacaggagataactcccatccaatcaatgctaaatcatactcttttttatcaagtgcacttgataattcatttccctcaagttcaactattgtagattttatgcctatatcatttaaattttcttttatcatataagctgattttactctttctctatttttcttgtttacaagaatttttaaatttaacctttctatttcttcctttaaattcttcttcctttcattttctttttgctctttatctactttatcctcatttttatctgtattttcttttttatctttttcattttgttttttattagtttcatcttttttatcatctgattttgtatcaactatattatttagtttatcaatatcaattttacttaaatattcttttgactttttaatattataatctaatgcttttatactatcatcataatactttgattttgaatgtagtggaaaattaaccatagatgctttacctagatatgattcttttaaaattttattcctatctatagcgtgtgcaattgcttttctaaaattaatatctttcatgatattgtttccgtaattaaatactatgtattcatatcctctaccttcataatttgttattttaaattgttttgcttgaaactgacttaaatcacttaatgatactttagttatatcacttgataatgctaaagtcatagctacctgagcttcttcatccggcactattattacatttatttcctttttagcatcctttattttatctttatcataataatcttcattaagagtaagtatcatattagatctatcatcaaattttgcaattttgtacggacctgttccatccatattttttctatagtcatttaattcattattgtttaatccacttaactgtttttcgctgactatagggaatattaatgtatctattgaaaaagcatatggttgtttaagatttatttttaaattgttactatcaatagtagatactgattctatattatcaactaaaggtttatatggactagattctgatctctttattaagttcacagtaaattcaacatcttcagatgttaaaggttttttatcatgccacttagcatcctttaactttatatttatactcttaccatctgatgatactgaataactatctaccaactgcggtaccacattataatcactatctatagtaaacaggctatcataaaccaaatccattatatatccaacagattgttcattattatttataggatttatagttttaggatttaccattgataaatgtatatattctgagttgttagatgtagtatcatatttttctgaatttttatctttattactatttttattacatcctgaaatagacagtatcataataataataatcgttaataccttaatttttttcatttgattcttcctctctatataatgccttgtaaactaagtagttttcttttactttctttaaataatttttagtttcattaaatggtatattgtgtaacttactaccatcatgactatattctgtattacttaaccacttatttacattacctgaacctccattgtaggccgctatcaccagttctagatcattaaactctttatataacttgcttaaataccaacagcctatttttatatttgtttgcggatcaaatatatctactttttctaaattcaattcatcttttgcccatttttgtgtcatatcacttatttgcatcaaacctttagctttccttctagatacggcctttttattaaatttactttccactttcattatactgtaaactaaattttcatcaatatcaaattcctttgaataagtctgaacatattctttataaaatcttggatgtaataattttaatacaaattttttttcaatacatacccatcctaaaactaataacataaagactataaatataattataaatctttttttattcacaccaattctcctttatatatgctattagtttattagctttatattttaaatcattcatatccccagaattatctattatataatctccaaactttaatttttcatcttgactcatctgagatttaatacgactgattgcttcttctcttgtaaaattgtctctacttaaaattctatctatttgtgttttctcatcacaagttataactattagtttgtcgactaaatctagaaaattcccttctactaataaagctgcatcaactattactatatttctattattagcttttatatcctctatccttttttttatctctttttttatagcaggatgagttatattatttagttttatcaacttttcatcattagcaaatacaattgaccctaatttttttcgatctaaagacccatcttctctttttatttgttcgccaaaactattaaatatctcagttaacaatgatttattatccattatttctctggatataatatcagcatcgattacatctatagagttttgtcttagtatttctgataaactactttttccacatccaatatttccagttagacctactactaccattttaccacctactttgtttcataccaagaatctccaacatttaagtctacatctaaattaacatccatcgatacagcatgttccatctcttctttaacaatccttgatactatttctaattcatcttcacaacactctattataagttcatcgtgtacttgaagtattaattttgattttaaattcttttcttctagttttttatatacattaaccatagctatttttattatatctgctgcactaccttgtataggtgcattcatagctagccttttacctaaatttctaaccactacatttccagaatttatttcaggtatatatcttcttctatttaaaatagtttttacatatccatctcttttagcttcttctatagtgttatccatgtatgtttttatatcttcatacgtatttaaataactatctatatacattttagcttcttttactggtatatgaagattttgtgataaaccaaaatcacttataccatatactataccaaaatttactgcctttgcagcacttcttttttcacttgttacatcttttatatcaatcccaaaaacttgagatgctgtttttgtatgtatatcaacattatgattaaatgcatctatcatatgctcatcttgactcatatgagccaatactcttaattctatttgagaataatctgcatcaaccaacttacaattatcatctgctataaatacttttcttatgtttctacctaactctaatcttaccggtatattttgaagattaggttctgtagatgaaattctacctgttgttgttatcgtttggttaaatgaagaatgtattcttttacttataggatttattatatttattaatccatctacataagtagactttaattttacaatttgtctatactcagttattttgtctattatttcatgtttatctcttaatttttctagtacctcagcattagttgaatatccagttttagttttctttataactggtaattccaacttctcaaataatataactcctaattgcttaggtgagttaatattaaattcctctcctgcaagtttatatatttcttgttctaatttatctatagataatttaaattcttcacctaattctattaatttatccttatctaccattactccttcgtattccatatatcctaaaacttcaaccaaaggcatttctacatgatagaataaaccatccatatccatatcatttagtttttcttccattttagaaactacgttttcaataagattaactatacttcctatatgattatttaattcttctttatctaaatcttcatattttttagcctttacaccttttcctaatagctcttccatagattttattttttgtccaaaataattcatagctatagaatcatatgtataattagagctacttgagtctataaggtattcagctatagatatatcaaaatacatattatttaaagatatatcatatggtcttaatgctatataatctgcttttaagtcatatccatattttcttatatctttatctattaatatattttttacttcatctatttgattttcatttatgtagtatatatcttctccgtttacacttaagtaaatagatattatatttttttcaagtatattaccacttttcttaactgtctttaaaatcaacttacctttactttttacttctttaataaattcagatatatcttcaagatgttctacatttatttttaactctttagattctccattttcttgtgaattttctcctaatcttgctattaaactattaaaacctagttcattaaaaacttcaattaatctagatttatcataatccccaaatattaattcatctaaattaacttctataggaacatctctaataatagttgctaatctcttgctcattatcgccaattctttattttcttgaagtttcttctttggactaccttttatactatctatattttcgattatattctcaatactaccaaattcttttataagttttatccctgttacttctccaattccaggtactcctggtatattatctgacttatctcccataagtccttttaagtctataaattgagttggagtcatttgatattttttcataacttcatcaaagtcatattcttctacttctcctacaccttttttagttataagtgtagtcgtagtgtttgatgctaattgtatagcatctttatctcctgtaactatatatactttatatccttcttgctctgcttttaatgatactgtaccaattatatcatcagcttcatagccttctaattctaatctatttatattaaaagcatccaataaattttttaatggttctagctgttctcttaattcatctggcatcttctttctaccagctttatattctttatattctaaatgtctaaaagtcggagcttttttatcaaatgcaacacttatatgtgtaggtttgtacacttctattatcttaaataacatagttgtaaatccatatatagcatttgtatgtaagccttgtttattagtcaagtcaggtaatgcataaaaagctctattaactattgagtttccatctattataactaaagttttatccaagtttatcactcctaattatttatcctttgtattattgccaatttgtattatatttaatattaccatattatttaaagtatattaagagaaaatatattgcgaaacattttttcaactgatataattaaactataacaagccggtttgctggaataggcagacggggcggactcaaaatccgttggtagtgataccgtgtgggttcaagtcccacaaccggcaccaataaaaaagagaatagatttaatctattctcttttttgttatttacatttgttgcgctaacattttatatatttcatatctttcttttgcattttcttctgtcatttcaaataattcttcagctatatcagggaattgtttagctatagctgaatatcttacttgtcccattaagaaatctctaaagctttctgtaggttctttagaatctaatataaatggattcttaccttgttcttttaaagttgggttatatctatataaatgccaatatccacacttaacagcatgttcttcatttgcaacagtacgacccataccttcttttaacccatgagatatacacggtgcataacatattataagtgatggaccatcataattttcagcttctactatagcttttattagttgatttttgtctgcacctaatgatacttgagctacatatacattaccatatgtcatagccattctacctaaatctttttttctagttctcttacctgctgcggcaaacttagccatagcagcaactggagtagatttagatgcttgtcctccagtatttgaataaatttctgtatcaaatactaacacatttacatcttcacctgatgcaagtacatgatctagtccaccataacctatatcatatgcccatccatctccaccaagtatccattgagatcttttaactagataatctttaagctcttttatctgatttgttatgcaagttattttttcatctgaagattttatattacttattgcttttaaaacaccttctgatgcacatttagattcttcaccatcatttttactttctagccaatagttaaacgactttttactttcttcatctatatccatacttattaattctctaattaaattttcaattctgtttcttatttgcttaacacctaaatacattccataaccatattctgcattatcttcaaataaagagtttgcccaagatggacctttaccttcatggtttacagtatatggagttgatggtgctgaacctccccaaattgatgaacatcctgtggcattagcaatcatcattctatctccgaataattgtgtagctatcttgatgtatgcagtttctccacatccagcacaagctccagagaattctataagtggttctctaaattgacttccttttacagtattaggatttactaaatctcctttatgagaaacttgtgatactgcaaattcccaattaggcacttctttgtcagattgagtttctaacggtttcataactaaagctttctctttagctggacatatatcagcgcagttaccacaacctgtacagtccatattatcaacttgaattctatattgtaatccttcaagacctttacctacagcttttttagtttcaaaactttctggagctttttgaacttcttcttcatttagtaaaaatggtcttatacatgcatgtggacaaagatatgcacattggttacattgaatacaattttctaatatccattcaggaacattaattcctactccacgtttttcataagctgtagtaccattagggaatgtaccatcttctataccattgaatgcacttactggtaaattgtctccttcttgagcattcataggtcttaatatatttttaataaattctggttcattgtcatgtttctcttcatcttttgcatttttccaagaatcaggaatatcaattttatttatagaattcattcctctatcaacagcttcgtagttcatatttactattttttcgcctttttttccgtatgccttctttatagaatcttttaaatgctctattgcatcttgttctggtattatttgtgctaatttaaaaaatgctgattgcattatcatatttattctattcccaagacctatttcttgtgctatcttagtagcattaactgtatagaaattaatattattattagctatatagtttttaagttttgcaggtaagtggctttccaattcatctttatcccatatacagtttaatacgaatgttccaccttctttaagtccttttactaaatcatattcacttacataagattgattgtggcatgctatatagtcagcttcatctataagataagtagattttataggtgtttttccaaatcttaaatgagacatagttataccaccagattttttggagtcatatgcaaagtatgcttgagcaaacatatctgtattattaccaattatttttattgcctgtttgtttgctcctacagtaccatctgaacctaatccccagaatttacatcttatagttccttcttgacttattttaaagcttctatcaacttctattgatttattagttacatcatccactatacctacagtaaattgatttttaggattatctgattttaaattttcatatatagcttttatatctgctggtgttgtatccttagatcctagaccatatattccacctattatcttaggaattttatcactttcataaaatgctgatttgacatctaggtataaaggttctcctatagaaccaggttctttagttctatctaaaacacaaattttctctacactagacggtataacgtccataaagtgcttagttgaaaatggtctatataaatgcactttgactaatccgtatttttctccttggccatttaaataagttatagtttcttctattgtctctgtaactgaccccattgcaactattaaatatttagcatcattaggtccaaaataatcaaataaaccatgtggtcttcctgttaatttaccaatttgattcatataatcttcaactataggcactatgttttcataatatttatttgaagcctctctagtttggaaatatatatctggattttgtgctgttcctcttgtaactggatgatttggagataatgatctgtctctaaattcttgtaaggcttttttatctattaagtttgcgtaatcttcataatctaaaacttctattttttgtatttcatgtgatgttctaaatccatcaaaaaaatgaataaatggtaatcttccttttatagctgctaaatgtgctactggtgctatatccgctacttcttgaactgaacttgatgctaataaaacacatcctgtttgtcttgctgccataacatcttggtgatctccaaatatagataatgcttgagatgctatagctctagcacttacatgaaaaactccaggtaacagctctcctgataccttatacatattaggtatcataagtaataaaccttgagatgctgtaaatgttgttgtcaatgcccctgcttgaagtgatccatgaaatgctcctgctgctcctgcttctgattgcatttctacaacactaaccttttgtccaaatacgttttttcttccctgagctgcccattcgtctacaacttctgccatcgtagatgatggtgttattggatatattgccgcaacatcggtaaatgcatatgcaacatgtgcagctgccgtattaccatctatagtaattatttgcttacccattatatatacctccttatttatcttcatttagattatgtatttaagtttcttattttagtcataaaatattatctgcattatttaattatatataccaatttcttaataaactaaaaaatactccctatttacaaatagggagtattttttagtttattaattttgctagtgaatttacaatcgatgatttagaaacttgtgagatacttgttattttatcattttcttgagctactgcaattatatcttctaatgtatctttattgttgtctaaaatgtaataacttattattttattgctattctcactgtatgcaaatgcatttggtgcatctaaaccagtttctttagcaaaatcttttatactttttccttcatacgattttagcgaaataccttttaatttatccatacttaaatatttttgcttattgtaaaaatctattatgacatttgatgaagatgcatattcaggcaagttttcaaatccagatgaaactcctacaaattcattagtttttacatcaactactttattattatctatatctacatacagtgcactattttcgtatccttcctttggatataccaattctatatctaatttacttaaaagttgattaaagtctaaattcttacaatttttaaatttatcaatgttaatgtagtatgttgttaaatatggcttacccatatttttaacaacatagtcataatcttttcccattatttcgcttatatcattttgaactttcgttatattcttttgttgagtagctttatctacgttcttatctttattcatactgcatcctgagattattagtatggaaattagcacagtgctaattaatttaactttcctcatatactaatcctcctaaatttacttatagttaattatataatatttatcttaattaaataacctatatcagaatattgtaatatttttgtaagacttctcttttaaatcgacatttgcctttatattttttctaagtacttagttgtatgctataatatattatgacaaatttagggggggacatttttatggacttaaaacaactagaagtttttgtagctgttgcaaagtataatagtttttctaaagctgcaaaagagttatttcttacacaacctacagttagtgctcatattcagaatttagaaaaaaatttcgatacagttttagtaaatagaaataataaagtaataacacttactagatcaggtgaaattttatatgagcatgctatttatatattaaataattgtaaaaaagctgtttatgatattaaagagtataatggaaaaattgaaggagtaatagatatagcttgtagttctattcctgaaacatatatacttcctgactttttaaaaaacttttatagtaactatccaaatgtgaaatttagcattagcagatatgattctcaagatgctatatctgaaatcttaaatgaacgtagcagcttcggatttgtgggatctaaaattaataataaaaaaattcagtatatagacttaatagatgatgaacttgttttaatagctccaattgacttagttatagaaaatgaagataattatattgatatagaaaaattgcatgacctaaagtttataatgagaaaagatggatctggaacacaaagtatagttataaataaacttaaatctaataaaatttcaataaacagtctagatactattgcttatgtagaatctaatgaatctataaaagaaatggttaggttaggacttggggtatcttttgtttcatataattctgttatagatgatataaatcttaaaaagataagatattataaaattaaaaatttaaaatttgatagaaaattttattttgcatattcaaacaaaaaaactttttctccattagaatataaatttttagatagtatttgtgattatttcaatattgatataaataaaaaagataagtgataaatcacttatcttttttatttatatattatgcttctattgtataaaatgctttataacctttgtacatttcatatatatctgctttagatactatttcatatggtgcatgcatgtttaatacacctactccacaatctatcacttctgctccttgttcagctaatatatgggcgattgttccaccgccaccttggtctactttaccaagttcagctatttgccatacaacctcagctttatcaaatattcttcttacttgtgctgcaaattctgcattagcatcattgcatccactcttacctctagctcctgtatacttagttaaagctaccccatatcccatatagcatgcatttctcttgtcaagtacatctgggtatgtaggatcaaatcctgcagaaacatcagcagataatactttagaattagccatagctcttcttactttaagttcacagtaatttccttctatgtttataagctcagctacagtattttcaaagaatcttgaatgcattcctgtatttccttttgatcctatttcttccttatctacacataacgcaactgctgtatatcttgggttttcaatatcaaatatagattttactgcagcataagaacatactctatcatcatgtccataagctataatcatagatttatcaagtcctaaatgtctagcttttccagctggaactatttctatttctgctgttaagaaatctttttctgtcatatcgtatttttcatttaataattttaatacatttgcagaaactgcatctttttcttcaccttctaatggcatatgcccaactaaaagatttaaagcttcaccagttataccatcagctaatttcttttgcatttgatcagctgataaatgtattaataaatctgttatacaaaatactggatcattatcatcttcacctatacatatatcaactttagttccatcatttaatattacaactccatgtaatgataatggtaatgctgtccattgatactttttaattccaccataataatgagtttttaataaagccattttcccatcttcatatagtggatttggttttaaatctagtctaggagaatctatgtgtccaccaactattctcattccattttgtaattcttcttgtcctattacaaataatgcaacacctttgtctttattatttgcatatattttgtcccctgctgataaacttccttttgacatggcttcttctatagatatatatccattttctttagcttgtcttattatttctctagctgatgttctttctgtcttacctgcatctaaaaacttcatatagccatttgcataatccataacactatttaactctttgttttcattaatttgattccatgcatttttaaattcatgtcttaagtccataacaatactccctttctagtaaaatttttccttacgataattatagcacacttacaatattaggcttatattatttttggttcttttgttttttcatagcttcttcatattcttcaggtgaaacaaccttaatattttctaatcttgatctaaaatgtcctctaaagtgctctaaatactcttttcttaacccttctctttctttatgttcttcttctgttaaaccttcacctttatgtttttttgctaattcatttattctatttaatttgtctctatcaaattcgttattcatttattatcactcctaaaaaaatagtttattttctttaaattcttctgtatttttataattagttaaaaattcatctatattttttgatattatatctattcccttttctatttcacatatacttggttgtgctatatttattctaaagaacctatcatctatagatgtgtcaaaaaaatgacttcctgataaaattgatacccctttttttaaaatatatgaactaaattctttagatgagtaccctcttggcaattctaaaaagaagtttatacctccagatggaacttttagcttaagtttttctcctaaattcttaactatcaattttgatgctagttcaaatttttcactataagctttttctaacttttttatatattcatcccaatcaaaattttccatgtaatgatacatagacctttgaatgatacctgatgttgagatatcagaagaatacttagcccataaaattttttttaaaatttcactcggcatctcaactaaacctattctaagtcctggcataagtattttagaaaaactttttatataaattactcttcctttatcatcataacttcttaaagggtaatttatatgagaactaaattttaaatcactcataaaatcatcttctaatatataaaaatcatatttttcagctaattctataagctttttctttttatatattgaatatgttatacctgttggattttgataattaggcattgtataaattatcttaggtcttgttttttcaagctttaattttaatatgcctatatctataccatcttctagcatcggtatacttataatctttgcacctctatttttaaatacttctaaggcccctctatatgtaggttcttcaacaaaaactaaatctgagtaatttataatacctttacatacaatatctatgccttgttgagctcctgaaattatttggatattatctttatgagtatttatatttaatttttttaaataatctactaatttctctcttagattcaaaaatcctagtccatcatcatattcaaatatagaattaccttctttttctaaagccatatttatagattctttaaaatcatcaactggaaacatatctattgatggatttccattatcaaatcttataataccatccatttctatagatttttctttatttatactcctatttacatcagatacaaaagttccactacctatatttttatatacatagccttctttttctaatagctcatatacttttgctatagtagtattattaacttctagtaactttgctaaagttcttattggtggaagttttttatttgcttttatttcatcttctataatcattttctttatatgattataaatctgtaaatatttaggactattttcttttattataaatttatatttatccattttatccccacttaaaacgatattatttatatatgcctttgttgatgcacatatctatatttgatattattatgtatatataataccaaaattttttaaaaaaggggataataattatgtattacgattatcatatgcattcaaacttctctggagatagtcaaacacccatggaggatatggtaaaaaaatcaatagatattggattaaaggaaatatgtttcacagaccatgttgactatgacataataagtgatgtagagtttgagactgattatgatgcttattttaaaaatattaatatgcttaaagataaatataaaaacaaaattactataaaaaaaggtatagaaatgggtgttcaaccacacattcttgaaaaatgttctaatgacataaaaaaatatccttttgattttgttatatgttcaatgcatgcaatagatagggtcgatttatataatggaactttttttaatgataaaactcaagttaaagcttatgaaaaatattatgaaacgttatataatatagtaaaaaattataatgactatagtgtattaggtcatctagatttaattaaaagatatggagattataaatcagaacttgatgataaacttttctataatatattagaatctatcttaaaagaagctatccaaaatggaaaaggaattgagattaatacttcttgtttcagatacggtcttaaagacttaactccatctacttatatacttaaaatgtataaagatttaggtggagaaataataacaactggttcagattctcatattccatctcaagttgcatataagtttgatttcatatataaaaaattaagcgaacttggttttaaatatgtaactacattcgattcaatgaaaccaaaatttataagcatagaaaatataatatctaaataattttaaaaataataactctaaatatataatatgggttattattttttcatttttatacttaaagttgaatataacttaagataggaggtggtttagttgaaaattcctaatcttgtgtactcaactttaatactctttttatctaattttatagttagagtaataggttttttatataagatatttctatcaaacaacttatctgaagtccacctaggaatataccatttagtatttaattttttaatgatttgtatagctcttactacaacaggaatacctacagctcttagttgtttagttgctagaaaaaaagcttttaatgataaacatagcacaaatgcactttttatatctacaatttacatatcctttataatagcatctttaatttcaatatttgtaggctttaaatctagttatttatcatcaaaaattttatatagcaacaacatgtctatatttatattagctatatgtccatcaattatagctataactttgtctaatgtagtaagaggatattattatggtataaaaaaagtaaatatccctgcaatatcccaaattttagaacaagtttcaaaaattatatttgtttaccttattgtaagaaattttaataaccccacactaatttgtttatcagctataattggtatatccataggagagtgtattagtttaatatttatgacctttaacttggctaaaaaaccttatatagaaaatcgatatacaatagatataaaagagtttatattagcatcttataatactataaaaatgtctatacctattacttgcaatcgtatgtctagtatagttcttaattctatctgttctatgataattccatctagattagctttatcagggattaattataaaaatgcattaggtatatatggtattatatctggtatggtttttccatttatatatcttccattcatgcttgtttctgctcttgttgtaaatttaataccaagcatatccttggaagtaacaagaaaaaatacatatgctatcaaaagtaaaatttatttttcagtaatacttacacttgctatgggtattttatgttcaatcttattttatttctttggagaagaaatttgtaaaatcatctttaataataaatctgcaggtacttatctaaagcttatgtgtttagttcccctattcttaagtttaaatcatatactttctggaattttgcattctattggtaaggagtacattgctagtattatagggatttcatcaatgataatacaaaccttattcctttattttatattacctataccaaatttaggtatatatggttatataataattttaactttaatgcctacattatcatgtattctaaattattttgttttatataaatacttaaaatcattaaaataaggtggttaattgtatgattgttttaaatacaactactaattattctatatatgtttttagtaaaaataattgcttatttattaaagattctttcggagacattaaaaaagtttctaatagtatttatttatattcatcaattatagatgataaagtcaaactcttttttattatttattttacctaagttaattatatatgtctttgtatatgactcagtttctataatctgaggagtatatttatctatcaaatttaaatcattagtatttaatatataattgcccttatagtttataatattaatgtcttcatataagcttttaaaaacttgatttaaaatttcttcatttaaatttttttgataaatcaaatgaaaatatccatccaaattatgatttatatcattttctattacttcgataacataagtttcattgttccatgatacaatttgttgtgatttttttagtaattctccccctttatatttataaaccttgatttttttccccaattgttcttcaaaaaattctattagccccttcaatatctcaccccatatatgttatcccttagattttactatatttcttatattataaattaaaaagctgtaaaactaaaagatacttttagtcttacagcttaaaattaatttttatattatggcattagtagtttctttatcaaatatgtgaactttatttttgtctaaagctaattttagcttttgcccacactttatattataccttgaatcaaatcttgcagtaatatttttaccttcaacatttaaataagcataaatttcagctcccataagttcacttatatctactgtcgcatcaaatattgtatcttgactattatctataaatatatcttctatatgaatatcttccggtcttatacctaaaacaatttctttgtttacatatccatttttctttaatgaatcagatttaactttatctaatgcaattttaaaattattaaatatagcatatactacaccttcttcttcagatatattacaatctattaagttcatttgaggtgctcctataaatcctgccacgaacatatttgctggattatcatatacttcttgaggtgtatctatttgttgtattacaccatctttcattataactattctatcagccattgtcatcgcttcaacttggtcatgtgttacatatataaaagttgttccaagctttttatgcagtttagttatttctgttctcatggctgttctaagtttagcatctaaatttgataagggttcatccattaagaaaactttaggatttctaactatagctctacctaatgccactctctgtctttgtcccccagataatgcttttggctttctgtctagaactgattctaagtctagtatttttgcagcttcttttacttttttatctatttcagcttttggtatctttcttagtttaagtgcaaatgccatattttcataaacacttaaatgaggatataatgcatagttttgaaaaaccatagctatatctctatcttttggagctacatcatttactattttatctcctatatataactcacctgaagttatttcttcaagtccagctatcatccttaaagtagttgatttaccacatccagacggtcctactaaaacaacaaactccttatcttgtatgtctatatttacatcctttacagcttcatatccattatcataagatttacctatactttttaaaattacctcagccataatttatatctcccccaactataattaatatagttaaagtatagttaaaaaacgttttctcatatatagttacattaactaaattatttcattcaaattatacaagaatttgatttacttataatcttcatacacagcagatgctaaaattttatttatattatccatcatagatgtgaacttatactcagaatctatatatctacttaaatctttattgctagatattgtttttttcaagtcctgtgctaattttaaagtttttttatctatagttaccccatttaaatttttcgatttaatatccatttgaatttttctatggttatttaaaataacttcataatttggattagattttataatcttcatattttttttaaagtctttatactctttactctcctttatatcacttgcaagttttgtagtactatcataaacactcataaatttcctcctataaaaaaagattgaatataatatattatattcaatctttcttatttatacctccattataataggaagtatcataggatttctcttagttctttgatataagtattcttttaagttatcctttatattattttttaagtaagcccactcttttatatgactttgttcacaagctactaatacattcttaattactgttttagctccatccattaaatcttctgattctcttacataaacaaatcctctagatattatatctggacctgctaaaactttaccatcttctttagatatagtaacaacaactatcataagaccatcttctgataaatgctttctatctcttaatactatgtttccaacatctccaacaccaagtccatcaactaacacatttccagttggaatatgtgatgcaactttagctgaatttctatctagttctaaaacttctccagttttcataacaaatatattttgacttggcattcctaaatcttctgcaacttctgcatgtttttttagcattctaaattcaccatgagctggcataaagaacttaggcgcaactaatctgtgcattaactttaattcttcttgtcttgcatgccctgaaacatgtatatcagctgcatcatcgtatactacttctgctcctttttcaaataaacaattaactacttttgatataagtttttcatttcctggtattgggtgagcagatattattactaaatcaccttgtcttatttcaacttttttatgttcagcagatgccattcttgcaagggctgacataggttctccttgagatccagttgttattataactaattcattatcttcatacttatgaatatcatttaaatctataagcacttcatcttctatatctatataacctaaatctctagctactgccataacatttaccatagatctacctgaaactgcaacttttctgccacacttttgagctgtgttaactatttgttgtaatctgtgtatgttagatgcaaaagtagcaactattattctactgttatttgcttttgtaaataatccatctaaacctgttcctacagttctttcagatgggttatatcctggtctttcaacatttgtactatcagcaagcattaataatacaccctttttgcttaactcacaaattctatgaaaatccataacttctccatctattggagttaaatctattttaaaatctcctgtgtgaaaaattattccctgatctgtatgaatagctatagcacaagcatctggtatactatgatttacttttaaaaattcaacatcgaaatttttaagttttataatctcctgtggagttataacatttaaattcacattgtttagcttatgctcttttaattttacttgtataagccctacagtaagtttagaagcatatataggaacatttattttctttaatacataaggtaatgctcctatatgatcctcatgaccatgtgttataaatattccctttactttatctttatttttaactaagtaagttatatctggtataactatatctacccctagcatttcttcttctggaaaacttaaccctgcatctataactataatttcatctttatattcaacaacagtcatatttttcccgacttcgtttaatcctcccagagccataacttttattttatttaaactctttttaaacaattgtatcatctccttttgtctgcgtcttttttcactttgacttttcgcactttaaaacgttcttcactaatatacagataatataaaatcacgcactctttaccagttactataattgtatcacaacttgaactatattttaagatatatttaaaatacatttaacgtattgttttgacaaactataattattttggtattctcaaactataatatttacaggaggttctaatgcgtggtaaaactcacttaactataggtgtattagcttcgttacaagcttctatgctatttaataaacctctgtctcttataaacgtcgtagtttgttcattattttcaatattacctgatttagacacatcaaattcaattatatctaatacgattttaaatcatcatttttctaaaaaaatttataaaatcgttatatatactttaaatattttaatatttctaatatctttaaaaataaatggtaacttcttaataagttccatagtaactttcatatcaataataatactagaagctaaaataacacatggatttttaaggaaattacttttatccttaacatttattttattagcaatttgcatatatctaattaatggtaaattttattttattctatttactataatattagcattattcccttggctaaaacatagaaagctttctcatagtttactagctattttaataataaactttttacttaaacaaatagaactattaactaatatatcaaatatatgcttttttggaactattggatactcatctcatttatttttaggtgatttgttcacaaaatcagggataccacttttttatcctcttagtgaaaagaaattttcttttggttttttaagagttggagggactttaagtaatattttagaaattatattcgttttatttttaataattttaataatattaaccttgataaaattttaagccccattacggggcttgtttttatttgcaatctttacataaaccatagaatttaagatcgtgatctaatatactaaaatcatataaatcttgtatttctaactctatagagtctaataaatcttcttttacctctattattttattacagtttttacatattaaatgatgatgattgtgagcatctgaatcatctaaatcaatttcataccttatacatccatcatctaaatttaatttagaaatcgcacctacttcatctaataactgcatagttctataaactgtagcaagccctatttcaggacaatcagctctaactaaatcatatatttcttcactacttagatgtttatccttatgctttaataacgtctcaacaatagctcttctttggggtgttatcttaaatccagtttctttcaatttttcttttaatatatctatttgattcatcaatatttaccaccttttttcaactgataatctttattaattattttaattgataaagctaattttgtcaacatatgcaaacacttatactatcttaaactaaataaaagtaaagatatactatatctttacttttataaatatacccatattttaacttttttaataacatttttaattattataaataaaatcatctaatttttttaaattttctgttttattccattttaccacaaaactattatctttcgctaatcttcctgattctctataatcttctaaaggaaattccatttgctttaattcatagttatatatttctttagatgtaattgctaaatttattaatttagacattgatatattaacatcaacgtatggtaatatcttttttattaccttagggtaatttgttataggcagttccactaatttatctgctatactttttaaaacttccctttgtcttgtatctctttcatatatactatcaccttttcttattcttgcatatgctaatgcttgatatccgtttaataattgttttccatcacttcttataaattgtggttcttctgcttctttattagatgtattaaatgaattaactatcacatcgtttaaatgatctatttcattttctttaacattcacttcgactccacctaatacgtctactaaatctataaatgaattaaaattaacagccgcataatcttttatacttattttaaaattttgttcaattgtatctaataacaattttgcccctccataggcatatgcatgtgttaatttttcatatccatgtccagggatatttactaaagtatctcttactaaagaagttaattttatacttttatttttatcgtctatagttaaaatcatcatagcatctgatcgtcctacattatcgaaattcttagaatcaattccgattagtagaatatttgatacacctttatttttttttgaagaatcaatttttttctcttgtttatcgttattactttgaatcatattttcatttgatttatttgtaacttctctatagctatttaatgcatatacattacttatagttgaaattattgcaactgatatacttaaaataatacaatattttttaaatttattcatattcatttccccttaattactttgttaattttattttaaccatataaataaatttaaatcttttttataaaacattttaagctaaatcattgtatatttacaacatattaaatattacagtttttattaatgcaaaaaactctcttaaataataaacaggtataaattggcttattgaattaacagtataaaaatttatatttttatatccatttttctttgctaataaaaagcttctaaaactatgaaaatctgtggttacaacttttatatttaacttatttatacttttattgctaattttttctattttttctttgctatatttaaaattttcatacgtgttagtagatttgtcttctaaaattattctttttttagatattccatgatttatcaaataatcttccatggctttagcttctgatattttttcatcacttccccttccaccagatacaactatataacaatcatcattgcttttatttatgtactctatagctttgtctaatctaccttttaatgtaaggctaggaccattatttttaactgcagctcctaagattactaagtaatcacaatcatcttttaaattgtgttttggaaaaaatattaatatagattcaactataaaaaatatagataatcctataactaaaactatattaaatgctttttttaaatttttgtttaaatgtatttttttctttataaaatgatacagtattaaaacaattcctacagtcataaaaaatgtatcaaatgccataccattataaactatttctaaataaagataataaaatacacataataatcctataagtaaatccaaatatttaatcactaaaaacctcctactaaaatttaattaaattaaaaacacatttataaacattttgcatttaaaaaaggagtaccatatagatactcccatttataaactatacaattttaaatattaattattcttcgtcgtaatctaatccttcttcttccattaaagtattataaacagctacaactgtttcatactcatcatcattttcaagaggagttaatatgtctccttcttcatctgaatcaattctaaatattaaagcttcttccgcttcattatcatctaaaggcataagtatagcatactcttttccttctgcttctaaagttaatattatttcaaattgtatttcatttccatcttggtctattaagttcactatattttcttgcattcatttcacctcaaaatttaattatttaaatatattataacgtatatctacattattttgtacctgttttaaaaaattcttttactatctaaatatccttgaagaattattactgctgctagcatatctataactttttttctcttatctcttctaacatctgcttctattaaagatctttcagctgcaactgtagaaagtctttcatcccagtactctatcttaattccagtttcttgttctaaaagttcacaaaactttataactttttccccttgaggtcctagtgtaccattcatatttttaggaagtcctgaaactattttgtttacttgtctttcttttattatagtttttaattcttctatatcttttttcttccccactcttttaacagtcttaacaccttgagcagtaattcccataagatcgctaactgcaactcctatagttttatcacccacatctagacccattattcttccgtctaatatcatataaatctccttgattaactaaatttctagcaatttttcactatatgtatatactatattcttattgttctctaaattcaagacattatgtgcaaaaataaattaacctagatactaaaatattaagtaactaggttaattttatattattctttattaaaaatcatcatatttatactcataattaataatggtataagtatataaattgaagtagtacctgcagctactattccagagtcattaactaataaagttactatacatcctacagtagatgcaacaaaccctttaaatatataaggatatttatctgatatttttttaaattgtcttgacggtttaaatataaagcttgatataaaccctacaattacaaatacaattatgataaatacattacttgtagctatatctatattcatctgtatctttctaacaaatgtttgaattatagctcctggtccatcaaccattatttgatttacaaatacagataaatgagattgacttttagatactatatctagtgctgcaaataagaaaacaattataactggcactaaagctaaaagtatatacttttttaaatccatcttagcatcaaatataagtaatataaacaacacatatgctacagattcagatattgaacctcctacatttgctcccattgaaggataagcacttgttattaatattattaaagcaaggacaactacaaaccaatttggtatttttttataattaactaaaactgataaagcaaaaatagcacaacctatagttattccttcatattcatttcctattccataatatctagcaccaattatagcatcataactcataatattattttgcattaaatgtgtcccaaacatagaatctataacaataactattatagtgagaatagagaaaaatcccatataagctatatcatctttaaataactttttacctattatataaaaagctacaagggttcctaatattcccatagttatactacctttagttgaaaaattaaatataggtgaaactataaatactaaaggtattaagatacctaattttaaaaactcttttaaaatactaaaaatcatttctttcttaggtaatttatctctaaaaaatagtagtaatatagttgcgataacacctgctacagctactatcccaacagaagtattaactatagtacttcttactcctaacatagaaaccattttttcaaattcatgatttataaagcctatattatcttttttttcaacttttataagtttttttcctaccatttgtggattttctataccaaacttagaaagtatatctacacctatatcaatattgccaactactccatctcgtctagttgtagctgaacgtaaaactccttttccagagccttcaaatttaattataggtgataatcttttttgctctttatagtcttttttacttggaaatgtagacattatataaactgtatcattttcatttactgttttaaaaacttcttttaaatatgaatctatatttttatatattttatttttcatattcttataagttttatcatttaaataatttttatattcatctaatctatatgtatctccaagttctataaatacaacttcactatcatcataaaacttttttgtttcgttttttaacttatcgtaatcagttctcattccataaggcatagtattatctttaatgtttatattatcaacattaccagattcaactctacctatgttatccatagccattaaagctatatttctattttttaataattctccattattaactttgtcagcatttcctataacagaagtctttatttttttgtccgctaaagtctgacctagtgaaccaagttttgacccataagaaccattctctaagttttcacttagagaatagtttatagtcatgtcatttatttttttaggattgtgtcctgtttcagctttatatgctactccattgtctttattaacttcttcaaagtttataagactttgacttggcattgtaactttgcctcctgcacctatagctgcatatgaccttctatcatcagttcctcggtcacctctgatattcataagccctatataaccttctttattaagctttttatttaaggcatctatacttagcatgtcctcaaggcttgtcctattcatattaattaatataactttacctttttcacttgcaaaactaactgtagatatagagcttataagtactattaaagtagttaataaggatacaatcttttttttcataagattgacctactttctattattcaagtaataagttataacctcttctaaaatttcatctctttcaaattttttcatgattcctctagcattattatgacttgttatataactagagtctcctgaaagaatgtatcctataatttgatttatagggttgtatcctttttccttaagagcgctataaactacatctatagcttcactaacactcatttgttcagatgttataccttcgaatttcattgtataatccatattttcattcatactacaacacccctatttcttttatttttatttgtttttttgttttgttactttacttgagattttaacacatcttttgcatgatttaaagcatcatcaacttttgttacatctggtgctccagcttgtgccatattaggtcttcctccaccttttccaccagcagtttgagcaacttctctaactatgtttccagcatgaactcctttttcaattacatctttagtagctgtagcaacaaagtttatttttcctcctgctacatttgctaatactactacccctgaagctaatttatctcttaaagtatcagcagtgtttctaagtgtgtccatatccatatcctcaaacttagctgtaactatgtttactccatttatatctactttagagtctaatatagagtctgcagattgtaaactcattttagctttaacttcatttaattctttagttaatgatttagtttcatctaataaatgtgctacttttgctgttaaattatcttctttagcttttatagttgcacatacttcatttattaagtgttgtttattgtttaggaagttatatacttctttaccagttatagcttctattcttcttacacctgctgcaactccaccttcagaaagtattttaaacatacctatttgagaagtatttgttaagtgagttcctccgcataattctattgaataatctcccatagatacaactcttacttcatctccatatttttcaccgaataatgcagtagcaccttttttagaagcatctgtcatactcatattttcacaagttatatctagtgcttcaaatattatatcatttactttttcttctataagttttaattcatcttttgatatagcctcaaaatgagttacgtcaaatcttaatctttcaggagttacaagtgatccagcttggttaacatgttctcctaatacttcttttaatactttgtgaagtatatgagtagcactatggtttctagctgaagctaatcttacctctttatcaaccttagtatatactacatctcctacatttatcattcctgatttaacaacacatatatgttttatagtgttatttggtccttttttagtatctattacttctaaaactacatcttcatttttattaactaaaagacctttatctccaacttgtcctccaccttctggatagaaagcagttttatcaagaactattacaacttcatctgaaacacaagctgattctactaattcgttgtttttagcaattcctttaacagttgattctatagataaagtttcatatccttcaaagtctgtaactatatctttatctaacttagctatagcatcttctttccatgcttctgagtccatatttcctctagcatctcttgctgtttgtctttgcttttccatttcagcttggaatccttcttcatctatttctagatgttcttcttctaaaatttctttagttaagtcaactgggaatccgtaagtatcatataatctaaatgcattttctccacttagagttttttcatttttagcttttaattcttctatatatgaagataatatttcgcttcccttatctattgtctcattgaatttttcttcttctattcttataacttttttgatgtagtctgctttttctactaactctgggtaagcttctccacttacagctataacttcatcaactaatttatataagaaaggctctttcattccaagtaactttccatttcttgctgctcttctaagtaatcttctaagaacatatcctctaccttcatttgatggtaatactccatctgcaactaagaaacttacacttcttatatggtcagttattattcttatagatttatcaactttatattcttttccataagtagagtttgtcattttttcaacagcatttaatatatgctttatagtgtcaacgtcaaatatagtatcaacaccttgcattatgcaagctattctttcaagacccatacctgtatctatgttcttgttttcaagtggattatagtttccttcttcatctttgttaaattgagagaaaacatgattccaaaactctaaatatctatcacaatcacatcctggtttacaatctgggttatcacatccatattcttcacctctatcaaagtgtatttctgaacatggtccacaagcaccagtacctatttcccagaaattatcttctttacctaatcttactattctttcttttggtatacctatttctttttcccatatttcgaaagcttcatcatcttctaggtatacacttacccatatcttatcttgtggtatatttaggtgttcagtaacaaactcccatccccactttaatgtttcttctttgaagtaatctccaaaagagaagtttccaagcatttcaaataatgtagcatgtctagctgtaactcctacattttctatatctccagttcttacacacttttgacaagttgtcattctcttacttggtggtatttctgtacctgaaaagtaatttttaagtggtgccatacctgcatttattaataataaactcttatcgttatgtggcactaatgaataacttggttgaactaaatgtccctttgattcaaagaagtttaaaaatttacttcttatttcgtttaatcccattttttgcattttgatttcctcctataatttatgtctttattattccttgtattaaaaaatccccgcctctataaaactataggggcgaggatatatctcgcggtaccaccctaattactgtaaaaatcacagtatcttcggaaaaccttaagttataacggaactaccgtcaactcctacttaatttcaaagttgatactccaagactgcttcaattaatctatcgtaagggctctcacctaatccctctctctgtaaagcatcaattaatttactacttcttttcattgtatttaaattatatattttctatctgattatagttatattactaaattttcttaaaataatcaatagtttttttaacaacgtacgtagtcgttggcgctattagcaaagtgaatttttattataagctcttttctattattcctccacctacaaccttatctccatcatacattactactgattgacctttagttatagctctttgaggctcgtcaaatactattttaacagtattttcacctattttagttactgtagcatcagatggtcttgctgagtatcttaccttagcttgtactcttataggttcttttatatcatcaattgatattaaatttacatctttagctattaatgcatttgaaaatatatcttcattatctcctaatacaactgtatttttaacagggtctatatcaactacaaacataggcttaccaaatgctattccaagtccttttctttgacctatagtgtagtttattatacctttgtgctttcctaatacatttcctttagtatctacaaaaaatcctgggtcaattctttttttagaatgtttttttacatatccagcataatcattatcttttacgaagcatatctcttgactatctggtttattatgaacatctataccaatttcttttgcaatttctcttactctatctttttcgtaatctcctattggaagtaaagtatgttctaattgttcttgagttaaattatacagagcataagtttgatcttttttatccgtaacagattttttaagtaaatatctacctgtttcttcatctttttctattttagcataatgtcctgtagctacataatcacatcctatttgacgtgctttattgaaaaagtcatcaaactttatatgtttattacaagctatacaaggatttggcgttcttccgtttaaatattcatctataaatggctctattactttttctctaaatacatcactaaagtttaatacgtaaaaaggtatacctattttatctgcaacttttcttgcatcttcaacagccgcaagtgaacaacatccaccttcattttctataagttcatcatcatcatcttgccataacttcatagtaactcctattacatcatagccttgttcttttaaaagatatgcggcaacagaactgtctaccccaccactcataccgatcattactctctttttcatattatcacctcgttctttatattatatatactttgacttgttttttaaagtgttaacttataccctatccataaaatcatttgctcttttatataaataatgattttttataaattttctatatgatcttataaaccaaattccacctactaaaactattatatatataggccacccaattatacttaaactagtaaatattaaactaataacaatacctatagttcccaatattaacctattatccatcatatgaacaaaatcaggaaaaaagtttatagtaaacatgctcattcctaacaataatagcatacccacaatcatcacaccagtaaacacaattggcggaactattaaaactttagatactttttctaatactttttctaaaattttttttactattatatgctttcccttatttgctctctttgatatttttaaagttaaatgttttaaaaattcagctctattcataaactactcctttagactcctcttagataaaactttatatactataatatcttttttgatgtacttataacaagtgtttatctttaaaatatttaaattatctttaactattgatataatatcgataagaaaacattctcttattgtaagggggccaattatgaaaagaacataaagactttcattattactaaatgataataatttagatgcaatatttttaacaaaacgctctaatgtaaattatattagtaaatttactgatgaagctgcatttgttttaacgtataaagataaattttatcttacaactgatggtagatttactgaattatctcaaaaagaatgtgtaggttttgaagttgtaaacttgcatttatttgataaaaatattataaaagcagttagtcatatttgtgctgaaaatagtgtaaagagattaggttttgaaagaagtaatataacttttgatagatatgaagcgttaaaaaatatgttatgtaatatagaacttgtgggaactgatggtattatagaatctttgagatatataaaagatgaacctgatcaagctataagagaatttattaaaaaatatgaaaaattttactatcctggaataggtcatggtgttggaatgaaccttcatgaagagccatttttaggtaactatggaactaaagtaatagaaaaaggttgtataataactatggaacctggcctatatatacctggatttggtggagttagaatataagatactgtacttgtaaaagatgatggaatagaaatatttactaggttccctaaagaacttatgattttataaatatctataaaattacaagtttatctattataacttgtaattatccattttgactagcatttaaatttgttccacttatattaattgctgttaataagtacaaatcgttatttataatgtttagaataaatttaaataggtattaataatattattaatatatttttggaggttaatatgagttttcaagatataaagaaattatctacttctaatgaaaatatttgcgcaatattatacaattttaataataaagaattaactatgttaaaaaatatatgtggtttaataggggttaaagaaaaaatagttcttactcctaagaatggaaattctttgattaaagatgttttagaaggaaaattagatgataattgtgaaaatggtttaacaaataaagctgttatatttaataatgtagaccattctaaaattcattcttttatagatgctttaaagaaatttagaatctctaaccctttaatagctgtagttacagaaacttctgtaaattggaatgtaaatactttagtaagtaatttattagaagagcgtgaagctttaaaagctggtaagcctgttaatcattaatataaaaaaacctcgtaatgaaatttacggggttttttataacgtttgaagttttctcggcacataaaaaaatgaaataattgatattacccaaaaacttatcttaaattttaaaactatggatcctaaaaaagccattcccattatatttaaaacttttatagatttagttctttgataagtatataatctaagatatgcataagcatcccttattaaaaaataataaattatatattttatagtttctgtcactgtaagtaagtagacatgatgtatttcaaatccagttaaatctttaatttgaagaataagcaaatataataatcctatatatactgtaattttagaacaaaatataaaatttgcatactttcttatattctttaatatataaaacttttgacttgccacttcttttaaacactttattctacttcctataaataagcttccaaaataagtcattattatcgttcctaaaggaagagttgcaataagaatataaactaatgaagatttcatgctttcactaatcggaactttagctaacatttgttgatagtccttcataacactaaatccaattaagtttgaaaataaaacatctactaataccattataaaacaagatattatacttaaataaaataagtcatctagcattttagtttttttattaattataaaaccgcacatgattccaattatcatactttgactcatacaaattgctgaagctatatctcccataattaaacctattataactaagcaaattaacatagcaagtgcgctaaacttaaaatcacatcttaagtatataattgcaataaatattggaactatcatatctatataaagtgcatataaaaaacctgttgatattgcaaaaatactacaaactacaaacaaagcagacataatagccgcttcagtcatttttcttatttccatgtaattccttctttcttagttttattaatattagtatattatatcatatacaaaattttgtaataatatataaaaaatagttatctttaattaaagataactattttttatatatttattcttaagctttatttttatgattttttataaataaagatgcaattaatcctagtaatgctatcactgctgttcctataaataaatgtgcatacccttgattcatagtatattgatatgcattctctattgccggtttagctttatctaaactaacaaagtaattattttttaatatatcaaaatgcatattaggattagatcccatagtatgttgaagtccattaaacatagattctacaaatgattttacagtgttaaatatatttgtgacatctgcattttgaaacttttccatcatttgaggagacatgtgtccgcttcctaaagacccacctggaatctgtggcattactttttcaattgcacctggtacttttctacctgcatctgatacaaaatttataagtaaatttggtgaaactgcaacccctattgaacgaagtaatgatacagttgattgccccatagaaatttcttctggcttaactaagctcatcattaagtaatttattggagttcccatagtaaatcccataccagctcccataaatactaaacctattgttaagtttgtaaaatttggatggttgcctgttactaatgcttgatataacacccctattatgtttacaccaaaccctaataaaagtaattttttaactccaaatttgtctatgaatttaccacctaaaggtgccgctatacctgtaaaaacagcaaatagtgttactacataccctccactacctcttttaattcttaatacattttctgagaattgtggtaaaaatactgtactcataagtccacatccaactataaagcttaaaaataaagttaatgctgtttgcttatttgtaaagaagtttaaatttaaaacaggatcttctgctcttttttctatagatataaacaatggaataaaagctataaatattattaaataaggccatacatccattgattgaattgaatttgcaaaatcatagaattttaagtttgttaacccatacattattgatgcaaccataacacttaatacaactgagccccatatatccatttttttaactttagattcttttttattttcttttaattttaatgccgcaattattataattatacttattggagcatttattaagaataaaaatccccatctactatctcctgccatagaaagtacaaaacttcctaatgtaggtccaagtactgttgctataccatatactccacctaccataccaagagctgaacctcttttttcctctggaaaagaagctcctatataagctgtggcaattggcattatacctcctccacctattgcttgaattactcttgaagttaataaaaattgatagcttcctactatatcagatactccacaaagtaatgagcctgttgcaaataatataacacataacatatataccttttttctaccatgtgtatcggctaattttcctgtaattggcatagaaaccgcataagctaatgtatatatagttatcatccatacactagcagactcagttatccctagtccattagctattacgttccttgctggagatactatacctgaatccatagcccccataaaaattccaagtaagaaaactaacatagctatccctgtactgtttttcttctgtgatccgctcataaaaatacactcctgttaattaaattttaccttaattaatgtaagagacataattttagttcagttataatcattttaaaatccaatattaaaaatattctatcctaaaacaactacaatttttaatttttaacttacattaattaccttgttaaatttttatttttatcaataattcatatacccattataaaaatatttattcatttataaaattaaaaaagaattgagaatagataaatctattctcaattctttttaatcaaacttaaatggattaactcttatagcattattgtataaaaatggatatgatttacttaaatactctaagtaagaaatccactgtattgaaatatttttatatactcttataacatcattttctaagtggtttatattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatgcattaatttcccaccaacttctgtaaaaaatatacctactaacatatttattttttcgattctatcttttttagctctataatctatcaatttttcaagcattatagtcacaactaaactgtttataggaataaaacataaattcataagggaataatatgcagtgtttagtgcttgaccaaaaattagataatgtataaaaaacattatggatgataaagcgattaatataaatgatatgtgagtgtaattttttatagtttatatattatatttaccttaaattttattaagttttctaagttgattaaattatataaaatttacttatatatgaggaatataatataagtatttatttgtaaaattactactttttaatataatacctcataaaaatatattgataagtagtatgtgtagatataaaaaatatattatatatatgataattttacttctaaatgaacaatataatatatataattaattaagctaaaaatttttatttaggtatttgattaaagcttgattggtagtggtatgtatttaatgttatttccaaatttttaaacattatgatataattatatgaaaagaataaattaggagtgtggtaaaaattgggttcgaccgagggtagtattattattcagttagtgatattaggagtattgcttatagcttcaggattcttctcagcatctgaaacagctttaatgtcacttagtaaaataagaattaggcatatgcaagaagaaaaagttaagggagctaatttagtaagtaaattaacagaagactcagggaagcttttaagttctatattagttggaaataatatagttaatattgcagctacatctttgtctacatcattatttataactatattaaatggaagaccagaagctgttccagtcgctactgcagtaatgactattttagttttaatatttggagaaataactccaaaaacaatagctgctaacaactcagagaaagtagctatattagtttctaaacctataaaattaataatattaattttaaaacctatagtatgggtgtttaatattattacaaaagttatatttaagttgtttggaatacaaagtaatatgggacaaccatatattactgaagaagaattaaaaacaatggttaatgtaggtcacgaagaaggcgttttagaaatagaagaaagacaaataataaataatgtatttcaatttggagatatgcaagccaaagaagctatggttcaaagattagatatggtttgtataaatgcacaagatagttatgaagaggtaataaatatatttaaagaagaacaatttagtagaatgcctgtttatgaagagtctgtggatgatataattggaatagttaatataaaagatatagtatttttaagtgaatcagaaataaatgaatttgacataaaaaaatatgtaagagaagcatttttcacttatgaattcaaaaaaataacagagttacttgaagaaatgaaaaaagataaaagtcaaatggctatagtcgtagatgaatatggaggaacttctggtcttataactatagaagatttagttgaagaaatagttggagaaatagaagatgagtacgatgaagatgatgaagatattcaagtaataaaagaagatgaatttatagtagatggtagtaaaaaaatatcagaagttaacgaacttataggaacaaatttagagtcagaagaatttgattctataggagggtttataattggttatttaaaaagattacctgaagaaaatgaagttatcgaagttgataatgtgaaattttgcatagaaagcttagataaaaatagaataaagaaaataagagtgttcacataaggtactatttatagtaccttttttaatatcaaataatatacaaaattttaaaatttaacaatttttagaaagattattttggtttattttacatgaataatttaaaaaaatttttaataaaacttttttagaagcattggaaaatctatatttctgaataacactatatttgataaattttggataaagtattataattaaaacgtattcctttaattttaaagatggagatacaaaaatataatttaaataactataaatattggaggaaaatttgccatgagagaaagagtacttgaaagatttttaaagtatgtaacatttgatacaactgcagatcctaaaaactcaaattgtccatcaagtgaaggacaaagagtatttgctaaatacatagtagaagagttaaaaggtttaggtcttgaagatgcacatgttgatgaaaatagctatgttatggctacattaaaaggaaatgtagaaggagttcctactataggatttatatctcatttagatacagctccagatgtaactggtaaaaatgttaagccaagaatagttaaaaactatgatggtaaagacatagttttaaatgaagagttaaatgtagtaacttctcctaaagattatccagaaatggaaactttaataggtgaagatgtaatagttacagatgggactactttattaggagcagatgataaagctggtatagctgagatagtaactgctatagaatatttaataaataatccagaaataaaacatggagatataaaaataggatttactccagatgaagaagttggtagaggagcagatttatttgatgttgaaaaatttggagcaaaatatgcatatactatagatggtggaatacttggagaacttcaatacgaaaacttcaatgcagcagcagctactataactatacaaggaagaaatgtacatccaggtagtgcaaagaataaattagttaatgctctacatatagcagcagaaatatctgaaatgttcccagcaagtgaaagacctgagactactgaaggatatgaaggattctatcatttaaatgatataaatggaaatgttgaaaaagcttctatgatttatataataagagatcatgataatgctaaatttgaacaaagaaaagagtttatgaaatctgtaatagaaaaaataaatgaaaaatatgaaggaagagtaactctagacttaaaagaccaatattataatatgaaagaaaaagtagagccagttaagtttgtagttgatatagttgaaaaatctatgaaagaaactgacataactccaataatagtacctataagaggaggtacagatggggctagattatcatttatgggattaccttgtccaaatatatttactggtggattaaacttccatagtaaaaatgaatgtataccagtttcagcaatggaaaaaggagctaaattaatagttagaatagctgagaattatacaaatttaaaataaatataaaaaatgaactctaaatagagttcattttttatattttaattaattaataattattataaatttataacttctttagtatttatatctattaagtttatatctaaatctaattcgtcatgagtctgaattatatctatagttgcaactgagtgagatccatcttttggaattgatgtacttcctgggtttataacaattagattttcatcaacatacaattcttttacatgagtatgtccaagtattaatatatcagcacccatagattttgcttttttgatagtttcttccttagaatctacatatccatgatttattaaaattcttgtttctccaaattgacttaagacatatggaccttggatatgatggtttataaccatttggtcaacgtcagcatcacaatttcctctagctataagtatattatctaattcatttattttagatattactcccttagggttataacctttaggtaaatcatttctaggtccatgatataaaacatcaccagcatgaagtaaaatatcacaatctgataaaacttctaaagctttttcaaaatacactaaactaccatgagtatcactcataacgcctattttcataagaatacctcctaaaattataaaaatttatcagcaactctactccaaaattcataatttactaacctgactaattttatattaacatcagatgttgtaattgaaatatttgttatactctcaagtctatgttcaacaccatcaactaccactaataatgcattttcaaatctatactcaggtaaaatacctataacagcatcgtgagggaatattatgcttgaagtaaagcatctatatgcattagtatttatagggtgtagaggagttaattgcattagttttagactaggatctactatgctaccaccagcagcatagttatatgcagtagatccagttggtgtagagattaatagcccatctccactaaagttttgaatatctttattattaacactcaattctaggtgtatggtcctggatttatcgccttttattacgacatcattaactgcatacatatctatacaacttccttttgaacaaactgtagtttgtataagggaaatatcttgcaatataaaattattatttatataatcatcaataaatttatcaataaagtcagggtagacatcagtaaaaaatcctaagtgtccagtatttatgcctaaaataggaatttcaggataattaaaatcatgaacagtttttaggaaagaaccatcgcctccaatagagattataagttctgaattaatatcaaaatcataggttacataaaaaccagcattaataagtttatcagttaaaatctctctagtttttaaagatatatctaatgaatttgaatttatagttatcgttcttttcatatccccacctctttacacttgtattataacataatttaaaaagtaattgatactctagtaaaaatgtatgatataaataaaaagtcttatctattatgtaaaaatagtataaaatagataatgttattataaatgaaagtaggtgtaaatttgttcaaaaaagaagaacaaaaatataatattatatcttacacaagtgatgaaaactcaacactaaaagaaatattattagataaattaaatttttcagttaggtctttatcaaaaatgaaaagagagcaaactgtattagtaaatggaaaatttaaaaagcctagtaccaacatagaaaaaggcgatttaatagaagtgaaaatagaagaagatatggctaatttcacacctgaagatttaaacttagatataatttatgatgactttgatttgataatggtaaataaacctccatttatggttgttcatccaactaaaagtcatagtgataatacaattgctaatggggtaacagattatataattaagaaaaatgaaaaagttaagattagatttgtgaacagattagatatgaatacatctggacttgtaatagtagctaaaaatgcatatgcacatcatacattatctacagatatgagtgaagacaaagtagataagaagtatataactgttgttaaaggtatggttaaggatgattttggaactataaatgcacctatatatagacagactgaagatagtataaaaagaatagttgatgagcgtggacaagaatctgttactcattataaagtaatagagaggttaaatgatgctacagttctagaggttaagctggagactggacgaactcatcaaataagagttcatatgaatcacattggacatggaataataggtgatgaattatatggttatgtggatgaagatttaattaatagacaagccctacatgcttatagtttagagtttgagcaaccaagaactaaagaaaaattaaaatttaaagcacaagttccagaagatatgaaaaaattaatagaaaaattaagatagaggtgtaaacatgataatacataagtttatagtacatgtactagataaaaatagtgaagtacctatattaaatgattttgaaggaaaaataagtcaagaagtagataagttttttcaaaaaataattaaaagagtaagtaaagatgatgacttaagaaaaggtatattcaaagattatgaaaataatatagttaaaaattgttgtgagcaaataatatatgatgaaagcacattcttagaaaattctaaagaaatagcagcatatttatttgatactatgaaaatcaatgctgaattagaatcttgtgatttagcaatttgtttatatacaataaaagatgagaagtatgttggtatattaaaattagattacaaaagattatatacacattctatagaatttatagatgataaattcaatatacaaatggtacctaatgaaataggtataccagaaactcaaagacaaaagcaatgtgcaattgtaggattaacaggaattaatgatgaatatcatttaagacttttagataaagatgcagaaaaggaacatttagaatctaagtttataaatgagtttttaaatgcagataagatagttgatgataagtataaaactaaagtatttaaaagtagtgcagaaacttggataacaaatgcattagctaatgatataaaacaagctgaggatataagaagtgtattaaattatactttaaaagaaaaagaagaaatagatttagatgaatttgttgagaagtctatagatagcgttgatttaaaagaaagttttaaagagcatatggaagacaaaggtttaaatgaatcatttagcatagataaagaatggatagagaaaaagcttaaaaaaagaagtataaaaacagatacaggttttgatataaaaggggatttaagcaattttgaagatcctatgaaatatagtgtaaagcaaaatcctgatggaagtatagatataactataaaaaatgtaaaattttatgaggaaaaataaaaaagccgagtcattaactcggttttttattatttattatcttctataaaagaacatatatctcctatacatttgaaattttcagcttcttcatcaggaatttcaataccatactcatcttctaaagccattataacttctacggcatctaaagaatctgcttctaaatcttctgttaaagatgtatttaaagttatagtatctaaatcatcaatgcctaattgctcagctattatttccctaattctttcaaacatagtagacctcctaaatcaaattaataatttaattgtagtttaatataagaactagaaattttcaatataaattatataaaaattagaatattgtagtaaaacaagcatatatatttatataaacaaaaacataggaggaatggttatgaagtatataggtttattagcatcgtctatatgcgtagtagtagtgctattaataaactcatattacaatatcataaacttagatattcaaaggataagttcatatgtaatagaaggtaatatgatattagaagattttattacaaaagaagattatgtattaaaaaataatgatgagtacatagctagactgttgaatattaaatcacatattaaagacacaaaaacttcttttttcacaaagaaatataaaaattataggatgaaatcaatagaaaatttagttaatagtatatctgatggaaaagaaaaagataaacatttagaattggtaaaaagatacaatgatttatcagaaaaggaactagatagtttattagacaagaatctattagaagtaacatatttatctacccgagcatatgaataagtaaggaaatctataaggtttccaacatttaaagggggtaaccatatgtcaaaactagataaacttctaagaagttttggatgtggatgtgattcaccatttggaggatcaagtttattaataatagctgtaatagtatttttattattaggaacagatatacttgataacttcttttgtgatgacaattcatggatttggataatattaataatacttttattatttaactttgatgatgggtgttgttaataaaaaaagctctatatagagctttttttattgccaatttagtaaaatatcaaaaatttataaaaaaataataataaaatagtaaccgttttttaaaaatcccatagtataaattaagagtatgatacatttgagatatgacttctaaaaatattttttaaatatgggttagctaaataataaaataaagatttagcaatccaaaaaattagggggtatatatgggatcattaagtagattatttggtggagatggattcttctgcggtggagcatggtggataatagtattattcttcttattcttagcatttcaagaatgctggtcagaaatatgtataactgactggattccatttttaatattacttcttattgtttgctcatgtggatttgatggatgcgatgacggatttgattgtggctgctaattaaaaataaaaaaagactaccttaaggtagtctttttttatttttaaaattacatacttactatttttataattaaaaaatattaagtgtgtaattttaaaaatagtattaaaaaattataaaactattatcaaaaagtatttaacatgcatagtatattttaagagcgaaagctcaaataattaatcatcaacaggaggtaacgcaatgttagatagactatttggaaatgatggatgttttggtggaggagcatggtggataatcgtactattcttcttattcttagcatttggagactgttgggaagagttagacatatgtgcatggatacctttcttaatagttttattaatattatgtagttgtggaggatgcttctagtttaaaattagacatcttagcaaattgacatcaggaggaaagtgaaatgttagatagattatttggtgaagatggattcttcggatgtggatgggtaatcatagtattattcttcttatttttagcatttggagattgttgggaagaattagatatatgcgcatggatacctttcttaatactattattaatacttctttgctgtgatggatgcttttaatagaggatattaaaatagttaatatactaataagataaaaataataagtaaccaaaaaatatatagattcataatatataaaatagttagatatgaaaactaactaaattttaaaaataaaatctaacaggaggtaaatgtatgttaacaagatttttcggaaacgatggatgttttggtggaggagcatggtggataatagtactattcttcttattcttagcatttggagaaacttgggtagaaattgatataatggcatggatacctttcttaatattattattaataacttgttcttgtgcaggattctttgatgataatgatggttgtggatgctaattagataacagtaaaatatacaaaaataacacgtcagtaatatactggcgtgttattttttgtcgaaatatatttaaatcgttttaaaattatgataaaattaatttttgcacagattaaagaatatattttattaaatatagtaaaaatgaagataaggaggaatgctaaatgaaaacaaatgtaacaataaaagatgtagctaagaaagcaggcgtttctatatctacagtatcaagagtaataaatgattctaagccagttactgatgaagtaaaacaaaaggtgttagatgttataaaggaaactggatatgttccaaatccattagcaagaagcttagtaaccaaaaaaagtcaattaataggagtaatagttccagaagtttcagattcatttgttagtgaattattaaacggaatagaagaagttgctaagatgtatgattatgatatattattagcaaatacatattcagacaaggagcaagaattaaaaagtataaacttattaagagctaaacaagtagagggtatagttatgatgtcttggaaggtagacgaagagcatttaaactatatacaaaattgtagaataccagcagtatatgtaagtaaaactgcgagaaactatgatgtttactctgtaagtataagcaatacagatgctacttacgatatgacgaagtatcttatagataaaggtcatagaaagatatcatttataatgactagtgaagatgatactgttttagaagcagaaagatacttaggatttgagaaggctatgaaagacaataacatagacatagataaatctttagtaaaaaatgcaggaactacatataagtatggatatgataaaatgaaagaagtactagatgaagggaatatacctgatgcagtatttgttacaggtgatgaagcagctataggagctcttaatgctatatgtgatgcaggatatagagttccagaagatatatctgtagctggatttaacgatgcaaaaatagcttctatgtatagacctaaattaactacagttcatcaacctttatatgatatgggagctgtagcaataagaatggtaataaaaatgattgataaagaagttttagataataaaaaagtagaacttccatatagaatagtagaaagagaaagtgttatagaaagacactaataaaaagcatgttatctattttagataacatgctttttattatatatactataaaatcgacaattttggataaattaaaattaaatttaaaaaaataactttatatataaatttaaaaatatataattaattaacaatatatatttaaaacaaaggaaataaattttatttgtagaagatacttaaatacttacatatttaaatttttattttttatagggggaaatagatatgaataaaataattatagatggaagagatttgactatagaagatgtagtaaatgtatcacgaaacggttataaagtagagctaagtgatgatgtgataaataaagttaaattatctagaaaattagtagataaatttgttgatgagcaaaaagttgtatatggtataactacaggatttggaaaattctcagatgtagttatatctaaagaagaaactcataaacttcaacgaaatttaattataagccatgcatgtggagttggagaaccgctagaagaagatatagtaagagccataatgttacttagaataaataatttatcacaaggttattcaggcgttagagttgagactttaaacactttattaggtatgttaaataatgatgtacatccgataataccagaaaaaggatcattaggagcatctggagatttagcacccttagcacatatggtacttacaatgataggtgaaggagaagcgatatataatggcaaaagaatgacttctaaagaagctatgaatcttgcaggagttgatatcttacctgaattatcatcaaaagaaggattagcacttataaatggaactcaggtaatgactgctataggagctctcactacatatgatgctatgaacttattaaaattagcagatgttgctttatcattaactatggaatctttaaatggaattacatgtgcaatggatgaaagagtacacttagtaagagctcacagagggcaaattaatacagccaaaaatgtattagatatattaagtgaaagtgaaatgactacaaaacaaggagatttaagagttcaagatgcatactctcttagatgttcaccacaaatccatggtgcaagtaaagatgcaatagagtatgtaagaaataaaataaatatagaaatcaattcagtaacagacaacccaataatattcccagaacaagaagatgtaatatcaggaggtaatttccatggtcaacctatggcacttagtttcgatttcttgggaatagcattatcagagatagcaaacatatcagaaagacgactagaaagactagtaaacccagcattaagtaatggactaccagcatttttaactaaaaatggaggagtaaactccggttttatgatagtacaatatagtgcagcatcattagtttcagaaaataaagtattagcacatccagcaagtgtagactcaataccgtcatcagcaaatcaagaagatcatgtatctatgggaacaatagcagctagaaaagccaaagagataatggagaatacaagaaatgtattagctatggaaatattaggagcagtacaagctatagatttaagaggaaagaaaaaattaggtattggtactgaagcagcatataacatagttagaagtcatattaatttcatagaagaagatatagtcatgtataaagaaataaataaatgtgatgaaataataaagaaaaatttaattgtagaagctgtagaaaaagctttgcaatgtgaacttttaataaatgaagaaactgttttaattgaaggctaaaagaaatataagggggataaattatatggctactttagaaaaggttatgaatattaaaaatgaaagtattgaagatgcaatgactataaaattagattatataccaaatgaaataccaaaatttatagatgggataagaagagcaccaaaaagagaagctaaattatcagaatcagatgtgaaattagctttaaaaaatgctttaagatatataccagaagaatatcatgaaaaattagctcctgagtttttaaatgaacttatgagtactggaagaatatatggttatagatttagaccagaaggaaaattaaaagggaaatcaatagatgaatataaaggaaaatgcacagaagctaaagcatttcaagttatgatagataataatttagattttgatatagcattatatccatacgaacttgttacatatggagaaacaggtcaaatttttcaaaattggatgcaatatgttttagtaaaaaaatatttagaagtaatgaatcaagatcagactttagtaatacaatcagggcatcctgtaggattatttaaatctaaaccagaagctccaagagtaataataactaatggattaatggtaggtttatttgataatcaggaagagtggaaaagagctgcagcaataggtgtatctaattatggtcaaatgactgctggaggatggatgtatataggacctcaaggtattgtccatggaacttactcaacattattaaatgcgggaagattaatattaggtatacctgaagaagaaaatttatctggaaaactttttataacttcagggctaggaggtatgagtggagcacaaggaaaagctgtagaaatagcaggtggagtaggtataatagctgaagttgattattcaagaatagaaactagatatacacaagggtgggtaagtaaggttactagtacttgtgaagaagcctttaatatagctaaggaatacatggataaaaaagatccatgcgcaatagcttatcatggtaatatagtagatttgcttcaatatgcaataaaaaataacatacatgtagatttactttcagatcaaacttcttgtcatgcagtttacgatggaggttattgtcctcaaggaataagttttaaagatagaactgaacttttagctaatgataaagaaaagtttgtaaaattagttgatgaaactttaaaagctcactttaaagctattaaagatttaactagtaagggaagttatttctttgactatggaaatagctttatgaaagctgtctatgatgctggatgtatagaaatatctaaaaatggagtggatgaaaaggatgggtttatattcccttcatacgttgaagatatattagggccacaactatttgattatggatatggaccatttagatgggtttgcttaagtggaaaaaaagaagatttaataaaaactgataaggcagctatggattgtatagatcctgatagaagatatcaagatagagataactggatatggataaaagatgcagagaaaaatggtttagtagttggaacacaagcaagaatcctttatcaagatgctatgggaagaacaaaaatagctcttaaatttaatgaaatggtaagacgtggagaaataggacctgtaatgttaggtagggaccatcatgatgtatctggaacagattctccatttagagaaacttctaatataaaagatggaagtaatataatggctgatatggcaactcattgttttgctggaaatgcagctagaggtatgagtttaatagctcttcataatggaggaggagttgggataggtaaatctataaatggtggatttggaatggtattagatggttctcacagggtagatgagatattaagaactgctatgccatgggatgttatgggcggagtagcaagacgcgcttgggcaagaaatgaaaattctataacaactgttatggaatacaacaaaatgtgccaaggtcaagatcatataacactaccatatatagttgatgaagatttaataaatcaagttatagaagctaataactaaagtagataatggataactaaatatttagttatccactaaaaataaatattaatatgattatagggggattattaatatggctatagtacaatgtgtacctaattttagtgaaggtagagatttagataaaatagaaaagatagttgcacctttaagaggaaaagcaggagttaaacttttaaattatgaagctgataaagattataatagggttgtagttactgtaataggagaacctaaggctgtaaaaaatgcagttttagaagcaataggagtagctaaagatgttatagatatgaatacacataaaggacagcactcaagatttggggcgacagatgtgtgtccatttatacctataaaggatatgactatggatgaagctgtagaattagctaaagaaataggtgaagaagtatctaaattatatgatataccagtatttttatatgaaagtgcagcatcaaaaccagaaagagaaaatttagctaaagtaagaaaaggagagtatgaaggtttagatgctaaatttgaagatcctaattgggctccagactttggattagctaaaaaacaccctacagcaggagcaatagcaataggagcaagaaagcctttaatagcatacaacataaacttagatactccaaacatagaaatagcagctaatatagctaaaactataagacaatctagcggtggatatagatttataaaagcaggaccagtagaaattccagaaagaggaataactcaagttacaatgaatttgacagactatacaaagactgctatgtatagagcttttgaagctgtaaagatggaagcaagaagatatggagttaatgttatgggaagtgaaatagttggattatgccctatggaagctttagttgactgtgcttcttattatttaggtcttgaaaatttctctctagataaagttttagagactagtttaatggagtagatttatgagtgctgatttaattataaaaaatataggaaaactagctactatgagaggcaaatcgcctttcataggcaaagctatgaatgatatagagataatagaaaatgcatatgttgcagtgaaagatggaaagttttatgaaataggtattggtaataattataatcatttaatagatgtacatacaataatagatgatgctaaaggtagattagttacacctgggcttattgatgctcatacacatttagttcatggtggaagtcgtgaaaatgaatttgctaaaaaaattacaggagttccttatttagatatattaaaaagtggaggagggatattaagtacagtaaaagcaacaaaaagtgcaagttttgaacaactttatgataaggcaagaaaaagtttagacaggatgttggaatttggagtaaccacagtagaagctaagagtggttatggattagaattagacacagaaataaagcagttaaaagttgctaaaaagttaggaaaagatcatcctataaatttaatacacactttcttaggagctcatgccattcctctagaatataaagaagactcagaaaaatttgttgatataattataaatgatatgatgcctaaagttaaagaacttgaattagctgaattttgtgatgtattttgtgaagactcagtatttaatataaatcagactagaaagatatttaaaagagctaaagaactaggatataaattaaagatacatgcagatgaaattgtatcactaggtggagcagaactttctgctgaagttggatgtgtatcggcagaccatttaatggctgctagtgatgaaggtataagattaatggcacaaaaaaatgtagtagctaatatacttccagctacatcttttaatttaaataaagaatatgccaatgttagaaaaatgatagatataaatttagcagtttcattatcaagtgattataacccaggtagttgtccaagcgaaaacctacaatttgtaatgcaattaggttgtttaggattaaaaatgacaccaaatgaagtattaagtgctgtcactattaatgctgcatgtgcaatagatagacaagattgtataggatcaattgatatagggaaagatgcagatttagtaatatttgattcacctaacgtagaatatttaatgtatcactttggaataaaccacacttatcgtgtatataaatgtggagagttagttgttgatgataaacatacgatatacgataaaaagtgtgaatgtatattaaattaaattatataaacatattttgaaatgaaattatatatacttaatctggtagtttatataattaagaaatatacataagttaagggggattatatatgaaattagttgaaatgactgtggaagatttctcaaaagaagtagattcaaattcaccagcaccagggggaggatcagtttcagcattagcttccaatataggtgtcagcttagctaggatgatggcaaacttaagctttggaaagaaaaaatatgaaagtttagatgagtctataagattagagtttatagatagatttaataaactaggagatataagacaagaattaatactattagtagataaagatacagaatcatttgaagaatatatgaaagctataaggatgccaaaagatactgatgaagaaatgcaagtaagaaaaacagctatcaaatgtgcacaagcattttctatagaagtcccatttaaaacagcatcagtttctatggaggcattagaattattaagttatatcgctaaatatggaaatcaaaatgctataacagatataggtgtaggtactttacttatatatagtggtattgaaggagctatattaaatgtaaaagttaatctattaggtttagatgacgaagaaatgattaataattatactattaagtgtaatgatttaataaacagagctagtgatattaaagatgaaataattgggaatatacatagtaaattagagccaataaaagcataaaaaatgtaacctattataggttacattttttatgcttttattgatctgtatgttttttgactctttttacaacttttttaacttttttattttgcttagatccttcatttgcttgatcgtgattagttgattttggagatttatgagattcagatttatttgattttttattaggtagttcttttttagagtgatcagatttagcttttttagattttttgctgtttactttttcttgagcttcagcattagctattttattcattatagtatctactttttttctttgattttcatctaaaaaagccttaaacttctcaaccacctcttctttaccttgaagggttttacctattttaactaattcatccataagttcatcttctgacttatttttataaccgtctgctatttcttcaattttatttttatctatatttttttcctttgcaaatttttccatagcttccttatctatttttttcataaaagcacctctttcaataatatatatttaattcttttcatattatttatatatagaagtattagataaattatgattaataatatgaaaaagaaaaaatacttataaataatatatatgcagacttataaaaaaagtaacaataatagtaaataaaacatagtttatatattaggagtagtatatagtaaggggtgactaagggtgaacaatttactatttatattgggaatgatagcgctaagtaatggcaatatatcactattggataataataaaaataaatctagtagtgtagatataaatgcagaatatggaagtatgagatctaaggtatcaaacaaaagtaaaaaaataaaattgaaaaataagttacgacctaagaaaattgaagatgaagaagtaaattataatcatgatgatgaagaggatataatagacgtgtcaggatatatagatgaagcatctagttttaatattaatgatttagataaaggtatgaaaatgctagaattaagtgatgatgacttagatcgtggactagagataataacaagaacgaaaaagtatatggatagagatgaaaagaaggttcttgttaaaatagaaagtgtattagatttagttagaggtataaaaaagcttagtagtgttgacttgatagatgatgatgacgaatcagatttttttagaagtatggaagaggatgataaaaaaaacatgatgataaaagaaatactagaagtctttccagaaagaaaaagagaatcagtagaaaaagctatggatatgaaaaagaaaatagagttatttgcagaactatttttgccagatgatataggggaagacaatggttctggatttagtttaagttcgttagctagcattaataatttaggaagtttaagtaatttaaaacttttaggtagccttttaagaactgataatcgtgaaagtaaaaatgaaaaaaatgataaaactacctacaatactgtatacaacaatacatatgaagaatttgaagatgaaaataattatgatgatgaagaatatgaagaagaagttaatgaaatagatgattacatggatgatgattatgtaagaatagacaaataaaaagtggaaaaatatcaaaaatttaattaaattgctatataaaactacttttaaatttttttgatttattatataataaatatatgaaatcctgaggcatgcgacagtgcttttttaaattcaaccgacaaagtttgaacgggagtatgagtctaacagtgtataacacgccccttcataattatgggggaagttaaaagctgttagtagtacacccacctgggagattctcgggtctgaatttaaggggccatcggtgttttgggataaaaaaagtattgtgatttcacaatactttttttatttattaaaatttcctaatatgccaaatggatttttagttatgaataagcaactagatttgtaatttaaatcattagaataattcgatttaaagtgtgctctgatgaacttctcattaatgctataatcatcttctatacaatcactccaagtagctcctaaatctttagaggaacaagtataaagcatattatcatgaacatatgatatgaatatattacaatcatatttaactatggatggaaataagtatacagatggagtagttatatatttatttaaaatttcttcaaagcaattattatttaaatatccatttatatattttacacaatatttattttcatggttttcacagtaggatatatgataaaaattcaattgatcttttaatacagataaataaattttatttttattagaattagtaatttgtataggagaactccaatttaaattacctacattaaatgtggatgaataaatttgaggaaattcattttgttctttaaaataaaatacagtaggaatattgttagtaaaagaaactatgaaattatctaatataggaagatttataaaatctaatttattctcaatccattgttcacaaaatgattattatatatctaatatagctttactaaaaaaatttagaggtattggattgtctgaaaaattattaaatactgcttataaattagcaaaagaagaaggctataatagaatttgtcttcatgctaataatgataagcttgttaactattataaaaccttaggattttcattaattaattctaaaacaaaaaaaatgactaaagatttattataatctttagtcattttttaattatttaatatcaattttatttatattctataattcctttttccaaattatatatatgtttaaaaccttccatttcaagtaaattacacgcaattatacttctatggccacttctgcaataaattataacacttttatctttgtaatctataatctcatctatatcctgcatcaagttttgtagaggtatatttatagctccatctatatttttttcatcaaattcttcttttgttcttatatctattaataacgtatctttctcatttatcatttcttttaatttttcattatctatatttatataattcataattttcctccataatgtatataatttttatatacccataaattaatttaataaaactaaaaagagtagtaataattactactccttaaatttcaagttaaatcccattctgtctgttcctattatagtattttcaaatatatctgtagcattatcaatatagatattaggatcttttattataggactaaaatgagttaatactaaagtttctacatttgcattttttgcaatattagcgctttccctaaaaatcatatgcttatttttaatagctttttctatatcattatcatctccatacattccttcacatattaataaatcactattatcaacaaattttataatatcatcattaggtcttgtatctgttacaaaacttatttttataccctttctaggctgtcccattaccatatcttttgtatataatttgccatctaattttatatctctaccattttgaagtttactccaaagaattttaggtacatcatttgaaatagctttatttatatcaaatttagcttttctttttatataaaaactataagctatgcatggtgatgaatgatctacttctacagtagatattattatatctttacttatataattattatttactattatgtcttctttaggtgcttctataatttttatttcatatggaagttcttttactataactctaaaggcttctacagcttcttttattccaactggacctattatagttaatggttctaaccttccactattacctatagttgataatataccaggaagtcctattatatgatctccatgtatatgagttatacatatatagtctattgacttaaatccagagttcgctattttcatagaaacttgagtaccctcaccacagtctataagtatttttcttcctctgtaatttataagtagtgatgaaagatatctatcaggaattggcatacctccaccacatcctaataattttatatctatcataatatatcgcctctttaatattttaatttatgctataatatttttattgctatcactatagtatgcattttttactatgtgatgataatttgctaatgtctgatttttatatggattaatccatatagatgctaatttaaatgtaaatatatctaatattaaccaaggtataaaactcaaagtcaaaataatatactctcctaatcttcctctcatcataagcatactgtctcgtaaaacttcagttccttttaattcttcattacataccattatataatatatttgagaaagataagtttgtaatataaatgatggtataaatattataatagccattattattggaattaatgcttgatttggcttaattatcataattatagtagtagttaaagttactaaagatgaagtcattaaatatgttataaaagttctaactatatatactataccttggcgaaataatttaactttataaccataaaataaatctaatatgcctacattacgtccttctatagtacagttgtagtgaatatatgctatacctagaaataatggttgaactattgtcattattataaactttgtaatagaatttaattcattattagatattagttgcattataggtataatcattgtaagtatactaaatattaagttcgaaaatattaatatactagttttacctttcatctgtgattttgccaagttttttagtttagctgtctccaaaaccttttcctcccctgtaaaatatattgtccttataattttagtgtgtatttaaattatattatatattttactttttatctacttatctttttttaaattgttatttttttacaaatagtcaaaattttttcacttaaagtacattttaaaattattttatctatatcgaattaaaattattttctcccttacttatagagaatattctaaatttttactaatatactattaataacttgtttttcaaaccaataaaacgaggtgaggttttaatgaaagatttaacagttggaagtgaaagtaaatgcatatttaactttgcactccccatgctaattggtagtttatttcaacaactttataacactgctgacagcgtaattgtaggcaggtttgttggtaaagatgcaatggctgccgtatctggcgcaaatcctataatgtttttattaacttcatttttaatgggtataacattgggattttccatattaatatcacaatattatggatctaaaaatatttccaaagttaaagccaccatagatacaacctatatatttatatttatagcttcattttttataactttaataggagtttgttttagcgaaaatattcttaaaatcatgaacacacctaatgaaatatttgaattatctaaaggatatttaataataatctttgcaggtactttgttttctactggatacaattctgtttgtgcaatattaagaggtcttggagattctacaaatcctttatattttcttataatatccactattttaaatataattttagatatagtttttataatatattttaatttgggtgtaaatggagttgcattagctaccataattgctcaagcagtagcttttatatttagtgttgtctatcttaataaaaaccatgatgttttaaaaataaaaattaaaaatttaaagtatgattctgaaatttttaaaactggactaaaacttggattaccttcagcaattcaacaaacacttttctctgtaggtaatataacactacaatcattagttaatagctatggaactgctgctatggctgcatttggtgcagggtctaaaattgaaacatttatatcacttcctataatgaatttaggtagtgcagtatctactttcgttgcacaaaatatgggagcgggaaaagttgaaagagtaaaaaaaggtgttaaatcttcaattattatggctttgtctatatcaatattagttatagtaatatttttcttatttaaagaaaatttaataaaactttttaatacagatttagaagttattgctatcggatctagatacttgcttactataggaccatttttcatttttataggaacttcatttatgttaactagcgctatacgtggtgctggtgcctcaatgtttgccatgataagttctatgatctctttgtggatagccagaatacctgcttcatatttactatcttctttttatggggtaaatggaatatggatgggtatacctataggttggttcgttggattgatagttactggtatttattacaaaaaaggatattggaaaaacaaggcggttgttagtattaatgataaagttgatatttcgcataataaaattctagaaactgaatttgcttcaaccaaatctgattaatttttaatactatttttaaatataaatatctcttaattttaaattaagagatatttatattttttatatgtatattttcttctcactataaataagtatatattaatcaattttatttatatattaaaatttgtcagcttttatttcgaaaaatgcttttggatgagcacatactggacatacgtctaaagcttcatttcctttatgtatatatccacagttttgacatctccactctactacttcttctttttttaaaaatttatcagcttgtaaagtttcaagtaattcactatatctttcttggtggtacttttctatagctccaacttctcttaataaaaatgctatatgattaaaaccttcttcttcagcttcttttgcaaacttttcatacatagttgtccattcataatgttcgccagccgctgcatcttttaaattttcttctgttgttccaatcccatcatgaagtaatttaaaccacattttagcatgtgccatttcattatgtgcagtttcttcaaagaaatcagctattttattataaccttcttttctagcttttaaagcgtagtaagtatatttatttctagcttcggactctcctgcaaatgcattcattaggtttacttctgtttttgttccctttatgtccatactaatcctccaaatattaaagatatttattgggcagtgattttttatccctatatatagggtattatataccatcaaatataccccgtcaatatagtaagttttcttattatattgttgttattttctatattttatgtttattttttaatatcagaaaacaaaatttatttcaaataatcaaataaattttataatttgaaaaaatcttctccaaataaagcaaaactttgcaaagtcataaaagctttaatatctatttttatatcttcactaattaatttttttgcttcatctttattaactaacataggtgttatatcttcatcttcttcaagatatttagtacttaattcaccttcacaagtgcaataaactaaacttgcgctttcttccgtcataccaggagataagtacagttgtttattacccaattttttattaatttctaaaactttaagaccagtttcttcttttaattctctttttactgctaattctgctttttcattattatcaactaaacctgcaggaagctcataaacataatcatttaaaggtactctaaattgtttaactagcactagacttttgctttctttatgaaaagcagctatcacaacagcatctatttcatccttcttgttattaaaatatttgtcagataaaatatcatatccttttctagaagctatcatccaatgtttttcatttcctatcttattttcatatcttgcatcataaatacttaaaaacttagtttgtgcaagtggttttaaatctttgattttattatctttcataatatcaacctctttaagtattaatttacctataattatatatgtttattttttaaagtaaactacatttttaggatttattgttatttttacatcttctcctacttcatataaactattattagaacttatttttattaaagtatcattaatagaaacatcataataagtgatatctcctgcatatactttttttaataccttagcttctaatccttctatatgattaaagttgtgtatattaatatcttcttttgatatcatgaactctatatttttctcattttcattattatttaaatctatacttattaaatcggatttatatattccatcaattatatttccatttatataatttctttgaccaaatatatttgcaacttcttttgatattggtttttcatataaatttttaggtgtatcaaattgtgctatttctccatttatcataacagctatcttatcactcatcattaaagcttcttctttatcatgagtaaccaatatagtagttatatttaaacttttttgtaggtttaatacaaattctctcatttcgcttcttaaatttatatctaaactcgaaaaaggttcatcaagcaataatatcttaggatttacagctaatgttctagcaatggcaaccctttgtttttgtccccctgaaagttgacttggatattttttttcaaaatcttctaatttaactaaatttaaaagttctttaactttattttttctagtatttttatttattttttttattttaagaccaaactctatattctcaaacacattcatatgtggaaataatgaatagtcttgaaatactattactgcttccctattttgagtttttgtatttaaaactgatttttcatcaaataatatatctccactatcaggatttacaagtcctgctattaactttaaagttgtactctttccgcatcctgatttccctaaaagtgttacaaattctccttgatttatatcaatatttatatttttaagtatctctatattattaaaactcttcgtcaagttaacaattttaactgatgacattttttttctccttatcttttaagtaataactctctagtgatttttccatcaatacaactataaccaaacttattataataaacactatactatatagagatgatagtgttctatctccactttgaatatatggaaacattactagtggataagttattacactacctccacctattattaatgttaaaaaatactgactaaaagaaataataaaacacatactagatgctcctattattccaggtaatattaaaggaaatgttacatgccttaatatatctaccttattagctcctagcatacttgcttgtatttcatatttgtttcctattattttatatacatcagttattatcgttattccatacggtaagcatggtaatatatttataattataaccccaaatacagtgtttgccatgccaagtcttataaaggttaattgtattcccatagctacagctatcataggaattattattggagataaaatcaataattcaactaattttttccctctaaactcatataatgctatagctttagctgctggtatacttattattatagtcaatactactactgctaacgatattaataagctatttaataatatctttatattttcaaagcttaatatatattcaaatcctcttatagaaaagttaacaggtataatttcaggaaatacccaagaagatgttatcgcccatataaaaagtatcgaaagtggtagtattaatgataataaaatgatatttgttattaatcttcttaaatttttattcataacttcacctatgatttgtatttatataattttttgaatatataatcataaataattaaaagtacaaaacttatgctagctaatatagtattcatagccatagctattggtctttgatttaagtccaaactaatatagcttatatatgcattaactggaagtgctttcggatttgttgctcctatcaaatagggtacttcaaaagatccaaaagaaaatgcaaatattattataaatgatgaaagtatagtaggcattatctgaggaagtattataaatctaaatgtttgatatttatttgctcctaaattttttgatacttcttctaatttattatctatactttttaaaatgttaaacgttgtcatagcaataaatggtatacctttatatatatacacaagcattatacctattccatttttatcatttaccaagcttataaattcactagagtcttttattatattcaaattatataatactctagacaatataccagtttttgaaaatatagcaaaaattaatagtaccactactatgtgtggcactattattggtaaatttaataaaaaatatctaaattttgagaatctatctttagacatgaaataagctaacactacacctgcaataacagctattatagaagatattaaagatgtctttaaacttaaaaataaagaatctaaaaactgcttattatttagtatagttttataataatttaatgttatatcttctaatcctatttgtggaaaatatcctaaactttgagatatacaagtcattattcctatacccattatgaaaatcattaataaagttgcaggtgctataagtaaatatggctttaacttattcattcttattagctacctcatccatccaaattttctctattataggaactaaactagcttttatctctggtactggatttttaatctttactggagcataaaatttagatctatcttcactaggtactttgtttaaatctaatatagtcatatcaccccagtttttaggattacttttagaagcttgagcatctatacttgttaggtaatttatcaataccatagctccttctttattttgtgcattttcaggtatagctaagaaatgagtattagatatattccctttatcaaagtttataaattcactagttttgctaaattcacctgacttaattttacctgcaacttcattaggtgaataactcatagtaaagtaaacttcattatctgaatacatattatttaattgtggtgtatttgcaggataagttttccctttattccataaataaggttttatttcatttaagtaatccatagcaggctttataacctctttaactttagcttcatcttctggtaaattagctactttttcataacctactatatcgtaaattatatttcttacaaaagcactacctgtaaaatctggaggtgcaggatatgtaaatttacctggattattaattatagcttcttttaaagaactagtatttactatatttgaatttactttagctgaatcctttactacagtaaatgttgctttcccccaaggtgcttccatattatctacaggtgttccgaaatccgtagttatatctttagaatttttatctacatatttatcataatttactattttttctaaaaatggaccaaataaaagtttattatcttttgctgttttaaaattttctccatttaaccaaactacatctatagttcctttagaattttgagcttgcttttctgatattaatttattaagtatagtatctatatccatacctactcttttaacagttatattatatttttctttcatattaggtacaacataattgtcaaaccacttatttaaaacttcatttcctccccatccgtaaaaattaacagtagttcctttagcactttgtgctatttcttcataacttttacttaaaattgcatcttctgattttttactactattgctgttattacatcctactaaaaatacaagtgacattgttattaccaaggcaataatttttttcatgtcaatcctcctttgttgtttttattataaataatataacctcccagccaaaatttattaagctaggaggttatattttatttaactaatttataatcatgttcttcaacgccatcttcagcattgtaaacttttttaaatccgttcttttctaatatttttgcagctttttcactcctatttccagttttacaataaagtaaaactgttttatctttatagtcatctaatttgcttaaattatcattaaactcattatagtctatatgcatagctctatcaatatgccccatatcatactcatctttacttctaacatctacaactactatgtcatccccactagctaataaatcttctgtctctttagcatttatattttcataaccactagctgctttgttttcttcattagatttttcttttgaagaacatccaacaaggctacttatagttaaagctagtacaatacccatagtaaagattttagattttttagtaaatttcatatatatactccccttttatgtctttttacaaatatttgtaaatttcttaatttcacaatcaattataccaaatttatacaatcatttgtattgaaaattcctatatataacataactatcatagatatattctataataaataaaaaaatccattagcctaagctaatggatttaattacattttaaagttatacttactatttctggtttacaattaaatcttatcaatactttcgagccacctaagcctttacttaatatcattgtagtatcatttttttcatatttaccaaaatcatattttggaaaaaattctctattaggagaaagtactccacctattaaaggcagccttattataccaccatgtacatgccctgacaaaactaaatccgctccataattttcataatcatcaaagaaaaatggagtatgcgcaagcattaaattataatcagatttatctaacttacctaaagaagtatctataaattcacattcaagtctttttttcctatttttataatttttaaagaaataaggataataatctaacggaactataaatccataaacgtttatctttgaattacccttatttaaagtaaccttctcattgtttaagtttataatagtttttttatctaattctttaaaataatctttatattcatttttatattttttaattaaagatttttgttcatgattacctattatgtgataaaccttatgctttttagctaattcatcaataaaatttaaagctacatgaaagtttttattatcaccttcaactaaatctccagttataactactatatctggattttcattttcaattctatttaataactttttattatttttaccaaaacttttattgtgaagatcacttacttgaactattttaaaattatcaaactcttttggtattttactatttttaacttcataccttgttgtttctaaagtttcagtttcatatttataaagtaaagcacttcctaaaactatagttgagcctatcaaaaattgagtaaacatactattccctctctaaatttatattaaaatgcattttctaataatttaaaatactttttttctaatgatttatacagtggtacagctattatagttataactacaaattgaccaaatcctacttgtaacattgctaatataagtggcattccaacgaatacatttaacatagctcctattataattgcatttataactgttggccaaaatgatgctactagtaatgcatatttatttcctttcattattttactagttaaataaactgcatatacacttaaaaatgttgcagttgttccaagtattatatctggagctccatatggacctattatattagctaaaaaacaacctatagtaagtccccatatataatcctttcttataaacggaagtaataccataatttctgatattctaaactgtatcggtccataacttatggcacctaaaactaaagttaaagttgcatatatagctgcaactaatgctgtagtaactatcttcttcgtatttttagtcatatatattctccttattgtcttaaaatttaaaaaaccgtagaaaaaaactacggttttacatcaaaataataatataaaatactacattttaagacttaaccatagttttatttaaagacaggaggctttcgaactgtctttttaagttttaaagtaatttatatattatcaaataattttatttttttcaactaactataattaattaaaagtttcatttacttcttttaacatttttattatttttatgtgctgagggcatacagcttcacattttccgcatactacacatttagaagcatcgcttttttcatttattatatacttatacatattatttttaacatattctatttcattaaacatactagcattatttagtgcttcaaagcaacttgggatatttactcccatagggcatggaagacaatacttacaggctgtgcaatttacttttatcttagatttaaaagcattttttagatccattaaaatctttttttcattttcagtgatagaatttgattttccatgttcatcacaaattttaagattttctactacttgttccatggtagacataccactaagaactattcctatttcttctttatcatataaaaacttaaatgcccattcagctggagttttcttaggttttgctttatctattatgtcttttatttcatctgataagttatttactaactttccaccacgaagaggctccattattataattcccattccttttttatgagcatattcaattccttttgtccctgcttgataatcttcatctatatagttatattgtatttgtgtaaaatcccaatcatatgaatctactattttttcaaatacattatatttatcatgaaatgaaaaacctaaatatttaacttttccacttctttttatatcatctagaaattcaaatatattatttttaactaaattttgccaaagcttttcatctaaagcatgaattaaataaaaatctatataatcagtttgtaatttttctaattgtttatttaaataattatccatatcctctcttgaagttatattccaagatggtaatttagtagctaatttaactttttctctatatccatgttttaatattttacctactactatttcactttctccattatgatatggatatgctgtatctatataattaagtccattatcaattgcatatctaatcatctttgtagtttcctctacatcaatttcattatctatttgaggaaatctcatacatccaaatcctaatattgatatttcttcatttgtatttccaaattttctatactgcatatctatcccctcctaaacttactataattaaattatatactaaaattttcatttagatgtattaattattgtttgcttcatttatatttttaatatttaataaatttaatgtagtattttgttgtattaaaactcaatttatgatattatttaattacatgaccgcttaagcagtaatgccgatgtggtcttttttactaattataaataaaaggagtgatattaaaaatggacagtattccattgcggatatgtttgtttgttaaatcgcttagtataacctaataatcgcttaaatccctttattcaatcatatgtttaagcaattatgtagataatacttaagtgattgcttttaaagctgaataaaggagtgatcaaatgataagatactacaaaacaattgactctaaattagagaaattaaaatcatttgaaaatggttgttgggttaatttagttgaacctactacatctgagatacttgaagtgtctgctaatcttaatttagatatagaaagtattaaagcagcacttgatgaagaggaacgttcaagaattgatattgaagataatcatatattaatacttatagatattccaatagacgaaagtgatgcttcatctgcgcattactctactattccattaggtataataattttagataataccatagttactgtttgtacagctcaaactaaaatattaaatgattttatagtagggcatgttaagaattttttcacttacaaaaaaactagatttattcttcaaatactttataaaaatgctagttattatcttcattatcttagaagaataaataaaatgacgatagctatagaaaaagaaatttataaatctatgaaaaataaagaattagttcaacttttagaattagaaaaatcccttatatatttttctacatccttaaaagccaatgaacttgttcttaataaaatgcttagaactgagtctataaaaaaatattcagaagatgaggatttacttgaagatgttattatagaaaataaacaggccttagaaatggctactatatatggagacattttaagtagaataatggatgcatttagtgctatagttagtaataatcaaaatacagttatgcaatttttaacatctattacacttataatgtcaataccgaccattgtatcaggtttttttggtatgaatgttgaaggtttgcctttttcaactcatccaagtggattttggatagtcatcgtaattacatgtgttatgtgtttaatacttacatttatcatgtctagaaataaattattatagtttagttgactttttacaaaatttacatataattaaattataaaactaaattccctagaaggggagtagcttacacattggtgttaattaatcgtcatatcagtgtttatcactcggttaattagcaagatttatcttgttagcaagaccttctaaatgagtagaaattttctactcatttggaaggtcttttttatttatactttaaattaaaaggagatattgtatggtttatttattcttactacttggttttttatttttagtaaaaggggcagattattttgttgatggttcatctagtatagctacatcacttaaaataccatctttagttataggtcttactatagttgcttttggaactagcgctcctgaagcagctgttagtattacagcatcaattcaaggtcaaaacgagattgcacttggaaatattatcggatctaatatatttaaccttttatgtgtagcaggtatgtcagcttttataaaacctttatctgtaaaaaagtctatacttataaaggaatttccttttctagtattatcgtcaattttattattagttttatctgatgatttaatttttcagcaaacacaaaattctatattgtcaactggtgatggattagtatttttaatgttcttttgtatatttatgtattacctattagaggtttctctaaattctaaaaatgaagccttaaattctaataatagttatgatactaatatttataagtctactatgcctttatctaaatctgttgttttttctgtggttggaatattaggtatagtaattggtggtaagttagttgttgactgctcttctataatagctcttaattttggaataagtgaaaaaattattggtataactatagtatctataggaacatcattacctgaatttgtaacttctgtcgtagctgctagtaaaggagaaagtgatatagctttaggaaacgtcataggatctaacatatttaatattttattcatacttggtatatcatctgtaattaatcctatatctatagataataatctctttttagatatatttataatgataattgtcacaataattacttatatcttctcaattagaaaaaaagatataaataattttgaaggaatcatattgataatagcttatatagcttatatgattttagttatatttaaaaattagttaaatataaaaaagatataggattttatcctatatctttttatttaagcagctggcactgcttgctgttctgttgatggttgttgcgttgccggtggttgtgttgccggcggctgtgttactggtggttgtgttgccggtggctgcgttgctggtggttgtgttgccggtggttgttgttcaggtgtttctgatggcgtttccggcgttgttggttgttgctgttctggcgtttctgatggttgttctggtgtttcaggttgattttgctcagtttgttctgtaggttgctcttcttcaggttttgattcaggctttggacttgcactcattccctgactataattaacatcaactcctgaaaatggtcctactttatcaaagcttctactgtctaaatcactatgtataggcttcataacatccttccataaagctgctgctatttgacttccttttgctagtgattgatttctatcatttcctatccaaactgatgctgtgtagtatggtgtaaatccacagaaccatgcatcaaaattcctattagttgttcctgttttacctgctactgccatattagacattctagctgattttcctgttccactattaactgcaccttctaacattttagtcatataataagctgtattttgtgagtaaactcttttcttctcaggtttattttcaagtaatacatcaccatttgatagctctattttagtaaatgttataggttctacatacacgccaccatttgctatagtagcatatgcagctgtcatttcaagtggagaaacacctgtatccatacctccaagtgttgccgaatagtgtctagcttctttagcagttgttatacctacatcctttaatgctttttgaaccacttccatagcttctttttcattatttcctagcattgctgcgccttgaactactgcagcattatatgaatgcttaagtgcttcactcattcctactcttccatgatatgatccccctgcatttttaggacctggttttcctttcccaaagtaatttggtataggagcatcattcattaaagactgtggtgtcatacctaacttttccataagtggtaaataaactgcaagtggctttatagatgaccctggttgtcttggttttatagctctattatatagactatctccacctataccacgtccacctatcatagctttaatttggccattattattatccataataaccatagcagattgaggttgtaaattaccatgttcatccctatatgttcctgggaaatttgaatcatcattgtattctttttcaactaaatcttgcatagaagagtctatcgttgagtatattctaagacctccattgtataacatatcttctgcttcatctttagtgtatccttcttttattaaagcttttataacatcttttttaactaaagtattaaagtatgaagaatttttattatctaccttatctcctaattttatttttatttcttgttttatagcatcatcatattcactctttgttatatatccaagttctaacatcctagatagtacaacttcttgtctttttttagattcgctattgaactctgctttatataccacatttcttcctttttttaatgcatcatacgtaagaccatcaatttttccatcttctaataattttttatacattttcatatcatcatcagttggaacataatcttgaggatatattattatttgagcattttcaatgtcatcagcaagtgttaatggtgatgtcttatatgcagcatatttacttggatacttagttatacctgctaacagagcacattctgctaaatttaattcagatatatctttatcaaaatatttagctgctgcagcttttacacctctagtaccttgtcctaaagacattgtatttaaataagccaataatatttcatctttacttaaagatttttctaacttaagtgcatagtaaagttcttttatttttcttttataagtcttttcattagttaaatataaatttttagctaattgttgtgtaattgtactagcaccctgtgccttatatcctaatttaaaattttgtacaaccgcaccaattgttcttttaagatttataccaccatgttcataaaaagtatgatcttctatagcaagaactgcatttttcatattttgtggcatctcatttgcatcttttactacatatctagattcttcaccttgagtcttttctgttatttttttatttgaatcatatatgatagagttttctgaaaatatcatattttttggatctacatctggagtattaattagtatacctataataaatatacttacagctgccactccacatccaaataaaactaaaaaagttgttgctatttttttaattaggctactttttttctttttcttgtcactcatatttttgttattgccccccatcttaagttttaatatgggtttttaaccctataatataaaacatattatttatattatatacaaaatttaaatttcctttatattctcccaaatttttttacatatactacttatatctttactttttcgagcaattttatttgggtaccattgacttgtaaataactttttacatgtgctctgagagtatctatgatatataagcattataatacctttatctttatttgttcttatacacctgagcacagcttgcaatacttttattatccctggataagtatatgcataatcaaatccattatgactcttactatcaaaatgcttttttataatatctctatcaactcctatttgaggcattccaccacctataactataactcctagtaacttgtcattagtaagatcaactccttctgaaaagcgacctcctaatacacaaaatcctacatgagtatttttattattttgagagaaattgcttaaaaatatttccttactttcattactcatgtcttttgtttaaacttgtattttatatgttgatactttttactcatcattttataaactaaatccacataattatattataaaaaaataccatgtaatttccatgtttactttcaacacatttcttgatatattctactatatcctcacaagtttcatatcgtctattataagtggtatttatattatttgcaaatattaactttttttaatactttactaatatattaaaattgtaatttaattaaagcttttaagttcttaattaatactatgctctcttaaatttatctatatattattatataataatattaattatatttctattaactaccatattttgctaaatacaatttattatttatgggaatactaattgtataaaattatataggaggtatttttatgaataatagctatttaaaaagaaaggctattgaagaagctaagtatatatatgaagattattttacagcatctaaaacattagatacattcaattctgttcctggcatagaggtctataatatccctaaatattatcatagtacatgttgtcgttgtcttaatccatatcctcataatgaaaagaactatttccctaatgaaggtttcgtatgtgatgattgcttaaacaatcaaaccctttcttaaaaatttaaactccttgttaaatttacttttttaaattattattatataattaaataaatttgaccaaggagatttgacatgaatatacaaatatatgattctgctaaaaaagaacttaataaattgatatgtaataatgaagataaaaaatatataagaatatttataagaacaataagtttttggtctgatgctagaattcatttagctttagacgatttaaaagatgacgaccagttatttgttgtagatggatataatataattataaataaaagattagcatctcaaatgaataatatatatatatcttttggaggattattaagtccaaacgagtttaatgtagattgcgattttaatgaatattattaaaaagagtgtcaattgacactcttttaataatttaattaatcttttaccatatctataaaattttctaatttatgataattacctaacttatttttatcttttttcacatctgatttaactatatttgtatttcctttttctatatcagatatatctttttgtaattcatttaatttatctacaacatcttcgttaacattattattataaatataagctatcttatcattttgctttactcgttcaccttctttaatacaatattttatatttccagacatactagaatttagtaaatactcatcccgtattattaaccccttttttttaaaactatcttgtatagtctcattctttaaaaccaaagtatccatgttcttttttattactatcccaattatatttgaaactatataaattaatatacaaactaaaataagcttagttaattttaattttctcaatatatcccctccaacaataaaatgtatattatctatttcttcaagtagaatataactccttcttatattaaaattaacaataaaagaggcacatacaaatttcgtatgtgccttttttatttataaaataatagttattatatttgaacaaccatcattaattattttttgtaaagttttttgtatttttactctcacatcatctggcatcatatacaatttactttgtaattgatcttttaccaaatcatgtagtgatttaccaaacatattgtattcccatatttcatttggattttcttcaaaccccttaagaagactttctaacatttcttttccttgttgctctgttcctacacctggcgatatttcagttgatatatcagctttaatcatatgaatagatccagctttagctcttaatctaactccatattgctttccttgtttaactatttcaggtacgtctaatgtaagttcatctaacgtaggtgcaactaatccgtatcctttttctcttacatctattaatgcctgttctactttttcatattctgtattaactttagacaatctagttactaaatttaataactcgtattctccatctatcttaaatccacttttttcctctagtacattgtagaataaatctttcttagtacctaaatttatacttattataccttctcctaattcaacgttatcaacttgagtttcctctaagaattccaactcttcaaatccttttataatgttatttacatctcttataactccaacatcatctatactttgttttattgcaaatattatattattttttatccaatgatttttttctaaaccttctatccatttagggaagtttatatttatttcattaactgggaaatcatataatacattttccataactacttctatatcatcttcatccatagctaaaacatttaacggtattacaggtttgtcatatttctcttctaattctctttttaattctaaagtttcctcagcatatggatttaaagtatttaaaactataacaaatggtttttttagatcatttaactcctttataactctttcttctggtgcagcatatccttttctatctattcctgtaacagttccatctgtagtcatcactattcctatagtagaatgatctcttataactttttttgttcctatttctgcagccttttcaaaagtcatagcttcattagaccatggtgtagatactaatctttgcttaccatcttcctcatgtcctaaaactccatcaactatgtacccaacgcaatctaccattctaactttcatagacacattttcttttatttttatttctactccatcggctggaacaaatttaggttcaacagtcattatagtttttcctgatccactttgaggtatttcatcttttgttctttctcttttaaactcattttctatattaggtaaaactaacaactccatgaattttcttataaatgtagattttcctgttctaacaggtcccactacacctatatagatatccccctgagttctttttgctatgtcctcatatatattattcatctataaccctcctgcatacaaattcttaataaagtatattttagtatttaagataatattacaaaaacaaaaaaaaactagacttaaatgtctagtttctctttaactacctcttcaacttcatgagttctatttctcatcattaactcatcaactacttcatctggattagctccatcatgtaacacagaataaatagcattagttataggcatttctatatttaatttttttgctacttcataagcaacctctgtagctgtaattccttctacaaccatttttacttcttttaatgtttcttctaagcttttaccttgccctataagtattcctgctcttctattcctactgtgcatactagtacaagttactattaaatctcctatacctgatagtcctgagaaggtagatgtttcagctcccattgctactccaagtctacttatctcccttattcctctagtcataagagctgctttagcattatctccatatcctagtccatcacatatcccagctccaaatgctattatgttttttaaagctccaccaagctcaactccaacaacatctgggttggtataaactctaaacttaggactcataaatatatcttgaattttttctgcagtagttaaatcttctgatgctacaactacagtagtaggtatatctctagatacttcttctgcatgagatggtcctgaaagaacaacatatttgcattcaggcaattctttttcacatacttgtgaaagtcttaatccagttcctttttctaaaccttttgcaacatcaactaatatttgatttttgttcacaaatggctttatttgtttacatacacttcttattgcttgtgaaggtactgctaatactataacagagctatcatttatagcttcttttaaatcagtagtaatatgtatatttttaggtatattaactcctggaaggtaatctacattttctctggtgctatttaccttttgacattggtcttcacttaaagtccacatcgaaacattatagccttttttagctactacaagtgctaatgcagttccccagcttccagctcctaatacgcatattttttccatagaaacaccccctaagtacaatcaaagtattattttttatcgcctatttttctttctgttccatttaacaacctttttatattttctctatgcttaaatattactgatatagataaaaataatgtaacggctaagcctttataatttcctatacaaagcattattataggagatgtgcatatactaagtacagaacctaaagaaacatacttagttacatatactataagtataaaaaatgcaaaacagcttaaagctattattggatttacagctatcatagctcctaaagacgtagcaacgccttttccacctctaaatcctaagaaaactggccaattatgtcctattacaacagctacaaccgctatataagctgcattacttgcatccatctgagctaagtatgctataaacttagctataaatacagcaattacaccttttagtaaatcacctgcgaaagtcattattccagctttttttcctaaagttcttaaaacatttgttgacccagcatttcctgagccttgtgttcttatatcaacgcccatcatcctcttagcgattatataggaagtagatatacttcctatacaatatgaaataataattataattaggtaatttatcataatcatccctctaattcttatcttctcttttctttataatcaaatctaacaggtgtaccttcaaatccaaagttttctcttattttattttcaagatatctttgatatgagaagtgagtaagttccttatcatttataaataaagtaaacttaggtggctgagttcctgtttgagaaccatagtaaatttttaatctcttacctttatctgaaggtggttgattaagaagtacagcttctcctattacatcgtttaaagttgatgttggaactctcttagcatgttcttcagctatatatactacagtttctaatattttgttcattctttggttagttttagcagatacaaaaactatcggagcataagacatgaacgggaatttttctcttatttctttagtatataaactcatagttttatcatttttctctattagatcccatttatttattacaaataagcaagctttaccttcgtcatgtgcaataccagcaaccttagtatcttgctctgtaactccttgttctgcatctataactataagtactacatcagctctatctacagcactcatagatcttattacactgtatttttctacattttcatatattttactttttcttctaagtcctgcagtatctattaaaaggaacttatgatctcctttttctaaataagtatcaattgcatctctagttgttcccgctataggacttactataactctttcttctcctaatatattgtttaatatagatgatttaccagcattcggtttacctgttatagctactcttattatatcttcgtcatactctgtatttaatccttctgggaaattagctacaacttcatcaagtaaatctccaagtcccatactatttgcactagatatcgcaaatggaacccctagtcctaattcataaaaatcatatacattatcaaattgtttttgactgtcaattttatttacaaccaatataactggtgtattagtttttcttaacatttgagccacttctttatctgctgctgtaagcccagcttttccatcaacaacaaataatataacatgtgccatatccatagcaagcattgcttgatttctcatttgagataatattatatcattactatctggctctatacctccagtatcaacaagtgtaaaatatttatttaaccattcaacctctgtaaatattctatctcttgttactcctggtgtatcttctactatcgatattctttttcctgctaatttgttaaataatgttgatttaccaacattaggtcttcctactactgcaactactggtctattatcgctcataataatctcccttcttattttaatatcttatcaacgaaatcttttccttcatttaaacaaggaactatctcaatattcattatgttttttaattcttctaaagttatattatctaaaaatatttcttcatctgccttaagcatacttcttggtatatataaagtttgtcctaaatctttgtcttttaactgatctattatatctgttgctgttattaatcctgatacagttattgtatcaccaaagaaattatttattattttatatactgtaatttctacacctttacacttttgcattatacaatttgccatatcttttataaattcatatgctgaatgtcccgtagctatagatactttcttagttatattcgttttttcttgaggtatagtatctaagtaatcttttatctctctttctaatttacttatcataccaaccccattttcaaattgtatgaatccttcatattcatcatattctaaaagttttttattagctatcatgtaaaactcatcagataagaatatgaatctagttcctagttccttaagatacttttcttgtaacttgtgaactaattcaattgtttcacctgctgttttctcattatatatctctaaatgaggaagatgttctctgtgtttagttatacctacaggaacagcagcagcactatttacatatggatataacttagttaaatctgatacagttctttctaactcttctttgtcattatatcctggacataaaacaatttggcaattcatttgtatttgtgcatcagctaatcttttcataatttcatataatctacctgcaaacttattttttatcatagtttgtcttagttctggatttgtagtatgaacagatatatttatagggcttattctatatttaattatattatttatatcttcttcactcatatttgtaagagttacaaagtttccttgtaaaaatgataatcttgagtcatcatctttaaaataaagtgtttctctcattccttttggtaactgatctatgaaacaaaatacacatttatttctacaactttttgctttatctattataggatttgtaaattctatacctaaatcatcatcataatctttttctatctcatatacatatatttcattatttttcttttttatttcaacttctaagtactcatcacttaataaaaatttatattctattatgtcatgtataggttgatcatttatagaaattagtaaatctccaacttctatgcctaactcttgtgcaatactgtctttatatactttacttattatattgtttacattttttacatttacttccataaatttcaccacttttccttttaagtacatcacattatattaacatgttttatttgaaatagtcaataaaaaggtaccattagcggtacctttaatgtcttactattattagagttcccttgagtacatcatgtaccattccacccatagtttttgagattattaaagctctatcttgtaattctttttcattttctgcataaaacacaggaaaaattgatgatttcatatctttattaatagtaacaatagctagtgttgtatcagttatacctacattcattaataacactcctttttattgttttatagtaaaatcttttaaagcccagttgtttcctcttgcattttctattataggagtactcttaactgctgctattaatttatcaatatccttttcaagtggtatataaggcattactaagctttcattttttggatttcttcttaaaagtggtataaaatctggctcatcaggtgttctcattattcctaatcttgaatatgctatatttgctaaagtttgtctttgtccaggatttaatattataccagagcttatataactcccttttttaggtattatttctacagctaaaccatgatttaggtatctttgtcttgatgattctaatcctatattcgaaataacaacatcattaacttttaataatggtccatcaaaagatattttagctggaactacctctgctatagatcctatactctctcttacaaatagctttttaaatataagtgccaatgctatacctgcaatagaacctagtataatacttggaaattcatctaaatataattctgtttttgcaagatgataaactgaagatgtagtaagtgctgttagtatacaagtatagcttctaacctcataagttaaagctatttcttctatatatccttctccacgctttactaaaagagatttttccatatccattagtgaacttctcttagtgtgtctaacttgtctaaattggcttgctgctaaagataaaaaagttacagatgtatatgatttttgcatcaatgcaggaactaacatagctcctaatgcagatcctattaccgctaacacaatttgtgaaactaacatattaggctctgttggatactgctttctatctgttttaagtgttattattcttgaaataattcctattaatatacctattaaaaaaattcctttcatatattccacctcttaggattttttatttttattgttcttactatatgcattgttatttccctttgcactgtctagtataggtgtactttttatagcttcaacagttaaatctatatctttaacaagtgggataaatccaaaattcacagatccatcttctgtatttgttcttgctataggtataaattcaggctcatctacatctctgtctattcccatatgcaaatatacattatgtatcatagcttgttgttgagcagggtctccaattatacctgcagataccatatctttaggtataactttaaatccaatacctttttttagatatttttttcttgaatcttcaagccctatatttgttatacctactccatctactaacattaaaggtcctttaaattcgataggtacgaccttaacatcaacaatatcttctaagcttttattagataatatttttttaaatatataacctactattatagttgctatagctgacgatatcacacacataacgaaattaaaattcaacttattattacataaaataaatgtaatagatgctgctaaagatgaaaaaatacttaaaaaatttctaacttcatattcttttgaaatttcatgtatataagttgttccttttgatatcaattctgtattttctaaatttgatagtgtaatttcttcttcactagctacttcttgaaattgttgtatacctatagctaaaaaagttaaggccgaaaactctttatctaatagtgcaggaaaagctactgccccaagtgccgatgcaataaatgataaaattaattgttcaatataatcttgaggttgtgttggctgttgtttatttactaatcttaatactataagcctagataaaacacctaatattaaagcaaccccaaatgcacgcctaaataatgtagcatcatccatattatttcctccttttgttttcattacatttattttgtacaaaaacaaaaaaaaatttccttaattaaggaaattttttttaggtatagtaactataaattcagttcctacatttaattcacttttaatatcaatagatccatttagtgattttactatatgcttgactatagccagtccaagtccagttcctccaaccgctcgactcctagctttatctactctataaaatctttcaaaaattctatacttatcatcttttgatattccaataccattatctttaacttttatacatatatctttttcattattataaataattgtttcaacaaatcctccactaggagtatattttatagcattgtctattaaatttaaaaatacttgttttatgtaatctctattacaattaattataatatcttcatcttcaaatttatattttaactctatgttttttgactttgcaaaaatgatagttaaatcgtatacttctttaaatacactcaatacatttactttttcagcatatatagtatctttattttcgataaatgaaagaagtaaaatatcatctataagcctctttaatctgtcagattcagtttcaattattcctaaaaacctgtctctagtatttttatcaatattttcgttcattctaagagtttctacaaaaccacttatagatgttaaaggagtttttaattcatgagtcacatttgcaacaaagtcacttctcatattttctaaccttactctctctgtaatgttttctatatttattatagatcctattataacatttttactactttgtaaataaattggatctagttttatattgtatactatatcttcatcattagtaatttgtttcatctttgttttcttagatcctataaatttagatatttcagataatattctattatcttttattacatgatttatatttttaccttctataacttgatcatttgaactttttatcatattcctagcttctttatttatcaataaaacatttccatttatgtctatagctaaaataccatgtgatatactttttactatagattttaattgtaaatttttatattgaacttcttgaatagtcttatctatagtgtctatcatataattaaaattatcaattaattgccctaattctccttttgcagagatatttatttttgtatgaaactctttattgcttatttttttagaaacagctataaattcctttaagtaattcctaagattcatagcatatcttatcgatattatagaaattattatcgatattaaaaaaaagaaaaaatatatattatcgttttgcataataaatgctccttaatctattttataaccgatacctctaatagtttctatatatttttcatcttcactacttccttctattttttttcttaaatatcgtatatgtacatctacagttctagtttctccatagtattcatatccccatattttgtctaataaatagtttctagataaaactttccctttgttttctaataacaatcttaataattcaaattctttgaaagttaaatcaattttttcacttcccttaatcacttcatgcttttgtaaatctaactttagattgccaacacttaatatagtttctttagagatatttttatttacattatatcttcttaaaactgaattacttctagctaataattcttttatactaaaaggcttagttatataatcatcagctcctgcatttaatccatctattttatcattttcaatatttttagctgttaacattattacaggtatattttttaaatccttatcacttcttattttctttaaaagatctataccacttatatttggtagcatccaatctaataaaattaagtcaggatttatttccttagctttaataaatccatcaaatccatcatatgatgaatacacatcataatccatggtctctaagttgaatttaagaagttctacaatatgcttctcatcatctataacgagcactttagtattcatcttaagttagctcctctctaatttatttcaagtatcatccctaatctttttgttgtttgattatgctttctataagaatggaacttatcgctattacaactagtacatatatttaaattaattatattttcttctttcactccacaattttttaatattaattcatttactttccataaatctagataatacttgtcttctttaattatatagaatttttcatcgttatttgtaatgattgtgttaaatttttcaattaaatcttttgatacttcatagcaacacggtcctatagatggtcctaatacacaaactaactcttttggatttgtattatataagttcttcattttttttatagcattttcagttatcttagaataagttcctctccaacctgcatgacataatgcagctactttattagttggatccataattgctattggaacacaatcagcaacaaatatcaataatggagtatgttttagatttgtaattaaagcatctccttcttttactttccctatatcttctttttttattatatttactatatctgaatgtgtttgtttattgttagttaagttaacataattcatatttaattctttacaaatattttttctatcttctttagatgccatatctacatttatagttgtaaatgctaaatttacaaaatcactctttttagttgcatcttcaaatcttatataattgttcatagtctcaccttttctccattattatgttttttaattcttttacaaaagtatttatatctttaaattgtctatatacagatgcaaatctaacatatgcaacttcatctacatcttttaacttatccataaccatctcaccaatctttttactatcaatttcagatatataacatttatttatatcattttctatgtattggattatatcctctatttgctctatagatacaggtcttttttctgatgattttaatatgccattttttattttatttctatcaaaatattctctactattatctttttttataaccattataggtgttagctctattttttcatatgtagtaaatctttttttacaagattcacactctcttcgtcttctaattgattgactatctgtatgtcttgaatctattacctttgattctttatagttacagtaaggacataacaagcctatccctcctcttcattgtatctttatatattaaattcatctaaactatgatcttgaccttgattaactattatagtatcacaccctatttttattatatcattccaaaaaacaacttgaccttctgaacctcttgaaaagaagttcatacttccatcccctattatattaaatgatactatttttccttcatttatatccatatctatatctgttatgaatcccatccttttaccattttttacatttattacttctttatccattatatcagaaattctaatcatattataatctacctcctcttaaaaataaatatgtacaaggataaaaaaaaatgaccttgttggtcatttttttaattattttttaattctatcatttttataaattgttctactaactctggatcaaactgagaacctgagcatcttttaagctcttttatagcttcatcatgtccttttctaaaattgtaaggtctatgagatgtcatagcatcaaaactatcagctatagctatgactcttgccaagtatggtatttcttctccttttaatttatctggatatcctctaccatcatacctttcatgatgatgttttataagtggtaataattcttcaaaagcttttatatgctttattaactctactcctagaactggatgttgttttaacaactcatattctgcatcagtaagtttttcttttttatttaaaacttcctctggaattttaattttacccatatcatgtaggtacgcagctaactttaagttcaatttatctttttcatttaatcctaagtagcttgcaaaccaacctaaatatattacaactctttcagtatgtccatatgtatatctatcttttttatttatcatatttataaatctttttaaagatttagttgtttcttcatctatgtatatatgatcagctatttcttctaaaacactgtaatatacttctaccctatttttacttaaagatttagctctatacaatgcatcgtctgcagtatttataaattggtgtttgttgcttgcccttaatgggtacgatgacactcctattgacattgtcacgttattattgggttgattttcctgaccataaaaataagtttcttctatatttgatcttattttttcacctatctttattgcttcttcttcagttgtatctggaagtataactgcaaactcttcccctccatacctagctacaacatcaggttcctttacattagctttaagtatataacctacttcttttagaactaaatctcctgcttgatgcccatttatatcattataatttttaaaataatctatatccataaataataatgatacagatgtattttcttcatcagcaattttcattttattctctaaagattcttggaaatatctatgattatagagtcctgttaattcatctaaattcgctaatttttgcaatcctttactatactctttttctatatttacatacattccaagtatccatgatgtaactaaaaaagcactaactataactatatcaatttgaaaatactcaataagtaattcttgtacagattcatttaatgaatttcctaatttaatagataatatgtctactccacatactaatgtagaacatattatagatacatatattgcataatttcttccaaactgtatagatgaaattattattataaaaatatataaaaatttataagggctttgttcttttcctgttgaaattataattatggtagaaattaacataagtaataaaatttctatattatcccttattttaggtatacaatttataattttatactgctttttagacacccatataaaatacacaattaataaaagtattatagccactatataaataagaaataatgtatattttaaattggctctgttagcatatgaacttatcatagctaccattcctaaaagcatgtatataacttttattatagctaaaatttcaaatactttctgatcccttatattgttaaattcatccatagccttctcctaaatgtcttttatcaattaataaaccataaggattcttccttatggtttattttaattattcttctcttaatgattttggcatttctggttcaaagaaaatcatagtacacattgtagatgccccattacctaaagatgttgcaaaatctgagaataaattcactaaaaagttcataactaatcccccttaaaaattttttatttaagaaaacaatctatttttagtataattgtttctcctagcttagttaatgatattgtttgcaatataattcctaattctatacaatatataaaactagttaaattatatttaataaattcagtttgtccaactaaaatacataaaattataatcacaatatataaattaagtaatctaaatactttttttctaagtttttttctagtagactcttttttaagaggcttatttttagtacctactggtgctttcttataaaatatataatagcaaaaagcaataattattaaactaaataaatatataaacaggctatccccatatatattaaatatcccacaaatataagttaaaattacactaaacatcaatcctattataagacatctattaggtgaagttgcatgtacacctcctgaacatctttttaagcttgatgcaactaaagtaattataagcatttcctttaatcttcctattaatattcctataattatggtgattataaaagctacaatagtatgtaaacatatgaacagtccataattcataacttctatttcatcttttgacttgttcgccttttctccaatttttgtcgctatactatttgaaacgttttctatcatactcatatacttctaacccctgtttaactttttagtaattaattttattacaataattaataaaataaatatcaacaaagaagggagcgctaataacgcactatatacacttgtattagcagttaaaacttgtgttggtattttaaaaacacaattagctataatcatatatatcccttcactaattgctaagcatatataaattttagctatatttaatatagtcgttataatttgttgattttttaatttataaaaaattatacctattacaaacatacttaaaacggtatgtattccaaagcttatcggcatcattctaataaaagttaaaataattaaatacaatatagaatttttcaaaacatctattatatcaatttttaaattaaataaaatatacccagctaatattaaaagtacgctttctggaaaacttctaataaaaatatatgataatgacgaacttagcattaaattctccttttttcttagataatacacaataaagtatagcataatttacattcttttacaattaatatactatcttctacaaataaaaaaatatgcaaaagcggattcgcctttgcataaaatttcatatatattttctcatattttttaatgcatttttttctatcctagaaacttgtgcctgagaaataccaatttcatcagctacttcaatctgagttcttcctttataaaaccttaaatctaaaactaatctttctctaccatttagtttttttatagcttccttaagagctatttcttgtagccaattttcatctgtatcttttttatcttgaacttgatccataacaaatattgcatctccattatcttgatatacaggatcaaataatgatataggatcttgtatagcatctagagccataactacatcttctacatctaactctagctcttttgctatctctgaaacagttggttccttagagttagatcttactaatctttctcttacctgaagagctttatatgcaatatcttttaaagatctacttactcttataggattattatcccttagataccttcttatctcacctataatcatagggactgcataagttgaaaatcttacattttgacttaagtcaaagttatcaattgcttttataagtcctatacaacctatttgaaataaatcatcgatattttcccctctattattaaacttctggatgacactcaaaactaatcttaaattgcctcttacaaattcttgtcttgcaacttcatctccatcttttatcttaataagaagttctttcatttgattatttttaagaactggtaactcagaggtatttactccacagatttcaactttatttatttgcattttatctcagtcctctcttaaaaagtatttcttatacaattatttacatatcatatatttttatactttctaagtagaattatttataagctaaacaaactttttcatctcttttttcaatctagatattatttttttctctaatctagagatataagattgggaaatgcctaacattgtagctacttctttttgagttctttcttctcctttgctagctaatccaaatctaagttccataatttgcttttctctatctgatagtctatctaatgccataaccaataaatctttatctatctcttcttctattaccttatatatttcatcattttcagtacctaatatatcagacaatagcaactcatttccatctaaatctatatttagaggttcatcaaatgatacctctgacttttttttattattttttcttaaatacataagtatctcattttctatacatctagaagcatatgtagctaattttatatttttatttagtttaaatgtgtttacagcttttattaaaccaatagttcctatagatattaaatcttcaacatcaattcctgtattttcaaattttctagatatataaactaccaatctaagatttctttctatcaatatagtttttatactctcatcactttctaaatttttaagtaactcagcttcttctttacttgaaagaggtggtggtaatatatttacaccgcctaaataataaagcccttttgcctttaataaaccgagtttggataaaactctaaaaaaataacttatacattttgtctttaattttatcaatttattcaacaatctctcccccttaaaaaattatatacccattaatagttgtggatttaaaatagcactatatccatcctctttaaaatttgataaacctaaaataacattaggtatctttttgccatctatttctatgtaatctgattttattcctattactaaattctcatcatttatttgtctcacaggtataattctaattctataatatacatcttcaccaatctcatctataacatcattaacagtattaatactaatattttttaaatctattttttgtaattctttaggtaaaatttcatataatttattagcacttataattactacttcgtcctttgttatgggatcttttaataaattccctgtatcgattaaagccctaagctctaattcatttttatctatacacacttttatatcttttttcatactatttaagtattttaattcctttatatctttataaatatatttaagaataattccacttatatacgatattaaaattattaaagatatattcatatgactaatccctgtaaaatatattataaaaaatgaacttccggctataaatatattaacaaaataaaatacaaccaaaattcttatataatcttttaaatctttataatcaaaacttatcttcgcaatagtcagtatcaataatattttcatgggtagtgtaaaaattaaatctaaatttggaagtaaataagcaatagcgtatatcattccgactattgcccctgtccatttttttttattagaattataatttttagttaatattgatgtacaacttattataatataatttattaataagttctcaattgcataatattctacatacactatcatcccccccttaaagcatttatctatattatagtttaggttaaatgagttttatgtcataattgatagtcgaattataattaatttattatttaaaaaaacaaaaaatcgcaaaaaaaaagaagatagtattatcttcttcttcttaggaatgttggtatttccatatcatcattttctatatatgatggacttgcgctttgtttagcaacaggttcttcttctctctttggttcttgcattactggtctttgaacttctcttgccatattatggtttatattaggttgttgaaatccttgattttggttcatcccactatttctattaaaatctaattccatatcttgtccatcttcaaatccagtagctattactgttataacaagatcatcctttaagtcttcttttattgtagctccaaatattatgttggcttcagaatcgcaagactcttgaactaatgttgaagcttcatttatttcaaatagtcctagattagctccacctgttatattaagtaagacacctttagctccttttatagatgtttctaataatggtgattgtatagcttgagttgctgcttctatagctctattttcaccttgtgcttttcccattcccatatgagctaaccctttttctttcattatagactgaacatctgcaaagtctaagtttattaatccaggggcagctataagatcagatattgactctataccttgttttaatacatcatctgctatagagaaagcttctagcatagatgtatttttttgaactatttgtaataatctatcattaggtatagttattagagtatcaactttagtttttaattcttttataccttgttctgcatttttcattcttactttaccttcaaatgcaaaaggcttagttacaactcctacagtaagtatacccatttcttttgctagttgagcaactactggggcagctcctgttcctgttcctccacccattcctgcagttacaaataccatatccgcaccttcaaggacttttattatttcatctttactttcttctgcagatttcttcccaacttctgggttagctcctgctcctagaccccttgtaagtttttcaccaacttggatcttgtgctcagctttagatgtatataaagcttgtttatctgtattaacagctataaattcaacacctttaagttgtgcttcaaccattctattgacagcgttatttccaccgccacctacgcctattactttgatttttgcaaagttatccatttctacgtcaaagtttagcatctataaacctccttatttaatattcaaagtaaatctatgtattaattatatcattttatattagcattttgttaatatttaactaacttattccacaaaaaagtttattttcctctttttttatttgataaattggatataatatatctgcttataattaacaaattgtcaaataatcttattctaaacactaatatgacttaataatacataaatttttctaatctctatcctatataatataaaacattgcaattaatatattgcaaaaaattcagttataaatataatattgttatatttactgtcaaaacttgattttatataccaacgacataagccattattttcattcaattaatagaattaaatctttcaaaagaactaaaagatactacaatcgaagtaaatactcaaatttcaaaaaaaatatcattagatataaataataatatgagtaagttatgttacatagagagatacataaaaaatgaaatcaatgaacataaagccaaatatgatgaaaatgaattattaagaaagataaattttataagtgatggtaagttatttaaatacataggtatagtaaacaaaaatggatatattgattttggtactgatcaaaaagtatatgtaggagatagaaaatactttaaggatgctcttttaggaaaaagtacagtaagtgatttagtagaagataggtttaataatgaaccatctatagtatattcaaaaccaataataataaataatgaagttaaaggtgttatagtcggagttcagagtgaagatattttacaaaaaagtttagttgaaaatgtctttccagataatataactgtagatatagtcagtcaaaatggtagacttttaataacttcaaaaggagaagaaacactttatgcaagttatataaaaaagggcatatctaaatataatgaacaaaacttccaagtatttaaaaaaggaaatgtaaaatatgtaatatcatttaataaattaaaagaaagtgattggtatgttgttacagtagcatctgtaaaacaagcatttaaaggtgcatataatacaattagtttagctagaatatctattgtggtaatactaatttcatatataatttcatcaacattaagagattttaaaaaagccagacagttaaaagaactgaaaggtaaagatggattaacaaatcttagaaatttagaaaattttaaaatagactgttgtaaaattttaaaaaatagtaaaagtgaagataagtatgtgaatatagtttttgatataaaaaatttcaaaagtataaatgaactatttgactataaaataggagataaaattttagtaggaattgctgaaaatataagaactatagaatttgaaaatatcagtggaagaataggtgaggatatattttcaatattatttaaagtagaagatgcaaatgacttagatagtaaaataaagtatttgaaagataagatttcactttattttgataagaaaaataaaatagatttagaacttaatgttggagtatttaaaataacagacaaagaaatggaaataggtaaaattatagataattcaaacgctgcaagaatggaagctaaaaaacatagagaatgtctatattatgtatataatgatgaattagaattaaaaatccatcaagaactaattgtaaaaaaagatttaaaaaatgcatttaaaagtaaagaaatagaaattttatatcagcctaaggttaatattcatacagaagaaatagaagctgtagaagctttaataagatggaatcataatgctttaggatatatttcaccagaaatatttatacctatagcagaggaaaatggagacatcaatttaataggaagatgggttataaaagaagtttgcaaagagttaagacaatgtaaggacaataatgaaaaaattgtgccagttgctataaatctttcaagaagagaattatatcaagtaaatttaattaattatatattaaatatgattgaaaaatatgatattgaacctgaacttttagaatttgaaattacagaaacagcagatgttaatgattctaaaatgataaataaacaagttgaagatataagaaaattaggtatgaaaatagcaattgatgattttggtaaaggtcattcaactttagaaaatttaaaaaatctagaagtagatacggtaaaaattgatagatatttatcactagatatagaaacaagtgaaaaatctagaaaacttttagagttaataattaatcttgcaaaagaatataactttgaagttgtatgtgaaggaattgaaaatatgaaccaaattaatattttaaaaaatctaaaatgtaatattgttcaaggctatgtgtattataaaccacttcgtatagataagttaaaagaaatacttaattaatataaaaaaatcctatatataaacataatttttcatgtttaatatataggatttttttattatatttatatataatatttattaattttaaatactttcaccaggaaattcatcaatttcactttcaggtatttcactagaaaaatcctcgacttcattttcagatgtttcactaggaaaatctttaatcttacttacaggcatttctttatcaaaatcccaaggatctcttacgattaatttgtttgcaaatggtatgaatgttgaaagtagtgttgaaattaatagtaactgacagaaccaaactaaaggcataacttgcataggagatacttttccatttgtgaaactagttaaaattaacatttgagcaccataaggtaaaaatccttgtaaaatagaagaaacagtacttaaaatagcagagcttcgtctagggtcaactttgtatctataacaaagttttttagcaacaggaccatttattataatggcaactgtattatttgcaacagctatgtctgttaaggcaactaaaacacctataccgatttctgctgattttttatctttaataaacttttgaacagctacaagaagtgcttctataccaccagcatgagttaccatttcggcaagaccacctgttaaaagagataataagaagatatctgtcatatttgtaaaacctgtgtaaatactttttacaaaagttaatattgttaaatctccataatacattcctattgctccagctaaaaatattccaccagttaaaactaaaaatacattcattccagcaactgctaataccaatacaaataaataaggtaaaactttaactaagttaaaatcataagcttgcattgtagcaggaacttctggcttaccaaatacaaatagtaaaactattgtaataatggctggaactaaacttaaataaaagtttatcttgaatttatctttcatatcacaaccctgagttcttgtagaagctattgtagtatctgaaattatagaaaggttatctccaagcattgctccacctaaaacacaagccattacaagaggaagagaagcaccagttttttcagctactgcaactgcaattggaccaattgctgcaatacatcctactgaagtacctgtagcagtagatatgaaactagaaattaaaaatataccaattacgataaattgtgaaggtatgtatgttaaacctaagtttactgttgaatcaacgccacccatttgttggcaaacactggcaaaggcaccagctaataaatatattacacacattattataatgtttgagttaccacaacctttaacaaaaatatcaaatttttcatcaatagaacctttaattaagaaaaaagcggctaagacaccacaactgacagctactggggctgggaattgataaaaggccatttctacgccttgagcttgaaggattataccacttcctaaataaactgctataaaaattaaaaatggaattaaagctttaaaactcggtttgactttttcttcttttctcataagaattctccttttgtattaaaattgtgacaattatgactttaaaaaaattgaacctagcttaattaaactaggttcaattttaaaccttaaagtaaatctaaggcttgttttaaatcatctattatatcttcagggtcttcaagacctacagaaattcttattaatccatctgaaattccagcttcagctctttcctcagctgtataaggagagtgagtcattgaagcagggtgttgtattaatgtctcgcaatcacctaagctaactgcaagagcacataattctaaagagttaagtaattttttacctgattctaagccacctttaacttcaaatgctatcataccacctggtaaatccatttgttttttagctaattcacgttgagggaagctttcaagtccaggataattaacttttactacatttttatgtccttctaggaacttagcaacttctagtgcatttttactatgtctatccattctaatttgtaaagttttcatacctcttaatattaagtaagcatcaaatgggctaagtacagcacctgtcatatctttaacaccaaataatcttacttggtttataaagtcttgtttaccaacaacaaaacctgctataacgtctccatgtccgtttaagtacttagttgctgagtgaagtacaacatcagctccccattctagaggtctttgtatgtaaggagtacagaaagtattatctaccataactatacaatctttcttttcatgagctattttagcaacagcttctatatctattaattttaagtctggatttgctggagtttctaaataaacaactctagtgttttctttcatagcagctttaacttcttctaaattagaagcatctacaaaagttacttcaactccatatcttgttaatccatgatttaataatgcaaatgtgcatccatataaagtttttgacgcaactacatggtctccagcttttaaagctgtccataatgctgaagatatagctcctattcctgatgcagtagacatacaagcctctgcgccttctagtaaagctactttttcttctaattgagtattagttggatttcctaatcttgagtatatgtatccaccttcttgaagtgcaaatcttcttccaccttgttctgcgctatcaaatacgaatgttgatgtttggcatattggtgtagttaatgctccagatacagggtctttatgatgacctccatgtatcgctcttgtagcaaattttttgttttttaagttttccatagtaattctcctcctagatttgattaaatagtagtgtcttactttgtgaaaacgattacttgcgtcttctcctttaatatagcactattggaatttatatacaaattcaaaaattttcaataaacttaacataataaaaaaatttcagattaaaaataggaaaacgtatataataaattattcttacttaaaaaatttatatatatataaattttactttatttatttcaaagtttatacaaaattaaaaaaatgttaaaagtttcactactatggtttaagttactgtaatttcaatggatatgaggagagtataaaaaaccctatatagaaatacaattttttcgtgtttactatatagggcttttattaatattttaagttgaaattaaaatttattttaaagattcatgatataaaagattatcattactatataaatacaaaattttatctgaaaattttatataacccttatctttttttataaaattaagtttagacataagcataggataaggtacttcaagactatctgctaaatcataaagatttgtttcatattttaatttttcaacaagctcactatcaggaattaaaaaattacaagcccatttaagagcctttaattccatagtatcaagattaactctatcagtataatgagtaagaactccaacaaaatttccatcagtagtaaaatgatgaccaagttcttctgataaaacttctagagttttctttttatcacctaaaattattttatttaaagttataataggtgggtagccttccatttttgtataaagacctaacaaagaaggcattaaagttgcagtttcaagaactatcccattttcctcacataattcatataacttgtctaatttatccataaacaattatccccctaaacatataaaaaactaatctttctttggatatttaaacataagatagttaagataactttctagttgttctctagcttcatttgataaatcttcacataaattaaccttttgaccgtcactagttgtaaagtattcttgtttatcagaatctttttcataagaattacttctatgagttgcaatagtcatatctttattatctagcgttttaactgaattaggaacacctattaaataatctgttgtaacattaaaaaactgtgctaataaatttagtttatcaaaatctgggtgtttatccttagtttcatatcctgcaatagttgctcttccaacacctaaaaaatctccaacttgttgttgagtaacatttttttcgattcttaaatctcttaacctttgaccaaacgacatgaaaattcacctccaattgtttttatatcatacttatattttatataaattgtgtcttagtgtaaacaaaaatgtgactattgtataaattttatagacaaggtaacaaaacgtaactataatcataaatataaagtcgtggctaaaagacacgataaatattttggtaacacaaagacacttaaaataaaggggggagtaaaatgagaacaaatttaaaagaagctagaaaaagtaaaaatttaactcaacttcaagttgcaaacaagctaaacatagacaggtcatattacacaaaaatagaaagaggacaaagaacaccatcattagatattgctttaaaaattaaagaagttctaaattatgaaagtgatgatatttttaaaaacaattaggaggtatttatatggagatttttaaaaataaggattttggggaaatcatggtgctaactacaaacaacaaagagtactttgatgcagtagagtgttgtaggattttaggatatttaaatccacatgatgcaataaatagacattgtaaaaaagaaggaataactttttacgagataggcatagtttctggcaaaaaaagaaatggagaagatattatccaatatgttaatagaaaatttatagatgaatcaaatttatatagattaattataaaatcaaagcttgaaactgctaacagatttgaaagttggatatttgaagaggtacttccaactattagaaagcagggggcatatttagataacaaaattataaacaatataataaataaccaagattttttagaaaatctaattgatagtttaataaataaaaataattcctacaaagaatttataaaagtcatagaagaaacaaaagaagttataagcataggaacttttgctaaagttttaagcaacaacaatatacatattggaagaaatagacttttcttttggtttagagaaaatggatatttaattaaaaatggaatagataaaaatcttccaaaacagaaatacatagacagaggatattttaaggttatagaaaaaatagttaaaactgaaaatggagaaaaattacaagcaaccactaggataactgggaaaggacaaacttactttataaataaaataaaaacagattatatgagtgttttaaataaaaaaattgataattgtaattaaaaggggtatattatgaaaaaatttttagatgcaaaaattatatacaatactaaaaacatgagtaaagctgagtggctagaaaaaagaagatgtggaataggcggttctgatgcttcaagcattgttaatatgagtccttttaaaagtagggctagtgtttatatagataaattacatagtaaaaattatgaagaatgtgaaagtgaaagttttaggatggatttgggaaataagctagaagattttgtggctcgtgagtttatgttaagaactgggaaaaaggttagaaatgtaaatggaattttaagaaatgataaatatccatttgctattgcaaacattgatagatatgtatttggagaaaaagcaatattagagtgtaaggttactaattcttttcaaaagaaagaatgggaaaaacaagttcctattcattatcaaatacaatgtcttcattatatggcagttacgggagctagttgttgttacgttgcagcacttattggaaatgaggattttgttattcataaattagaaagagatgaagaacttataaattacttaatgaaagaagaagaaaagttttggaaggaatatattttaggagataaagttccaattcctgatggtagtgaagattattctaggtttttaaaaaataaatataaaaatccaaaaaatgaaagtattattctttttatgaaggaagaaaaaatcaatagatatgatgaagttttaaagcttattaaggaacttgatttggagaaaaagtatattgaacaagttattcaaaatgagatgggagattatgaagtagcttttgtaggggatagaaagattacttggaaaaatcaaagtaggtctagttttgatagcaaaagatttagaagtgattttcctgaaattgctagtgagtatgtaaagactactacttctagggtgtttaggatgtagatatttagcttgtttcgtgggggaggtgttatatagtattttccttcactgtaaagcttaaaaacatggctttaacgtttcgccaaataatatataacaccttaactggaattgtaaggctttagattaaaataaatttatttataaataaagttagaaaaattactataattagtcttattatactttgatagtctagttttcctgtttttttgtagtcaatgtaataatctaaagctgtatatattaagagtagtattaaagttatgactcctagtaacttattaccgtaatctaaaaacattaaaaaaactacaaaggtcataaaaataagacaatattgcaaaatttttagtttagatatattttgtggttttaatataaaaatcacatccttaaattgtatgttaagtaaattatagttacatattttttaattttcaataaagggggagtttttgtgaataatttaaaaaaggaaataaaaaagaaggaagaaaagcttgaaaatttggagataaagcctgtttatgctatgaagcaaattatgataaagatgaaaaatgatatagaaagtagacttttaagtaatgttgattttgataagtttttaaataaagctattaatgtttttaattccaatgaaaattttaagtcttgtgagattatgacttttattaatgctatggttaagtgtgctagtttaaatcttgagcctaatagtgttttgggacaggcttatcttgtaccagtaaggtttggggaggactgtaaggttgagtttcaaataggttataaaggaatgatagagcttgcttatagaagtggaaaggttaaaagtttgtatgccaatgaggttaaagctaatgatgagttttatattgattatggattagagcaaaagttggtacatagaccatgcctaattggtgataggggagaggttataggatattatgctgtttatcatttagactcaatgggatctagttttgtgtttatgactcgtgatgaggttttaagtcattctaagaagtatagtaaaagctttgggattgatttgtgggaaagtgaatttgatactatggcaaagaaaactgttataaaaaagttacttaaatatgctcctttaagtatagatttgcaaaagtcagttttattagatgaaagtataaatactaatttacaagggggaatatagatggctgtttataggcatattcatatagatttttggcaagatggttttattttagatttaactcctgaggagaagtatttttatatgtatcttatgactaatagtaagacaagccaatgtggaatttatgagcttccaaagagaattatagaaacggaaactggatacaacagagaaactgtagagaagctactttctagatttgaggattatggaaaagttgtttatagtgaggaaactaaggaagtgtttttaaagaattggattaagcataataaaattgttagccctaaggttagaaagtgtatagaaaaagagcttaagaatattaaaagcgattatcttgtagatttatttttaaaagagtgtgataggtatggatacagtatagatacagttaatttaaaatatgataaggctatggatagtgtatgtatacccatagttgaagttgattataacgtgagtaaccactatggggaaaaagaaaaagaaaaacaaaaagaaaaagaaaaagaaaaacaaaaacaaaaaatagaaagtgaaaaagaaagtataggtatgtatgtaaaaaataatatagatgagtatgcaaagctttatgaagaaaatataggacttataaatggaatagttggagagtggttaattgaagtaagtgaagatgtagatattaaactttttaaaagagctatagaaatagctacagataataaaaggtgtaataaggggtatgttaatggaattattagacagtggagagaaaacaatataaaaacttttgataatttaaaagagtatgaagctagaaataaaaacaaagggggaagtgaaggtggaaagtatgaacagtctaagtatcaaagagagcttaaaaaagaggactcaaacctttatagaaagccaacagaagaagaacttagagccttcattgaagaagaaatataaatgtgaaaaatgtagggatttaacttttatactagatggggataatgcaactccttgtaattgtagagctttaagagaagctaaagatattttaaagtctagtggaataagtgatgaatttaggaaaaagacttttgatagttttaattatacatatgatattcaagttatagatgcttatagaaaagctagggaatatgctaagcaatttgatgagataaaaaatagtaggagaaattctataatgtttttagggcaagtgggttcggggaaaactcatttgtcccttgctattgccaatagtcttatgaatgattgtgtgggagttttgtatatgccttatagggatgttttaactaggattaagcaaaatattatggataaagaagtttatgaaagtattgttggtaggtataaaaatgcaaaggtgcttttgatagatgatttgtttaagggaagtattagtaaaagtgatgtaaatattatgtttgagattgttaattttagatattttaataatttgcctatgattgtaagttgcgagatgggaattgatgagattttagatgttgatgaagctgttgggagtagactttatgagatgagtaagagttatttggtggagtttagggggaagaagcttaattataggatttacgaatatgaaaaataatagtaaggttcaattatatgatagactattaaaaattattatattattcgacttatttaagataaaatatggtaattttcaatatatatatatatacttgaagtatatagtataaaatttaatacctctccaattttaaacatataataattatatgtaattctataaatattctgaagatagagatatttcatgtatagaaaaaatttagttagtattgtttaaatttttagattttttactgcaatatatggatataaatataataatcaaaaggagtatatagaaaaaaatggaaaggagtggtataatgggaaaggttataaacttatttaaaggagagattatgatgccgacagtatttgatatagcactagcttttctaaatatagagccaatgagtaataagaaattacaaaaactatgttattatgcacaagcatggtatttagcattaaataatgagcctttatttaatgagagatttgaagcctggattcatggacctgtttgtcctgacttataccacaattataagcataatggctatagaattattagaactaatgaaaccacatcagaagaaatgagaaaagacccttatttaatggattttattaacaacatatatgctatgtatggagatatgacaggtgatgaattagaagctttaacacataaagaattgccatggataaatgcaagaagaggactacaagactgggaaagttctaataatgaagtatctatgcatgacatgatgaattactataaggaaattcagggggaatagaagaaattgaaaataatctcatcacttgttttagggatatttataggagttttattaactataatatttattaaaatttttaaagaaaaagattttaaggaaataaaattaataaaagagtttataaaaagtataatatatagatttataaaatatcctatagaatggatattaggtttaattattacctttgtagttatttgtcaatttataaaaccaaatcctattgaaaaaagttcatttgatttacttaactttatatctagtgtcgcacttgcatggattatgactaaatattctgtcaagaatgattttgaagataggcaaaaagaagtatgtgttatttcttatggatatagtaataatatacatagaaagctaaaaagaagtataagggtatgtgatttaacacaaaaaaaattagaattatgcaattgtaatagcggaagttgtgatttaaaagataatttacatagaataagagacttaatgatttgcatagatgaagatataaatcaaaatacaactaattgggcaaataatatttcagaagaaatagaaattttaaataaaattaaattagagcaacaaaagataataaaaaaagaagaacaaatacaacaattaagtatagaaaatatagaagagagaaaagaaatagagtcattaaaaaatgaaatcaaagaagtaaatgaaattatatctaaattaaataaagatataaattcgaaaataagacatatgttaaataataataatgcaagtagtgataattatttagtagagattgataaagagataaaagatcaagaagctaaaatagagaatagatccagaggtataatagaaaaatctaaggggctaaaatctagaagctcagctgtttagaaattataatcaaataaataaaaaagacaaccaatcatctgaagttttccatcaattctaattaacaaataaatactaataacaataggaaaaacaatattagcaataagtgtttgaatctcagaactcataaaaatacctcctttcacacaaaacaaaccataaaacaaaattccaaaggagacataaaaattatagcaagacaatataaaataacccaagctcaaataagaaatatattaaaatcaaaataatagggcgatagtgtttcactatatctccttgaccacatgattatattaatattaaatcataaataataattaacttataaatacaaacttaaaatatataactatttgtaacagtgatgtaataaaagcaagtgatggagaagaagtacgcttttatgctaaacaaaagtgaaataaaaaaataattcaagtaaccttaaaaaggactatgaattttaattcacagtccttcaaatacatctaaatttttaaacttgttgattttgtgtttaaactttctggtgggaataacttaaaaaatattgttcttgcagatggcgaaacaatgaataaattcaatggtattgcaaatacaaaatttttaactatattactaccataagctgaaagtaagtgttcattaaaccctacatttacaacagctccataaaatgacatccataataccataccacatcccatgaaaaaggtcatacaaatagctttctttttaatagaatcattaggtttaattattttaggcattattttgcttacaattttcccaactataaaaacatctcctattagtgcaaataaaaaggcagggataaatcctaatatagcatgtttaagcacattaaaagataaaccttccattaaagcaatgttgtaacagctcattataaataccattgacgtacatatcattaaaataaatataaaatgttctactttattttttcccaaatcattcatctccttataatagtttgtaaacttagttgacaaaactattataaattctttaattaaaaatgtcaattaggttgacgaaaataatgataatattaaatttataatgtataatattcttaattgaatataatatattttaaatataggagagaaagatgaattcatatctagataatttaaatttaatagatttattaagtgaaaaacatgctcaacttcgtaaaattgttagggataaatggagtgaaaatgctggagaatatattacagatacagaatcatatattatagctttacttgaaagaaaggctatgacagcttcgcaacttgctagaataattgatatatctaggcaaggggcacataaaaatactaaaaatctaattgcaaaaggatatatagaaatagaaaattgtgatagctcttcaagagataaaacacttatactaactgaaaaaggtgaaaaattttgtgaagaaactttagttttaaaaaatcaattagaaaaatcaattgaagaagttattggtactgaaaatttaacagtgttaaagtcatgtcttaaagaaacttggttttaatcactttaaaataaaaacttacttataatagtcacactaaaagtcattgtaaaatatttttttaagtgtataatatataaaattaaacaatcagaaggggaattaacttgagtaaaaaaactattattggaggctctatactaattgtaatgatggtaattttagtgtctatatcgtattcttctaagatagataatccatttgttggactaaaaggattggcacaaatatctatcggtaaagaaaaagtcgaaaaaatttcagatgaaccactaagatatataagtaaatcatatgaagattttacaagttatatggagtcagagggttatactgttgagcaaatgggaagaggatttcaactgcaaaaagggaatgaaagtaaactattagtatctgaaggttttatgggaatgtatgaaatatttagcgaataaaaagatggcatataatgccatctttttattgtttaaataatgttaaatttcaacactatattaaaacatagcctaattttaaaatttatacttatacaaattacttagtctttataacattaatattcttactcaattcattaatactatcacaaagcacctgaagctttccctcaatcctaattaataaatacatactaatagcaatatgaaaaccaacatttacaataagtatttgaacatcagaactcacaaaaatacctcccttcacattttcacaaaaaaagtggcaaagcaagatggcgaaggattagcgaagaaattatatggaatctgacgcaacgttaaagccacgcctcaccggctttacagtgaaggaagaaccatataatttcaagctaacccgaagccccctaactagccaccaactaacctacaactaaatcaaactcagtaagcatttgaaaaaacaccctataaactacttataaattttatttaataaagctaattattattgtttgcaaaatatagaaatgatacaatgtgaataaatagtaggggctattaaaaagggggagatttataaatgaatattaaaaaaaatcataaagtagaggacatttcaacgtatttaattgaaaactttaatgccacagaaattacaatagatgaatttttagtaaacaatcaagacataagtgaagatacctttgaagatatttcaaaaattttaaaaatagaagatgaaaatattatccaaagtttattaagtgaaaatgaaaaagaagaaatacaaattacaatagaacatttaaataaaatagaagaggatttaaaagaagattgctcttcatatattaataaaataagcacaggcaagctaataattataattttagaaagtaaagataaaacaaatttatctggatttactatggaaggtgctggtcaaaaattatttgattatttaatgagtttaattgatgaacctattgaaaaaacttctaatccaatagatgaattaatagaagaattaagtcattttagaccttatggaaaatactttaagtaaaaataaaaaagtgagagtattacaaacatacactcactttttatatttatacaaaaactatcttaaaacttaaaatacactacttagctttcataacattaatatttttactcaattcattaatactatcactaagcacctgaagctttccctcaatcctaattaataaatacatactaatagcaataggaaaaccaacattggcaataagtgtttgaatctcagaactcacaaaaatacctcccttaatatatacaaaaaagtggctatagtaaagacggcgaaggattagcgaagaaattatatggattctgacgcaacgtcaaagccacgcctcaccggctttacagtgaaggaagaaccatataatttcaagctaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccacgcctcaccggctttacagtgaaggaagaaccatataatttcaagctaacccaaagccccctaactagccaccaactaagccacaactaaatcaaactcagtagtatcagtaacaactatcttagcttcaacagcacgaaccaaactagaatcataatgattaaatatatccttagaaactatcaagtccatgcaagcttttatctcagcctcagttatatcttctctaggatcatcaacagatatagaaacacctctgcctaaatcagtcataaaattcataacaagttttttcttaacctccataaaaacacctcctttcaactaaactaaatactaactaattcaaaatagtattatcttgctttaaaatttcaagctcatcatgaacctgaagatttataatagccttagcaacatctaatacatcttgactagtagcatcaggacgaacattattataagtcctactttttacaatagtcttaccatcatcattaagaccagcatctaactttatctttaaagctgatggattcttagtttcagaaactgccatttaaatcacctccttaacttgttaacataagtatagaggtgacatagaaaaatcatcaaagaaaatatttgagaaaaaaatattactaaaactgctatgagaaacaataaatatggtaaaattttcttatataaaaaataggagatgagtataaaatgaaatcttatatgtttccatgtaatttagaaaaatatgatattttaggaagctttttaaaaaatggatttgtagactatggaacagatttaaaactagggttaggagatattgtatatttatacaacggagcaccttatggagctatatttttaaaatgtcaagtaagggcaatattagaatatgaagaaactattgatgataatgaatttagcaaaggggaagtaaaaaagagatcaaattatgtaagacttacaccaattaaaaattatttaagtaaaattgataaagtttctagtaaaaagctttcagacaatggtgtaaaaggatatatgttcccaatagaattaacagatgaaacaattagatatatagaaagtgtttagaaaaaaataaaacgtatcacttaattgtgatacgttttaattacttgtgagatagtaactgtcatttattctaaataactaagcttcactcttttgagctattttttctgtagttcttttgtcaatttctttttttagctcttttaaataaggagagaatccaaccttatctgcaccataagtaaactgtaagtcatattctagcggaatccaagtactaatatccgcctcgttatgttgaatgactgcttctaaattatctaatgctttgtaaagctttgcttcatcagtcttacgttcattcatttcctttaaaagctctgtaaattcctcacgataaggagtagggaaagttgaaatccatttgaaaaacatctcatcctcttttttactatcttcttcttttttctcaaaagtaggaatatcaccagtaaaagcttcccctaaatcatgaattaaacacatacgaattaccttgtccatatcaatatctgggaattcatcacgcattaataatgccattaatgcaatacgccagctatgttctgccacactttcatgacgtccgctagatgtccatgagtgtctagtattacattttagtttttctgctactgttaatatatctagaaatgtcgctgtattcataccaagttccccctagaatttttatttatgaaatattataacaaatatacttataaattcatatttatctatatgatatctaaaatatatttacttcgcattatataacaattttaaactttgattatatacaacatttagttattataaaaggcaacctttggccaactagtcacaccacttcttttaaaatagctaatataattaaataaaaaggagtgaaaaaaatgattgaaaaaataactatcaaagaaataccccaaaacaatcaagatttagctcaactaataggaatagaaaactttaaaaaactagtcaaatacatgggaggaagttccatatacataccaaaagaacaaaccttaatcctaagcttaagaaataaaaacataaaaaaagaatttaatggagatataaaaattttatctagaaaatatcaaataagccaatcacaaataagaaatatactaaaagaaaagtaatagaaggtatagtgttttaatatatcctcttaaacagtacatttaaaacataaataataaaagtgatttataataaaatgactaaatttcaaaaaaataaacaaaatatattataataatacatcttttgaggtgataaaatgagtatctccaaattaattttattaatttttgctgttttattaggtggatataatgtatatactctatattaacatcacttttactaacacttaccttaaacaagtcatcaatcaaaataaccttagcatttttatacctatcctaactcaatagtatcatttaactcatttatttcatttttatcttttttatttaatttatctatatctatctctttttttgatttttttgcttcatcatattttttctcttttattaactcttttatatgtactatttctttatctattttatcatgttgatttattttagcttttaaattatctatatcatttttcatagaatcttctatagtttcctcgtctatttgattcataattttattagcatcatctatattgcctttttcaaattcatcatttgcttttttataattgtctattaaagctgttaatctttttgcttcttcattactactttctttgtctaatgcaattttaaatgaagctaaggctttatcatattctttattagccatttccattttaccttgttctattgcctttttagatttactattttcacaacctactaagcttatcactaataatattaaagttaaaattatccctattttcttcatttaagttcacccctttttacttttattaaattctagcctatttatatatttaccacatttttcaaattatcaatcttaaaaattttatatatgataaatattaaaatatataagagggcatagtaaaatactataccctcttaataactagttctctatattttttatgtaatttatattattatttttctttccttcttttgatccatgtgtatatccaataacctcaaagtgtttagcaaattctttagcaaactcttcataatgactacatctacctcttatacaagttgatatatgcatcacttcaacatctgcttttttaagcttttcaatctttacatctaagcttcctactggatccttatcgcatccattacaagtattaaaagctactaacttacttccatcttccttatatctttcaaaagaatcttcacttgaattaaaagttcttaagcatccattagcagtacactttctagaaacttccccacatacgtatattgcaatatttttcatttatttcctcctgtgcaccaatttcaaacattgtatctctcactatatatttttcataatgatataatttcctatctattatagtataatttaactaaatattgcgtatcatagggtacgcttttttaatattttttaaatttataattatcttaaataatagtttattctacttgcatttatagatattttgactaaaatatcacaagagtgatacaatattcagtgtaaacgtttttaagggtaaaaaggatggtgatgggaattgattttaaaaaacaagaaatacaaatactttttcgaacttatcattttagcactaggatgctttataatgtccgttgggcttaacatgttcttagaaccatacatgatagcatcaggaggacttaccggtcttgcaatagtccttaaaaatctttttaatactcctttgtggtttataaacttagtttttaatatacctttatttatatttggtattaaaatacttggtaaaaaagatgctataaaaacattaatagggattttattacttacatttttcttaaaagttacagaaccactaacttcagcttttcaaactactgatatactactatcttcaattgcaggtggtatagttgttggtataagtcttggaatgttatttagggtagatgcatctactggtggaacagagcttgcttgtcttatcttaaataagatatttccttttatatctatttctgtgtttatgtttataatagatggtgttgtaatagctttagcaggtattgtttctaaaaatattcaaatagctttatatgctataatttctttatacgtttcagtcaaaatttgtgataccattgttgaaggctttgatttttctaaatcttttataattgtaactgatcatcctgatgaaatttctgattcaattatgaaaaacttagaaagaggagttactttcttggaaggtcgtggaggatattcaaaacaaagaaaagatgttttattagtagtagtttctagacgtgaggaagttcttttaagaaaacttgtcaatgaaatagaccctctagcctttgttataataaataatgcttatgaagttcttggggaaggatttactagaaaagtttaaaataatcaaggctataatcattattatagccttaactttttatgcttgaagtgaattttaatatagaaattatattatttgtctacttatttcacttatttctttcattaaatcaatctcaagaatttttaccatatcttcttcaaagaaaacatccttataagatttgcaccctactacaaaaggtattcctaattttctaaataaaaatattttagactcctcattatacaatacgttaaacccattatttattactgatacaacttgttttaattcttccatagttataacagatttaatcaagtacttttctattatcctaagtattaatagttccttttttcctattgacttagctttagtaatttgctcaaagatatttttagtactttcacatattgcattctttgccataataacatctatatcaaattttttatcactatcagatttatcaaacatatttgccatgtcatctaaagatatttcatccttcattgatagtatatattctattctctctaatatcttatccttaggtaggtaagtttcttgacctgtaaaacttgatttttttataaaccattcttcaggtataattttttttcttttccatctatataattgtccataagaaatattagtaacttctagtaattcctttttagatattaaattttcttccataattcctccttaaaccctactactacttactactgtagaatcagatgaaacttctaatacgtcattatattctacattatcaacattacatttattaatcaacttaatttccttacctcttatatttttcacattagatttttctaagtatatactatcaccttctattaagttacagattaaagttcccattttatcaaataaagtaacaggcttaaaaattcctttagacttttttataacttctatagtagttgctccaatttcattacacttacatcttccccttggagttataattactacttctgcatttaataatccattgcaaacaatctttccatatacatttagattttctgattctatatttttatctacttttaaatctccataagattttatatacttagcatttatactttctttgcaacttagagaacctttaattgtaacattgttacactccatatcataaaaagactccatttctccagttacaactaaatcttttattttacaagttccttttacaactaagtcacccattaccttaacgctatcacaaattaaatctccatctatactaacactacccattactttaaaatccttacattttagaacaccttttgtctcaaaatttccagttacttttaaactttcaaaatctaaattaccattaaaattacaatccccaagtattttcactttatttgcaactatgttaccttcagattttccatctcctataatctttatatcgttatattcaccttcacagataaatccatcacctaacagctttatatttgctttttccattttttcctcctatattttatctacattatcaattttagataattcatttatatcaatgctttcgctatattctactttatttattttacagttttcacctattataatatttttacctcttactataccaacatcacagtttgataactttatattgtcaccttcaattactttaatatatgcgcggttgtttttaattcttttaggtataaatattttaaatatattttttgattttttttcaccacatatttctatattagttgctcctatttcaccgattcttgattctccttctgtaaataagtaaaaatcttcacaatttataagaccatcacatataatatttccttgtaaatctatcttttcactttcaatatcttcttttacctttatacaaccttctccagaaatcttatgagattttatatttttttcaatagttgcaactcctgatacatttatatcttgtgcttttaatgattcactactctttaatacacctgatactttaaattcttcacactgtatatttttactattttttaatacacctgatacatcaagcttattgcatattatatctccttttaatgaatatactcctgatatatttatatcttcaaactttccaccaccactacttcctactccatctaaatttatagaatgtaatttattatccatattaactcctttcaaaatactatctatttatattttaactttgtaacaatgttttatttaatatattcatactatcaaaacaatgttacactgtcaatcataataaacctattgtatattataaaattttaagcaatgttctaattgtttcaataataatagacataataaatatattccttttttaattttatttactttttccctcaaaacattgttttaaagtacaaaaaaacacattgataaaattatcaatgtgttttcataaattttaatttataatctctatagctttttctaaaagttcatctctaccttcttttattccctgtatcgtaggctctatataaatatctggttttattcctactctttgagtttgtgatttatctggattataaattccaactcctgtaataagagtgtttacaccacctggcaaactaaaactagctacatttccatctgtaccaatagaatcgctacctatcaccttagcattaggtgcatttcttagggacataactgtaaactctgattgactttggctacgttcattcataagtatcatcactttacctttgtaataatttttattatttgaaccaacttttaaatcttcatatagtataaattctcccggaactgattgattaggcactgatgtttttgcaaaagtaacttctttaggcataagatattttcctagactatatacaataaaatcagatggataatatcttaaatctacaataataccttttgtatccataaacttatccattattttatcaatttcaccttcttctaattttcctgggttaatatatcctatatttttatctattagtttgtgtgaatcttcatctatatcaaacatatttatatcagggtagcacttaacattttgtgctatctccttgtcatctcttttaatagtaaggttcatactatcttttgaggttgcaaataattcatactgtaatctatttactattgctgatttttttgaaagtgatgcatatttagatttttcttttattacttcaaatatatctttatcattaatttttaatacaatatccccttttttaagcttacattccttttcatacttaggtaatacattttttataacaatctgattttctattaatccaaattctattggtgcatatttatctcccctatatttatctaaagtaccattagtatcagaaaccattgcatgtgggtcgtgtatttttgttgcaagtccttctactgctagcttatattctaattcatctttagtttctataaatttaggtataaattcagttaaaacactatcccaattttcttctattatatctttgtaaggatagtaatactcaattatattccaatatctaaataagctaagtaatttataaccactatcatcatatttcatattattatatgctttttcatttttaaaatctgagaaaggagagtctttagaataagaaacataagctttagctcttttggatatattagtatttgatattttaattaataaatcacttaattttttatctatatacttttcatcttttatccaagctaaatctctttttagcataacttcattatttttatcattttctactttttcttttacttttcctaatttcataatccaatcatataatattttatctgtatcatttgagttttttgaagctaatatatctggagttattctaaacagttcataatcccaatttactgacccagaaactacttttggatgatagtattttacaagtccccaaactttacataatttctttagattttcaacttgatttttatttaagttttcaatttttatattgcttccattatcaaattctttatcaaaatctcttttgtccatagctgaaaatataagtgctattataataaaaatccctattacaattggcattaatgttttgatttttgaattttttattttttctttatccatgctttatcccctttattttctaggttatttgaaatacttgcaaaaaaattatatactttaacaacttacatatacttttcattttaaattactagcttgtatatcttatttgatatattaacatttcgatatttttcaatataatcctctaaaattttgttattttccaattatatctttactaaagatgtcgtatttaaataaaatcaagagaaaggcttgtgttagaggatatgcttaataaaatttaactaggctttagtgatggtatagcgaaatactataccatcttttatttttaaaatttcagtcataagataaaaaccaatgtgatatatatgtaatatagagatataaatatatcacattaacggagggatttatttatgaaatgggtaaacaagtattcatttttatttgctttatttggcttttttggctttaaagaattaaatggtgaaccactaggtctcataaattttgctttctttggatatttttctcacatttggtggtataagctaggtgatgttgaagatgaacgcttaatttataataaacataaagcaggttctatagcattttatacaggctttgtcctagcagttgtatcaagtgtattaattaatctatatacagtagatttattaacactttatagattgcaaatattaatactagcacttacttttgcaatatcaatgaatttatgggcatttttaacttacaaatttgatacagggaactaaaaattatggcaaagtttattagtaatttaaagaaataccgtcaatttaatgaattaactcaagaagaattagctaatagagttaatgtaagaagagaaactatagctcgtttagaaaatgctaaatacaatccttcacttgaattagctgtaagaatttcaaaggagttaaatactcccattgaaaaattatttatttttgaattttaaatatcgtaatatattaatcagttataaattaaattttatttttagggggaaatttatatgtatgagtataaatttatagaagtgccgttaaaaaagggatttacagctaaatctggtgatacttttaaagaatgtgaacatatcattcataaagaagccaaaactggatggagactaaagcaaattgttattccagcaaatgaaaatccaggattttcacctccaggtgcagcatctccatattgttatcaaattgtctttgagaaagaatgcccttaaagtccaaatcaatggattttaagggcattgattttatttctctaaatgtgttgtttattttatatatttatccagtatctattaaattctactccattagaatctatttctttagactctaaaactccaccattatttaatattattttattagaccctatgttgctttcatcacatgtaatcaaaattctatctagattaatatctttgcaaaatcctataacttgctctaacatttttgttccaatacctttttttctttgactgggacatacataatatcctatatgtccacctctaaattttaaataatcattaagctcatgtcttacactcatctgcccaactatattatttgtattagtatctacagcataaaatatagtatatggaacaaaaccttttagcaaatttattccatttgaataattttcatattcttgtactgttttattaaaatcattgtctattaatttaaatacttcaggtaaatcaggagattcaagcaagaaatcccttaatttaatctccatactactacttagttttactaactttattcccatataacccctcctttctaataagactagtttaatttttcattaaattcaatctcaaattaagttagtagttaaattttaattttggaaatagttatataaaacttgtactttttaaagtttaagtagtattttataaagtaaatttgaaatttcatcatgctgtatagataatccattttctaaccattctactaacactcctacaattccagaaactataaatgtggattcaattttatttaattcagaaacctcttcgcataaacaactttctaaaacttttttattaaaaaaggacttaacttttttaccattagaatcttgctgtattaaaaataaaaaaatatctttatttgcctcaacatactctgtaatattttctaatattatcttaaggtttgttggatcacaactcgggtatgacctatcaaacatttcctcaagttcattgtacaattcttcttctatatgctcatataaatcatatacatccttatagtgtaagtaaaatgtccctcttcctaattctgcttttctagatatttcagctacggttatttgatttaaatttttttcttttataagggatataaaggcatttcgaatagacctttgagttttaattactcttttatctttcatattttataaattcctccttgatactgaacacattttacttaagtgtctaatattaaacacttaagataatatcgcacatagaattaatgactattttaaattataatgaacatgtgaatttaaatcaacacgtgttcattaagagttaaagttttaaaaatatatttaaggagatatgattatgattttatattttactggaacaggtaatagtcgatatgtagcccgtaaaattgccgaagaaataaatgatgaagttgtatcaataaatcaacttataaaacaagaaagtacagatgaattaatatctaaaaataaaccatttatatttgtatgtcctacttacgcatggagattaccaaaagtggttacagagttcattagaaaaacgaaattctctggaaataataaagtttactttataatgacttgtggtgaagatacagcaaaagcaataaactatattcaaaagctatgtgatgataaaggatgggaactaaaaggtatggcagaaattaaaatgccagaaaattatatagctttatttcctgtaccagataaggaaacagcaaaacaaataattgaagaagcagataaactaatatataaaattgcatccgatatacgtaatgaaaataattttaatattgttgcccctagtggtttaaatggaacaataaaaagcggtataacaaatatagccttttataaatttattgttcatgcaaaaggattttactctactaatcaatgtattggatgtgggaaatgtgtaaatttatgcccactaaataatattatcttaaaaaatgaaaaaccaacttggaaaaataagtgtactcattgtatggcatgtatttctggttgtcctactaaagctattgaatataaaaataaaacacaaaataaagaaagatattacttaaaataatacctttaattttttaagatttacattcaattgactataatagaaagaatctaaaaaagtgattgaagtgttactaaatgaaattaattataactattcattaaattttcatttacgttatattaacaaataaaaatagtgtatctattgaaattacttacttttactagatacactattttttaaatttaactgaaacaaataatacttatattaatttaattgtcctaaatctattgtaaattcatctccaatttttttaaaatcatcattcattttgccacttttatcatcttgttttgccgcatacaaacctaactttaattttgttgctttcttatctaaatttttctctaaattattaaatataaatacaccttaattttcatctgttctttttagataaaacccaacatcattacctaaatcatcatgtccaactaattttaaatcataatctacatactttttattatgaatatctctatcataaattattttagtacctaaatcgttagttctatattcttttaattttatggtctcatccttacctaacttaaaagattgatttaattttatagttttagtattagcagcaagttcatctccgtttgttttaaattcaaatacccattttccatttattgttttctctttattattttcaatataaaatggattagaataaactatttttacatctaagtcaccttttaactcagagcctatattatatgtcattacttcttccacagtatttttatcaatcccaatagcactaccacttccaccttctattttaagttcaccatttatataaatctttggaatacttaaaatactagcattttcaagttcttttttatattcatatctagtagatagtgtaagttcatctccatcgattataacttcatttaaagttattgtaagtccattcttagtaatagacttccctactacagttttgtaattgtctaaatttgattctattcctaatgtattttttatatcatatattgctttatgcatacttgcataaacaggtcggttaaataccaataatccaccaactacaactaacccagataatcctgcaactaatatttttttcttagatttttttctattatttaatttagatttaacttttgactttattaattctttatctactttaacttcttcataattatctatatcaaattttacatcattaaatattttatattcattcatataatttaatcccccttatttacccatactttctctaatttttttcctacctctagataatctactatataagctagatatagttatattgttttctttggctatttcttgaggatcttcttctcttaaataatattttttaaagatatctttatctttttcatttaaatgtttaaaaatatcttccaaatcttgttttatttcaagactaagtaaattcttatctatgtaataagtatcttcgtttatttcagatgtattagctgttgataagtatttctttttataattaatagctttatatttagctataacgcaaatccaatttttaaaagtatttttatctttttcaaaatactcaatattatcccaaatagctaaaaacacatcacttacacattcttcttcatagttttttaatttacctaaattagttcttacaatagatgctataagtccactatatttatctattagcatctctattccctcttgctttctcttttttatatatttaataatcaatttatcttgcaagttactcccccccctatttaaatccatttactacttgtaaaagcttttacatttacaaatacaattttaaaagtaaaaaccttgcacttttatgaaaatttatttaaatttttaaaacttatataaaaaacccctagaatttacttctttaaattctaagggctttaattttactataaatatttataaagtaaaataactaattaatttaatatatttactttattaagaaacaagcatccagttatacaagaaaaactctcctaaaacagctaatgtaagatatataatagcttcatttttagatatagaaatagtcattttatttgtattaatagtagtttcacttttagatataaaagcatatttttcacttatactattaaataaactacttacacatacccatatgaaataccccaaaacagcacctaaagagttcatcattaaatcatcaatatccgtagctctatgattgaataattgacaaatctcaattgctaatgaaaaacctaatccagtataaaatactttaacagtatttctaaacttttcccaaatcaaaggaagtaaaaatcctaaaggcataaacataataatatttaaaatatacgtcctaataccctctgagttaaatggtattaaatttatttcttctattctaataatttcaccatattgccctatatcccatacactaccaattccagctacactaaatgctaagtaaatataaattaagaaaatatagacccatattaaatgtggaattaaatatgctttttcttttaaatcttctgattttacagctattatttgatatattaaacaaggtatgattacacaaagaagtggataaattatcgacataatcataatttttctccttttaaatttaatttgttttctactatgataatagcattattttagctttataaatcttaagattttcttactttttctaaagttaaaataacaaaataaaaaaccattaaaatcaaatttaacggttttcattaaataatatataaattattagtttaagtataaaataaattagagttttgatgtattatccaaactataaggggagcatacataaaaaggcacagtaatcgttgccatagaccttctaatgcaaatactgtatttttaaacttaggcttttctcctataacaaaaaaattaaagaaattaaactcaaaataaaaaatacagataaaatatgtccaagtaaaagctctccccttttaaattctaaaattgcaataaacattggtgcaaattgaagcgctaaaaatcctataaccgaacctataccatgtattttagatgaaaaagtaatatcttcttttttctcatttaatgggaaaatacctgatattatagcatcacaaattccatacaataaaattaatataaatacagtgattgctaatacaaaattttcattactataatataaaaaaacattgtatcccaataagcaaatacctatccccgaaattatcatccaaaaattatatacagttcccaaagggctatttttacaacctaatatactcattaccattttactatgactatatcctttataaggaatagcaatgaaatacggtataattaaatccataatcataataattaaaaataatatattattcaaaatatcccccctgacaaaatacactaattattaagttaattatagcagaactttaaaattaaaaatgtcgattaaaacagatcttttaattaatcaaaaaagtaataatctaattttaaaactgtatcaaaattgtaaatcaacaaacaataaaaataaattaattaaaaatacaatgtgatgagaggtaaaataatgtttaagcctaaaagagttatatttgaaaaaggaacattagacacagatattggtaaaaatatttataacaaagtaaaaaacaacccaaatattgaaattataaatactagttctaataaaattaaaagtaatattcctggagataacttatatgaacagtataggtctggaaaagaaacattagttgtgggttttcggaaaggtttaaaatttcaaacatgtaaaccatcagcaaactatcaattaccattagttagtggatgtatgggaagatgtgagtattgttacttaaatacacaattaggcgacaaaccttttgtaaaagtatttgttaatacagatgatattttaaaaaaagcaaaacaatatatagatgaaagattgccagccataactatatttgagggcgccgcaacatcagaccctgttccacttgaaccttatactaattctctaaaacaaactatagaatttttcggtaaagaggaaaaaggaagatttagatttgtaactaaatataatgatatagatagcttactagatttaaatcacaataatcatactgagattagatttagtataaatacacctagaataatctccactcatgaacatcatacagcatctgctggtaaaagaattgaagctgctattaagcttgcaaaagctggatataagataggttttataatagctcctgtatttctttatgaaaattggcaggatgaatatagagagttaattaaaagtataaaggaaaagttgcctaaagactttaatgaacaaattatatttgaagttatatcacacagatacacaactaaggcaaaaaatagaatacttgaaatattccctgaaactactttacctatggaagatgaggatagaaaatttaaatatggtcaatttggatatggaaagtatgtttataataaagagcagttagctcaaatgaaagattttttccttttagaaataaaaaatgtatttcctaatagtattataaaatatgtaatctaataattattaatttaaaataaaaagagtaataatttaaatgatttctacctaaaattattactctttttatttttctaacaatagttattattaagtaaatatccttacatataatttataatacatctaaattaattataattttattacatttttcacatctaagacattttatacgtggattactacttagctttttcataatactaatataaaaatttgcgttttttcttattaataacaaatccctctataaaaagacctacaaagaatatagcaattattattagtaatgctttaaaagatatatgaaaaaataatttatctaaagcttcaaatatcccaaaaataattagactcgtcccatttacaaaatacatattagaaaataattttatatattcatctttatcttttatatttctctcagggtcgcatccaaactcatttatatttttagtttcttttaattttttaccataatttaaaatccagactcctgttaaaacagttaaaattcccatttatattccctcctttaacgtcactgatattatatcaaatatataaattaacattttaaatttggactaaaatctataatttatggactaaaatataattattttaaagtattcctaaaatcttttttccaatcatctaaaccttctttatcataaattaaattatataataaataaaattaaaggtcttaactcaatttaagaccttttttcattatcttcttactataaggtatatataaaattgcacctattaaacatgttgttacttctgttattgtaagagaccaaactaatccatgaagtccaaagtaataatgaagtactataaccataggtatatataaacaaccttggctaatagccattatacctgttgccatcccttctcctgatgcttggtatattgtcataaataaagttgtcataccattaaatagtgctgatactaacattgctactaatatatatactcctattgaaagaacagatggatcatctgaaaatgcttgtataacttgtcctctaaatatataaacaattcctacaaatactactgctattgaaattataaacatagaagaatattttatcccttcttttaaacgagttatatttttattagaaaaattataagctataagtggcataactcctaaaactatacccatagagaaaaactctggtaactgaactattctaacagctataccaaagcttgcaactacactatctccatactccatagcaaaattatttaataataaagtagttacaatcataaatgcacactgaattaattcagacacaccaattttatatatttcaatttgatcttttatacttattttaaaatgatacaaaaatcctttcaaattttcactcttagtatttaaataccaaacataataagcactagatgcaatatttgcaattaccatcgataacgaagctccatatacatgaaggtcaagcactagtataaataatatatcaagtataatactaaatactacactaacaaacataccatacatagattctttagaagcaccttctgaccttactatttgttcaagtgcaaaatttaatataagagcaaacccaccaataaataaagtagttgaatattgtcttgtatagtttaatgtgtttgaatctgctcctaataatttaacaattggattcattaataaacaagcaactactgctattaataaacctacaataatacttccatagaaagtataccctgcaacttttttagctctatttacttcattttgtgcaaccaaccttgttacaaaagttcctccacctacaccaaacatatttccaaatgccattaaaactgtaaatataggaagtcctaaagttattgcgctaagcattgctgtatcgtgtactaagcctataaaatacgcatttataacattataaatcgttcctgctgacatacctatcatcataggtattgataaatgagctattgccttttttattggctcatcttttaaatactttatatttgattgtgtattttccatgtttacctcccttacacaaatgtataatatctaattattagagttctaacattttaaatataaaattacacactacaactaaacctagtattagttttgtagtatgttgaaatatatgttttttagtttaattatatacattcatattgttccatatttaattgttagagttctaactgtttaattcattatattcctatcatacatctatgtcaactatttaataaaatttttcataccaatataaaaataaaagtagtgatttatctaaaaatcactacttttattttaagttattattaacttttataagtatatttttaaatgattctttttcttcatcagtaagacaatcagtaatatcgttttcaatttcaataaacatcttatcaaatgtttctataagatttactcccttttcttctacataaatatttttttgtctttcgttattagatggaatctctcttcttatatacccctttttttcaagtccttttaacatactagtaatactagcagtagttcttccaaaagtatctgctaaatctctttgaattagacctttatcttgatgttcataaatatatttaattattctaccttgttgtgcatttaagcctaatttatttatttttttatctgatgaaaacattaattttcttgctattgtactaatcaaatttgtaaaaatagtattttcattcactcttatcacctcattttatatatcatattaacaattagaattctaattgtcaacatgacagctatttttcatcaattgtatttatagtattatctttcaaatcaaatagcttaacataatttttttagttttaacacagaatgagtttttagatttgtatcaagtaaattagtgagggtatagtgaaatactataccctcttttattttattaatttcgtaattataacttatatatagaaaaataaggcttaaataagccttgtttctaaaaatttttattaattacttgtccaataaaataaaaaagaaattctataaaattaaactctttaatttcatagaatttcttctttattaaaaattacacttgaaatcctaagtatatttcaaatatagcagaaactataaagtatatacctatgatatatggtgatgcaagtaatgttaatataggatttgctaaaataaataatcctaataaaacaagtattatataatatagagttttaagattaaatccaatctcttttcttttaattgaaattattattaagtaaatacctcttattactgcccatattccatatagtaatattaatgtttcagttgttgctataggtgttagccaaacaattaacccaaatactatgtttataatcccagtaaatatgtaatatcctttgtcagcagatttaaaggctctaactatatcgaatatacctattataactattaaaatacctgctatagttgtaaagctaaaatatgattctataggatttataaaaaataaaaccccaataatcccaaatagaattccttgtaaaattaatgttgattctaactttgattgattcataattctcatctccttgtaaaaatatattccctaaaaataatcaaataaacacaaaaaactaattttttaactttataatcatttaattttaaaatatatatcataaaaaaaatttatgcataaagcatttttaaatttattattttagtgataattcagataataaaaagagtgtattctttgaaattactttatttcaagaatacactctttttatttttcaaactcattataaatctttttacacgccaatctacaaataactaatttatacttctcattaatcagcttttaacttagagatatattaaatttttataattttatcaaatatttctaatgatttatcatatatgctaaattcttgttctttatatatttcactatatgtcttatgtatgtactcttttaatatagtttctttcattactttcattaaaaaacttgttatctcttttactacatctaattttagactctcattctcatcatccatacttattttaatttctataaaatctttattatatttaattttatttttaaatatactcgattctacaaattcatttgcaactaattcatatttaggtaataaactcaaataaatctctttattattcaaagtcatcactcctttctagtcataagaggaattatggaacctaaatccaataatctttctttacttaaatttactatttccttattctttgattttaaaaattttttaatattttcataatcgggatgttttgttatatctccaaagaatgcaagtttgtctttgcttataagacctgaacaaccacctataaatccataattcaattcaaataaatctatatttttagattgtattaaaagacaatctattccatattttaaaacagttttatatatacccacatcagatgttattattgaattttcgtcaactatacatatagaacactttgaatatccttgttttatatttatcttagttaatttcttcttatttatataatctagaatttttttatctgtatgttcaaaattatgtattgcataatttccaaatatagctacgttatactgtatattatgcggataatctctttttatataactgtctccttttaaaatattaaatccaagtttttttaaaatattaaagtaatattcataaacatttggtgctacaactatattaccctctcctaaattacatatgcttatatctggatgatattttatagcattgtaacattccttacattctgtcgtttttattatttgtatatttcttttttttaattctagttccatatcgcaagtaattcttttatctaccaatgctagacataaatcctcattaattacaaaagattcgcgactatattttgtattcatatttaccttcctttatatttattttatatagtattttattatatatactttgttatactataactattttttcaataaaaaaatggtagctaatgctaccatttttatctttcaccttttttatatggatttccaagtgccgctggcgccttagaagtttttataaataaaactaatactattaatgttattatatacggtatcatcgatagtaagttttcatttattttaaatggtaattctggatttccaaagaatacagataatgctgtagagaatccaaataataagcacgctcccatagctccttgtggtttccacttaccaaatataacagctgccatagctatatatccttgtcctgaaattaatgtaggcctaaacgaagaaactatagctaaactcatagatgctcccccgaatcctgcaagtatacctgaagctattactgctatatatctaatacgagctacgttaactccaagagtatctgctgcacctggatgttctccaactgctcttattctaagacctaacttagttttatataaaacataccatactataacaacaaatataaatgctaaaaatactgttgcatatgtattaaatatagtatttaatatacttccatctgcaaataaaccatctaaaggtcttggcattttatcttccatacttattgtaggagtcatagtagcaccatcaaataacatcttagatgtaaataatgctacccctggagcaagtaagtttattgcaactcctgatatagtatgatctgcattaaaacttatagttgcaacagcatgtattaatgcaaataatccacctgctaaaccacctattaaaaacgctatccacggatttcctactaaaacacctgcagctgctcctgcaaatgctcctatagtcatcataccttctaaccctatattaactatacctgagttttctgacaatactccacctaacgctgtaaatataaggggtgtagagtacattaaagttgtacttaaaattaaagctaaatcttccattattcaattcccccttgctttttcttattcttatattttataaataacattcttataacactacttaaagctataaaataaactatagaacctataactatatttattacttcagaaggagcttgtatagtttgcatctttgttccaccatacttaagtgctccaaataatatacctgagaatataactccaattggattactatttgctataagagcaactgctataccatcaaatccgttaccttctggtgctgcaagtactgttatattatgagttacacctaaaacttgcactgcacctgctaaagctgcaagccctcctgctatagccatagatttaaatatagatgattttatatttattcctccatattctgctccaaatttattgtatccaacccctcttaactcatatcctaaagttgttttaaataatacaaaagctattataaatactaatattattgcgattactataccccagttagctttagttgctggaccaataagtcccgttaaccaatctatgcttatactagcactttcatttattaaatgagatgcttcactattaccttctcttaaccaaggtttcattatcatataattatttaaataaaatgcaatccagtttaacattatagtcgatataacttcattaactccaaactttgatttcaaaaaacctgcaaatccaccccaacaagctcctgccacagctgctgctattaaagtaagtggtatatgtattattgcaggtaagtgaagtccatatcctactaaagttgcggttaatgcacccacaataaattgaccctctgctcctatattgaataaacctgttttaaatgcaaaagctactgaaagtcctgttaatataagtggagttgcttttataaaagtccatactatatatttaggcttaccaattataccatcaatcattacagagtaagcttctataggattaaatcctgctattgctaaagctatagctcctactattaatccaagaaatatagatatcaaagagaatactatagtattattagctaaagatatcttccttttagtcttagtattattacacattctctgcacctcccgccatcataaatcctaaagtattttcatcagcatcttttgcatctacaattccaactatttttccttcatatattactgctattctatctgatacattcataacttcgtcaagttctaaagaaactaataaaactgcattaccttcatctctttgatcaaccaatgccttatgaacaaattctatagctccaacatccaaacctcttgttggttgagttgctattaatagttgagcttttcctgtactttttctatctactcttatattgtcaacttccctacctattattaccttttgttggttaccaccagataatgccctagcttttaaagtataatctgttggtcttacatcaaattcttctattatattatttgcatgtttttctatttctttgttatttaatacacctttattagaaaatcttttttctttatatctttgaagtactgcattttctgcaactgtaaaatcaagtataagaccccttttatgtctatcttcaggtatattttttattccttttttaaagatatcaattggtttattgttaaatacttcttcaccatttattttgatactacctgagtcagcttttcttaatccagttaatatttccaccaattctgattgaccattaccatcaacgccagctattcctagtatttctccagctcttacttctagtgataaatcatctagtatttgtacttttctactatctttagcttttaaaccttcaactttaagtactacatccccaactttagcctcttgcttatcaactttaaagctaacttctctacctaccatcattgcagctagctcatcttctgaagtttcagcaacttttactgttcctatatatttacctcttcttataatcgtacaataatctgctgctgcttttatttcttttaatttatgagttattattataactgacttaccttctttagttaaattccttattatttgcataagttcatttatttcttgaggcgtaagtactgcagtaggttcatctaatattaatatatctgcccctctgtacaatgcttttaatatttctactctttgttgcatacctacagttatatcttctacctttgcatttggatcaacatgtaatccgtactttttagatatgttaattacatcttctatagcctttttcatatctattactccagttccttttgtaggctctgttcctagtattatgttttgagcaactgtaaaaggttgtactaacatgaaatgttgatgaaccataccaattccatgagatattgcaacatttggatttgccatctctaccttctcaccatttatatatatctcacctgaagtttgatgatacaaaccatataatatattcatcagtgttgacttccctgctccattctctcctaaaagagcatgtacttctcccttatgcacagtcaaatttatattatcgttagctataaagtttccaaattttttagttatatttttcatctctacaacttttcgactgtaatctacattactattaaccatagttaactatatccctcctctttaaataattgccaattttattatactaaaaaataacattaataacaatttaaatttgataattagtgtgtaatattttaattatatcacatactttttgttgtattttgttgtattttgtaattttaaaatataattttaatatatttattacatattatgacaatcattcctctgttttaggcttaataatgatatgttttataattataaatgatatttaaatttcattttacttttcattttatttttaatctgcatataatatttttggtataaaaaaagactagcatatgctagtctttttcattattatttttgtgttttttctaattcagcttttgtagctggaacttttatttctccactctttattttatcaccttgttgattaacaaattctaatatatctggagcaacgtcttcttttgtagtttctgctaccccaacaccattttcatttaatccataagtaactactgatccaccttcaaattttccatcaactaaatttttaacagtgttataaaccccaacatcaactctctttacagcagaagttattacagtttctggtgcaatactattttgatctctatcaacacctatagcttttttaccagcttctttagcagcttctataactccgtttccagtatctcctgcagcatggaatactatatctacaccattagatatcatttgatttgttatagattttccttttgctggatctgcgaaattgtttgcatattgagcaactacctgtgcatctggcttaacagccttaactcctgcctcatatccaacttcaaaagattctattaatggactttccattcctccaacaaatcctactttattactttctgttaatttacctgcaactaatcctactaagtatgaagcttcttgagcattaaacattatactctctacattcttaggaggttttcctccaaaatctgcatctattaaagcaaatttttcttctggataagctttagctgcatctcctattgctttttctaatttaaatccaacccctattactaaatcagcaccattatctattgctgtttcaacattagtagcataatctgattcttgtttagattctatgtaattagcctctattcctaaatctttcttagctttttctaatccttcccatgcactttggttaaaagattggtcattaactcccccaacatcagttatcatagttacctttatctttttattcccattttctttgtctcctgatgaacctttagaagctccacaaccaactaacatagaccccgataatactgtaacaagacctaaagttaacaactttttaaacttcatatattacctcctgtatataacgattatgatttcttacctaaattttacactatataaaaagttttttctacatttatttcaaattttattcaatttttcactatatattacatacaatttcaaaaaataagaagataagaaatctttttcttaatcataattagatttcttaccttctttattgtatacaatatatttatttattacacactttatcttaaatcaggataccctatttgtcttaatgcttcaaataatactatagctacactatttgataaattaagcgatcttgctttttctatatctaccataggtattcttattgcagtttctaagttttccattattaaactttccggtagtccttttgtttccttaccaaatactaaaaatgaattatcttcatattttacatcagagtgtgtttgtttagcttttgttgttgaataaaaaaacttagcatctggattttgttctcttacttcatcaaagctatcataatattttatttctactaaatcccagtaatctaaaccagctctttttaaatatttatcatccatacaaaaccctagtggtcttactaaatgaagtgttgttcctgtagctgcacaacttcttattatattccctgtattttgtggtatttcaggttctactaatactatatttaaagacataaaaaatcctccttaattctttataaaaataattatatcaaaaagttcgtatttctaaaaacttctttacattaaaataatataaatctccataatttagtggagatttatattattttaatgtttgttctatttaaattttcatgttttttctttgttccctttacaataactttatttttaggtggataataacattcatttataagttcttctttcgttacacttccatcttcatttttataaactctatatgtgttaactttatatcctcttctacctttttctccaactttagtttttccttcatataatttatcactttttttgattattatttcttgaggtattgtttcaactatatttgtttttatatctatatattttttgtcttcatgattgccataaattgtagatattatcttattattttcaactttgctttgtattagtataggagaatcaaatttattttcaaatatcaaatctatatttccatatgataccgttgcatctcttcctttttgtatataactacttggaatactatgatttttagcttgtattatttctaatcctgaataaagtgcagcattatatatagtactggaaacttgacatatacctccgcccattcctagttctaattttccatttaatataattggagcttctttgaagccttgttctatatctctttttcctgtggtttcattaaaagaaaacttttcattagaatctattaatgtattgttaattttatttgtagcaattgtaatattattaactctgtttttatttttagaattaaattctgtttcatacgttcctaaaatagtgtttatcttagataatttttcaaaagtatatttaggagtaattatagatgtaggtatataacattcagagtaatctttatctactattttcttatcaagtaaagtaaacaattcttttttatttaatttaacaccatttttttcatcactaactttaaatttattttcacttaatttaatctcagaatttataggacttacatatatatctttagctaaattagatatatatgcttctagcttatttttttcatatcctacatctaatttaaaatttactttttcaccgaaatataaattcatttttgttttaacatcagataaaaaccctttatttctacctactccatgagctttttttacagcttcttcaactttgtagcaaaatcctacatcatctaatttaagattataatttttatctttataaagtaaattaatattattatttttacacaccaatttatttattttatctatagcttcactttttgttaatcccgagacatcaatattttcaatatatacatttttacatatcttactatctttgttaattgcataagatttttcaattaatccaaaataacacaatatagatattattaatagaaaataaattttatgtctcttcaatattagtcattcccttcttggtagtagtcacaatattcaactattgggcatatattacattctggttttctcgctttacatattcttcttccatgaaatattattagatggtgagccttcgaccatctttttttaggtaatactttcataagttcaaattctgttttttctggagtatcagtttttactaatcctattctgtttgatactctaaagacatgagtatccactgcaatggcatcaactccaaaagcattacttaatactacattagcagtttttcttcctacaccaggaagttttactaactcttccattttatctggaacttctccaccataattagaacaaagtattactgatgtttcttttattttttgagctttacttttaaacaatccacaacttttaatttcttcactaatttcagctgtacttaatttagcaaaatcttctggtttattatattttttaaataattcttctgtaactttatttacccttacatcagtacattgtgcagataatatagtagcaataagcaactcaaatgcatttgtgtaatttaactcacattcagcatccggatatgtttgttctaatatatctaatatcttttttatattctctctgtttttcttttttgctttagccatattaaaaaatcccccttatattgtgatttatatataataatatataacaattttgattattatttaaacatatggaattgattttgatatatcttaattatattatttatcaaaatttatcataatatatatataatttaatttattgattggtaatattttgttacttaaaaaaaaatggattgtgtattaaaacaatacacaatccatttagaaattattttttatctagttcactatatttttttaatttatatatagcagcttgctttacttcatcaaatgttttatcagttaaaatttcaattgcttcttctattctatctataggataaatatggaatttaccttgtaatatcgcatcatttacctcatctaaaaggactagatttcttaaattatttcttggaagtataactccttgttttcccgttagaccttttttcttgcatgtataataaaatccttctactttctcagttactccacctactacttgtatatcacctttttgatttatagagccagttacccctatattttgttttataggtattccacttagagatgataataaagcatataactctgctccagatgcactatctccatctacccctccataattttgttcaaaacaaatattggcatttaaagataatggaaactcttgagataaattttctagtaaaaatccgtttaatataagaactcctttactgtgtataggtccactcatttcaacttctctttcaatattgactataccattacttccaggagctgttgttacagttattctcgatggtcttccaaaagaatattctcccatattaagtactgataatccatttattactccaactttagacccttcagttgatataagagtaaaacctttttcaagagattcatccattttcttttctattttactaaatctttctcttctttctcttatagcttttagtatatcttctttatctacaaacttagcacctcttatttttgcatatgcatctccttcaactaagatttctactattttattaaatttagttgataatttttctctatccccagttattctagtactatattttataatttgctctactccactataagttaagtgttttaagttatttttattacaatacgatgctataaatcttgatactctcatttcattattttcatcttttttcatctcattatcaaaatctacaaatatcttaaaatacttattaaactcagaatcataattatacattaaattgtacatataattactacctattaaaactacttttacgtttacaggtattttctcaggctttattgctgtttgtgtatctaatgttacttcaccttgttgaattgtctttttcaatatatcccaagataaattatatcttaataattggtctacatataaaactaaatatcctccatttgctttgtgtactgctccaggtaataactttgtaaaatctgttttcacagttccattataatattcatattccgctttaccaaataaattgctaggacttgggtttatttcaactactactggtgctccagatttatctaatccattatcaaccaataagttaactttatatctagtaaaatgctctttgtcgtatttatcttttaattcttcttcatccatataaaataaataaacatactctaatatatcatctctagtgtcctctaaatatttttttattttatcgaaacttccatatttatctattaaattttctatatgtggatttactatatatttacctatctcattttctaaatctagtaaagcttcctttgcatcttcttctatgtctctaattttataagcaacttgtatagcagcattttctagttctttttttaccttgtaaaattcttcagaagacgtatctacagattcatcttctggggtaaatatcattccaactttactactttttaatttaaatcctttttcttctccatatttttttattttctgaagtaatgcttctttttcaatttcataatcatctaataattcatttttactcatttcaaattcttcactttcaaatgcatctttaagttcatcaagtaaggtttctataagtttttccatatcttttttaaataatttccctatacctttatctaaagccaccgctataggctctctactattttcaaaattatatacatagcaccaatctttatgatcatttttttcttgtgcataagtatttaaagcattaagtacataagtagtttttccagttccactgtctccagccacaaatatgttatatgcagggttatctattttaagtccaagttccatagcttttatagcactttcttgccctattatttcccctaagccctctaattcagaggtattagaatatttaatcatattcatccccctttcaattcctttttatataatatgttttatatttattaaatgttaagtaaaaaataaaaaacttctaactataaaagttaaaagttttacttttctaaaatctccatatttctttgtattatttttttacctctccaactaaaagctttttctttataccttcttttaaattctttattagatatactattaatttcatctttatccaaattaaacatcaaatcttcataaaactcttttatattagttgtcgatatatttttattgtgaggacacacatcttgacatacgtcacatccaaatacttttttattttcttttaaaacatttatctcatcttcacttaactcttcttttttttgtgttatataagataaacatagttttggattcatttcaaaatttcctaaaattgctttacctggacaattatttatacactttttacattgcaagcaagttcttttttctacattatcattttcaaacttatagttatttatcatataacctataaatacatacgacccaaattcatccgttattatattattatttattccataataacctactccagatatactagctagatacctatctacaagaggaccattatctgcaaatatcatatattcaaagttttcctgtttactttttatatattgtgcaatttgttctaacttttcctttgctactatatgataatcttttccataacaatacttagaaatattagaatcgtctacatcttttacataataaggaaaagcacaaacaattatagactcagcattttccatagtttttctagggtcaattctcttttctatacatgactcttccattcctgtaaagtaccctttatttaatttatcttttattatttcttctaaatcatagtatggtcctattcctgcaattccaacacatttaatacctatactataacaaaactcttttaaatctttactattcataagttttcctttcattaatgtatatttacatttataataactaaagtataaaggatggtgatatttttgataaaattagtaattccaggaagaccaataagcaagtctaactttaaacttcataatattcatggtcaatcatggatgccttctaaaggtaagcactctaaatatttagcttatgaaaatatgattgcaggatatataaatactcagtatgatggtccttgcatagaagaagatcttattactatattaaagttatattttccaaataaaagaatgggtgacttacataactatcctaaaagtatatgtgatggtatagaaaaaagtggaattataaaaaatgataaacaattaaaacctgtacttttatttgattttatagataaagaaaatccacgcgttgagatagagttatatcctttatctcaatataaagtagattatactatttcaaaactatagttaattccacctaaaaatcattaggtggaattatttttaatctaatttattcgatacatcctttaacatttctctaattggtaaattatacggacatttactttcacatttaccacactcaatacaatcagatgcttttatttctaaacctttatatctatcttttgaccaatcttttaaaccatatctactataatatccttctaataaaaagtttagtggaatatttattcctactggacaaggcatacaatattcacatcttctacaaaatttattccctagcttatttcttatttcttcaataagtgcttcttcttcttttgttatatttaaatccttaagaacagatgtattttctataacttgatttacactatccatacctggaattacaacatctatataatccttagataaaatatattttatagccagtttagcattatctatagctcctccagctaaaggcttcataacaattatacctatattccttctactagcttccttaaatatttcatctgcctgatcttctactatattatatggaaattgtattgtatcaaattttccgctatatacagctttctttatggtatctatactatgacttgttattcctatatatcttattttacctttcttcttaaaatctaaaagtgccttataagccatatcatcattgaatattttatcatattcttctggcttaacattatgaaattgatataaatctatgtaatcagttttaagattttttaaacttttttttacatcttctatcatatcatcatacgttcttgccatactttttgttgctaatataaacctatctcttttcccatctatagcattacctatatattcttcacttatagtataccctctagctgtatctataaaattaactccttgatttatcaactcatttataaccaaattggtatcttcttgagttattctttgtataggaatccccccaaatccaattctattaattttgatttcagtatttcctaactttctcatatattcaccccattattaatttttcatattataaattaagacgatatttcaattaaaatatcgtcttattccctacatatattatatattaatttattgtatttgtttaacaatatcttttatcattaaaatctctcttttgtgaccttcatcttctaatggtgtttctagataaaatggtaaatgttttaattttggatgtgttataaaccttataatcgcatccaatcctatttccccttcaccaatacaagcatgtctatcttttttagattcaaaaggcatcatactatcattaagatgcactgcttttaatctttctaaacctattattttatcaaatttatctatcactgaatctaaatcatttactatatcatatcctgccgaaaatatatgacaagtatctaagcatactcctattttttcatcatgttctactttatctataatttctcttatttgctcaaaagtaaaccctatttcacttccttttccagacatagtttcaagtaaaacagttatattttcttttcctgttatagcttcatttaatgcactagctatcttatctattccaacttctacacctgaacctacatgactacctggatgaaaacacataaattctattcctaaagaatccattctttgtatatcttctttaattacctttcttccaaactcatatacttcttctttaacccctgctaagttcatagtatatggtgcatgcgctagtagtggtccaaaattattatcttttcttatttcttgaaatttcattatatctttttcatcaaaagctttagcatttcctccccttggatttctgctaaaaaattgaaaagtattcgctcccatgtctacagcactttgagctgcttttgaaaatccttttgctattgatatatgcggtcctattactatcactagttttcctcctaccaatttatattcatttttattaatatacccaaaaaaataagtatcaacaagtttgttgatactttatactctacatttttcttctacgggtatagtaattaaagataaattatatttagtttccgattcttcatgttttctatttaatataatttcttttattttcaagtccattgtttctactaactctttaatctcatctttgcttaaagatacttgattataattagttatattttcatcctctatagtattttcttcaatagctttataaaaggaattactcatattttcaaacttagatatacagatatcccccatatccatttgttccaagtcgttattaaaatccaaagcttttttccctattacaatatgtttagctgtagggtagtaatatttctccacaattccagatttaactttctcttctactaaatctaaaactcctactttatataaagtttttatatggtaatttatttttgcatgtggttcatctaataattgagacaattgttttgctgataatggagttgccttaaatgcttttaatatatctattcttcttggatgtgcaatagcttttatgcactctaaatctctcagtactaatacttctttcattcccccaccacccataaaaatatttaattatataaataattatatattaccaagcagtaattgtcaaaaaattctctattttagaatatatttattttgtatttttcactcaagttttgcagtatttttataccagcaatactattaccttttttatcaagagcaggaccatatatacctattcccatcttcttaggtacagaagccattataccgcctccgacaccagattttgcaggtattcctacttttattgcaaattctcctgatgcatcatacataccacatgtaaccataaaagttttaactatacgtgatattctttcatctataagtctatttccagtttcaatatctaatccatatgatgctagattcactcccattctagctaaatctacacaatctacttctattgaacattgtttaaaatataagtctaatacttcttccacatcaccttctataaatccatcattttttaaaagatatgccatagctctatttctatctcccgtagccttttcagactcatatacatcataatttatttttaaattatcatttttagctaattttctaaagaaatttaacattttttcttctttttctttaaggtttttaccttttatcatagaagttgtaactatagctcctgcatttatcattggattacatggctttttagtgttattagtttctaatttcattattgagttaaatgggtctccactaggctccatccccaccttagaaaatacatgttcccaatcactttcactaagtactaaggctaaaacaataggtttcgatatactctgtatagtgaattttttatcatagtgtccagctgtatgaacaacattgttcatatctatcatacatattcctaaatcatcttgtcttgcttttttaagctcaggtatatatgatgccacctgtccataatttgcatattttctgttatcttcaagtattttttctaatacattttccatacgcattcctccttatttttttataacgcttcaatactcttttaaatataatacaaaaaatcctgggattgtgtcaacttcccaggatttcaatcttaatcaacgattctactacctccaataaattctcttattatagatgtaggtggtatatctagttcatcatctaactctacaaagtattgtaaaaatttaagaaccctattagcttctataaaagcttcattatcgtcttttatctcttctaaaagtggcttagcatatttttttagtatagctagttcgtataaacaagctgagttaaacataatatccgcttcttcttgataagggaatatatttttatcttctcctcttcttacagaatcccaatttaaaatagttttctccgcactataacctctaaagttgtaatctctaactattcgtcttattaaccttaaatcagtcgtaggtattctattatgattatctagatttatttgagtaagaacacttatatatattttaaacttatctttttcatctatacttttagtaagcataggatttaaagcgtgtataccttctaaaataattggttgatccttatctatttttaatgtttttccactaaattctcttttacctgtcttaaaattaaatttaggaagttttatttcttctcctttaagtaatttttctaaatcactattaaacaaatccaagtctatagcatatatagattcaaaatcatagttaccaaattcatctaacggtgtatcttctctattaacaaaatagtcgtctagagatataggcactgggtgtaaattatttacttttaactgaattgataatctatgagcgaaacttgtttttcctgatgaggatggagccgctattaatataactcttttattattttcctttattatatctgcaatttgagatatctttttttcatgtaaagcttctactattcttattatctcactatatttattttctgttatagccttattaagacttacaacttcacctacacctataagatctgaccataattcagattccttgtatatatttgataatttatgctgaggtataaattcttgagctttagttttatcaagtttactaggtcctagtataacaacgccagatttccatttttttatatcaaatacagttacgcaacctgtcgatggtagcatatgcccataaaaatgatttatataacttccacatttatatattttcacgtcatcgtattctttatattttaaaagctcagcttttatataatcatgtctttcttcaaagatttttatagcgttttccttattagtgactatcttttctatattttcatttctatctattatagacttaacttgtgcttttatgttatctaaaatttcatcatttagattttgttttccaattttaacctcacaatataaaccattagataaagagtgttctatagtaactttacaattaggatataattcctcacatgcttttataaaaatgaaagataatgttcttgtataaaccctcataccatcagcaattgtagtatctataaattcaaggttacaatctttatttaactcagtacttaaatctttcaatttattatctatttttcctaatgttattatccctttatacttactgcttaaatctttagctatattttctaagattacgccttttttgtatttataattagattcaccaattttgacatttatattacacatagaatcctccctgtctttttaatccttatactattattagaacgatttatattatataaatcgttctaataatttaacagattcatttatatcattgtaatttatttctagtataataaattgaggatttaattttattaaatcttttatgctatcgatacttaatattccttttccaagtccaatgtgtaaatcttttataccatcattgtttttatcctccttattatttgcaatttatcttttatatctttcactatatatttaatatatgcatattaaaataaaaattccacatttttgaaatttttattttttaaattttaataataaataaaaaagagtatgcaactacatactctttttcttgctttttattgtattaaatatattaattattgtaattcaatcttttctatattttctttcataacttttatagatttatcaaatttttctttttcttctttttctaatggtaattgtattacttctcttactccatctttgttaactacactaggtgctgctatatatacatcattatgtccgtattctccatttaaataagatgatactgtaagtatgctattttcattttcaagtatagctttagttatagcagttaaagccattcctataccatagtaagtagattttttacacttaattatttcataagctacatttttaacttcatcttctattttttctaaatcatcaaatgttattttactatcttttctagaggccatttgatagataggttgaaccccttgtaatgcataactccatgctacaaattgagaatctccatgttctcccataacataagcatgtacatttttaggattaacatctaatttttcacttaaagtatatctaagtcttgatgaatctagagttgtaccagatccaattactttatgtttatcatatccagaaagtttggcagctatataagtcattatatctactggatttgtagctattaacaatataccattaaatccagatgcttttatattatctattatatttttcattatttttgtatttttatttaataaatctagtctagtttctccttcagcttgtatagcaccagctgttatacatataatatatgcatcactacaatctttgtaatcacctgcatatattttcatttttcttttgccaaagtttagaccatgatttaaatccatagcttctcctttagctttgtctttatctatatcaattaaaactaattcttcacaagttccttgatttaccatagaataagcataactcattccaaccattcctgtaccgactattactaccttatttttcatatatcttttcctccaaatgtttatatcattattttgtcctattttttctatttaataacactttagtatttattaaattttaatccagatttttattatatacaattattcccatagagtcattaaattaaacttattttttgaatttaattttattttttaataaaaattacaaaataactattataaactttaatataaaaacttttaataattcatttctatattgtttgattgtattatataatctttaaatttctttgcaataggtgacatgtaagaatttttagaatatgccatatatataactctctcttttatattttccttaatttttattttggacaatgcatttgtattaatcattggcgtatttggaactatagaaattccagcacccgcagatactaatccttcaactacacttcctatatttgctccatcaggctgaatagctatcttaggagtataacctaaaagttcactatatgatatcaatcggtctttactattttcacaaaatgctataaagtattcatctttcaattcttttaaagaaatttcttctctatttgaaaaaatatgatttttaggtacaattaaaacatattcttgtttctttattggaatagactctatatcgtaattatcatcaattttatattcactatcataaaatcctatatctattttcccaatttttaaattttctactatactatctacagattgttggttaaattgaaatttagtatcaggattattatttaaaaaattacttataaaaaaattcataaaataaacgcctatcctaggcgtagatgatatagatatagttcctctatcctcactaatcatttcttttaattcattaatacctttatcaatttctgttaaagctctatttgcataaattaaaaatattttcccaaaacgtgtaagttttatatttctaccttttttctcaaataagggaacttttaactcatcttctaatttggatattgctttgcttaatgctggttgagttattgataaaagtttagctgatgttgtaaagttctctgtttcagctataattttaaaatactctaattgctgtaaattcatttttcctccttattctaattttcaaacctataactaaaagttatatttatataaataatttgaattagacatatatgatatataggtgctataatctcattaaatatataattttattatataaatgaagtataaattttatttattgatatgtcaaaatatataagtaatttgggagggtttaatttatgatgaaagttgataaagacctttgtataggttgtagtttatgtgttaatgattgtatagtaaaagatatagaacttgtagatggcaaagctcaaattaataatgtaaactgttttaaatgtggccactgcatttctatatgtcctaaaaaagcagtatcaacagatgattataatatggatgaaattttagagtataataaaactgatttttctatagatgctgataacttacttaattttataaagtttagaagaagtgtaagacactttaagaaaaaagatgttgaaaatgaaaagattgaaaaaattatagaagctggaagatttactcaaacatctactaacgctcaaaatgtatcttatatagtagtaaaagataatatagataagttaaaaaaaatgactttagaaagcttaaatgaattaggtaaaaagttgctagataatttaaatccacaaactattccatatgaaaaatatgctaaaatgtggattaatatgtacgaatcttacaaaactgaccctaagggcatagatggattattttttaatgctcctgctgtaatacttgtggtatctgattctccggtaaatgcatcacttgcttcttcaaatatggagcttatgactaatgcactaggtcttggtacgttctttagtggattctttataagagcagctgataaaaacaaacaaattatggactttttaagtcttaatgaaaatcaacatatagttacttgtatggtaatcggatatcctaatgtaaaatatcaaagaactgctcctagaaaagatgcagttatatcttggaaatagattttgtaaaaataaaagcaatataaaaatcttactctaaaaaaattttatattgcttttatttaatttaattataattctatgtaatttagttcttcttcatctttaactgatatccattctttttcaagaagattttcattttctataattttatttactggcattttcatatacttaccagtagcagttactgctatttctccatttggcaatataatttctcccgttccttcaaataactttctattttcttttattattcttcctactacttttatagtacagtctgttggcacaggctttttatactttatatctaaagatacagtaacaccccaaatttcatcatttgataaacttatagctctacctatagtttcatctaatatagcagcagacatacctccatgcattcttcctgggtaactttgatgccactctttagtatcacatatagctactaattcgttattttctagttcgtaaaaatttgcttttaatcccaaatcattttcaatcccacaaactaagcaattactgctgatattttgcttttttaacactttgtatttcatagtgttacctccaatcttgtactactaattccctaagtattatatcataacaaaaatatgaatgtaatttaaaatggctaaggttatgataactcaccttagccatttgtttatttagtaactaactgtaattcaactggaataaatttatctactttttcaccttttaaatattgattagctatctttaccgctgtttctcctataagtatcggttgttgagctacagttgctgccatagtacctttcttaactgcatcaacagcatcatccgttgcatcaaatcctactactagtacatctttcatattcgcatctgcaagtgcctttgatgcacctaaagccatttcatcattttgggcaaatacagcatttatatcccccttagattgtataatattttccataacactaagaccttttgttctatcaaaatctgctgattgtttggctattatatctaagttactaccttttacaccatcttcaaatcccttacctctatctcttgttgctgatgaacctgctattccttcaagttccactatattacctttatttcctaatttgtctattaagaattttgctgccatgtcaccaccagctatattatcagaagctatatgagatactacatttccaccatttgcaactctgtctacagtcatgactggaatatctgagttgttagctatcattactgacgccactgctgagtctgaatcaacagggtttaataaaactatagatacaccttttacacttatatcttccatattagatacttcttttgctggatcgttttgagaatctagtactacaacctcataacctagtttttttgcttctttttcaacaccttttttcaaatcaacaaagaagggattatttaatgttgatactataagccctattttctttgtattattatctttttgactacatcctactagcatgaaacttgataagactatagtcattattattgaaagaaattttttcattattatcttcctttcttagttactttttctgtctaataatacagcaattagtataactatacctttaaccatcatttgatagtacgatgatacatctaatatattaagagcattacttagtacccctattataagagcacctattattgttccacttatcttaccttttccacctgtaagcttcgttcctccaagtactactgctgctattgcatcaagctcatatcctgtacctgcagtaggttgagctgagtataatctagaagttattattatacctgctacagctgataatataccacttatagtgtatacccatatttttattctatctgtattaagtcctgataacttagttgcttcttcatttccacctagtgcgtatgtatatctacccattttagtgtggtttaaaatataataacatgttataaatactactattgttataattactggcgatggtacctctaatattgttcctccacctattttaccaaatgccattgctaatgcattacttcctaaagttatcggctttccatctgtaaaaactaaagttatacctctaagtattgtcattgttgcaagagttgctatgaatggctgtaactttcctttagcaattataaatccatttaaaaatccaactactgatccaactactatagctgcaattactgctactataatgctttgccctgatgctaaaagcgatgctgcaaaagctccactaagagcaaggactgatccaacagaaagatctattcctcctgttaatattacaaatgtcataccggctgctattatagcattaactgatgtttgtctaagtatgtttaatatgtttctagtacttaaaaacgatggactaagaatcgaaactacaactattaataataataatcctactaacgacttatactttattaataaactctttaaatctaattgtttatttttattttgacttattttagcttccatatttaagcctccttcactttaactgcatattttaatatactctcttgagttgcatctttgatatctaattctccagttaatctgccttgacttaaaactagtattctatcacttaaaccaagtatttctggcatttcagaagatatcattattactgccttaccttggcttttaaatttatttataagatcgtatatttctttttttgcaccaacgtcaactccacgagttggttcgtcaagtataagtacatcaggatcagtcataagagctttcgctattgcaactttttgctgatttcccccacttaaatttttaatgatttgttcttcacttggagtttttatattcattttctttatataatctttaacttgagtattttctttagccttatttaatttaaataaactagataagctatctaatgatgatatagtcatattttctctaactgataatgaaagaattaatccatcgccctttctatcttcagatacatatgctatcttatttttaagtccatctttggctgacttattattaacttcttttccattaacaatgacttttccattttctttttttatgtgtccgtatatagtttttgcaagttcagttcttcccgctcccataagccctgcaatacctactatttctccgctttttacattaaaagatatattatctacatatttattagaaatatttttaacatctaaaattacatttcctttttcaacttcatgtcttgggaattgatctgtaagttttcttccaaccatcatttctatcattttatcttcatctagattgcatatttcttcacttcccacatattttccatctcttaaaactgttatgtaatcacatacttcaaaaatttcctttaatctatgtgatatatacactatggcttttccttcattttttaaatcttctattacattaaataaactttctgtctctttatctgtaagagcatctgttggttcatccattattattatctttgcatctaatgataaagcttttgctatctctaccatttgctgttgccctaaacttaaatttccaactaattcttttgaactagtttttatatttaatttatttaaatatttatcagattcttcataaagctttttaaagtctattttgaatccttttttaggttctcttcctaaaaatatattttcacctatagttaaatcttgtattaaatttaactcttgatgtattattgctatacctttttcttgtgcatctttaggtccttttatatcttctaagtttccattatagtagatttgaccaccatcttttttatatacaccacttaaaactttcataagtgttgattttcctgcaccattttctcccataagagccattacttttccttgataaagttctaaattaactccatctagggcttttactccagggaactctttaactatatttttcatctgcaaaataggacttttcatatagtgctccttccgaatttaaaagttttactaaaatacaactcctgattttaatattatgtttgaatatggagtgcattctcctgttctaattactgcgtgagagtctttagtcattttcttaaactcttcatgttctaccattgttacttttacattttcaaatctatttaatatttctttatacatctcgtttgcagcatcttttatttctactgctattattatttcttctacacatagttcttcaagtactgtatctaatgtatctaagaaagttggaactccatactttaaagctaaatctattcttttgacatctttaggtataggtaaaccacaatctccaatagttaagctgtctgtatgtcccatttgagatataactgccgatatttcgctatttaataattttccttttttcatatctttaccccctaaatttattaacttcttctaatgttggtagagaactttgcgcgccttcttttgtaacacataaagcacctactcttgatgcaaaatccatagctgtttctatatcttcattctttgaaaaagctactgctaaagcacctgtgtaactatctcctgctgcagtagtgtctacagcttctactttgtatgattttttaaacattgatttgtctttatttatatataaactacctttagaccctagagttactattaattctttaacccctttttctatcatagttttagctgcatctaaaatatcatcttcattgtttatacttactccacttaatatttcaagttctgtttcattaggtgtaagtaaatctacattttctattatagaatcttctaacttaacagcaggcgctggatttaatattgtatattttccaaactccttagctttttttaatgtatattttatagtatcaagtggtgtttctaattgaacaactactatgtcacttccttttatagcttctatatttttatctatgtcatttttgctgactttaaagtttgctcctggtgcaacaactattgcattttctgcatttttatcaacagttatcatagctacaccagttggtccattttctttatgtacataagttgtatcaacattattatttttaagtgcatctattaaagtttgtccaaaactatcagtcccaactttacctatcattgttacatctccaccaagtcttgccattgcaactgcttgatttgcacctttgccacccggtacttccttaaagtcgcttcctattaatgtttgtccttttttaggcatgttttctacgtttactactaagtccatatttaaactacctattacacatatctttttcataatcgtcctcccctaaagttttgagatgttgaacttcttattacaagttctggtttaaaaatcattttttctatattattaatttctttattttctaagttatttataagtatacttgccgactcatatcccatatcataggaattttgttttatagttgtaagttgcggctcaattatattcgcagtttgaatatcatcaaatccaactatgcttatatcttgtggtatttttatacctctttcttttaaagcttttatagctcctattgctattaaatcattggctgcgcatattgcagtaaaatttatttcatctagatttttaactacttcatagcccgattcaaatgaatattctccttgtattacaagatcttcattgaattttatatttgattccttcaaagcttttttatatccttttaatctatttatagatatttcactttttaatggtccacttaagtaaagtatatctttatggcttattcctactaggtgttttgttcctaagtaagttccttcttcattatctaaacttactacgcctttaagattttctatatttaactctttatcaactaatacaattggttttgatgatattttatattcatttgagttaacttcagttttagaggatggtgcaaatataattccatcaaccatcttctctgttaatgtgttaaaagctcttgtttctttctctatgttttcatctgtattacaaagtattatattgtaaccttccctcacagccttatcttctgctccccttgctatatctgtgaaaaatggatttctgatatccggaattataagccctatcgttttagttttctttgttactaagctttgtgccattttattaggtacatagttattttctcttacgatattaagtattttttgccttgtactctcactaatcttttggtccttattatttaatacttttgatactgtagtttttgatacccctgctaaatttgctatatcttttatagttaccaattaaatcctctcccaagtttatttagtgtattatttttagggttaccggttatccttttttataaatataccatactatatccatttaatgcaacatatttttatttgtatatcattttgaaatcactttcctagattattcaacacaaaataacagctattactatagcattttcaatatttttgatgattacttaatattttttcattttattatttttttatgatatacttttaaccttatcatttaaatattccttttcattggattttaaaaaaagattaccctaaattagagtaatctttttttgatataaacttttctagaaaaaacatattatgacctatagaatgtatttgtatttcaaaacatataccaaatattctttgtttaaagttatttcagaactcccatatattttttgaagctttctatgtatgcttcttgcttcgaatccaactttatcatatttaaatactccacaatcctctagggcctttttaaatataatacctacttcatatcttaagatttcatctatataaaaagagctattctctaatagagatagccctctttttatagtttaaaataactgtaaaaatccgaaatagatttatatcgttcttctctatttggatttattgccttaaccactatatggtatagttctttagaagcttcccacttttcatatgaatggtctttatcatctccaagtattccaaaaattaaagcacctaaattaaatacattagttttctcatcgattggtgaatttaatatatactcttcaggtgatttaaatctttttgaaccccaaaaatcttttcctatatcatttatagttggttttttcctaaaaagatctatatcgcatattttagttatatgattatcaaaatcatacataatacttccatcgtataaatctactgctacatatcctaactgttcaacatttaaaagaaatttaaatatttcatttatggatttaattcgcttatctattggaagttttttatatctatagtaagctgattttggatgtgtgtactttggatatttatcaaagttccagtgttcatgtaaattttctccttctatccattcaaatactactccatatccattatctgtttcgaagctttcttttaattttattaactgatcgcacttaagatctttataaatattgctagttctttttaaattttctacagctgtatttatatctctatcataatttaaagtcttagccccagcatattttataaaaagtttatcagatcctcgctttactccaaaacatatattcccagaatcttgttggtcgaatacacgaaatacagttccaaatttttttaaccaattaaagtcatattcttctctcagttcaaaacaaacgccatctaattcgtacttaatagtatttttcaccattaatttcccccttacttcaatcctctatacttaattaattattaatacttaatataactttaatttcatcaactatatcctctatactcttatttgatgtatcaatttttatagtatccatcttgttgtataattctagtctatctaaacttctttttatattatcctcatatcttaaaccaagtttaatatctttgtttattctatttataagattttctttagagcacattaaagttattttataaacatcaacactagaagaatctattttatttaatatatctttcattatatcctcagtatgtatcacccagttaaatataatatatttagatttagaattttttataaaattatttagtatgtatgatatattatctaataccataaatttattttcatctgtaacttcaaatgggttcatcatccagcagttatctccatctaaccaaaatgaattatctaattttttatacaatgctttacttatggtagtttttccaactcccataactccatttataatgattaacttcttttccattaattctcccctttaatctatatatcttatttttaatttaatacttaagctatcatagttattataaattaatatctataataaaaaaggattctcctaaaaattaggtaatccttttttacaattaacagttatactcttcatttgcaatattcattttagatattattttaaaacatataattccacctactataattcctattccgcctataattcctataggcataggtcctataaataagttaggattttttatggcactaaacatcatacctatacctgcaaatccatttaccattgcatgcccaatagctgcaggtatgcaacttttagtttctaaagttaaatatgctaatagtgaacctacaaatatacaaaatattatcattgccaatattccaccccaaggagctgtaggatatgaaagtccatagttgtgacccatagcaatcataggagcatgccatattccccaaattataccactaataagagttgctttaattggagaatatctttctaaaaaatttggtagtaaataacccctccaaccaagttcttctcctaaacaaggtataaaatttgcaataggagcaattaatataccagatgccatttggaaaattaacatagatttaatctcactatcactaggcacagcctgaccaagagttgttaattgagcttttgtattatttatcatattgctcatattaccatcaaaatgtgcagggaatattataaagtatactatagccccaaatactataagtaaaataggtaaaagccatgccattaaatagtacttaatattttttttaaaattaggttttatccataattctttaaatttttccttagttattaatgtagttattataactcctatagcaggcacaaacatacacccagttattataactcttgcatatggattttgatatcccccattaaacatcaacccaaaagtcataatccaagttaataaaaaagttattacaataaaaatatttactttcttcatattccatcccccccatagattctaatttaggaacatatgttatgcataaactataacagatataaatattacctgcaatatatataattttataaaatatatatgatatattgattgctatttaagtataaataaaaagtacctcgcaaaatacgagatactatattataaaatcttcatcttctagttcttcatatatacccttttgatatccattgcctttagttgaaaagaaatcatgtgatttagtttctgtgcttagaccatttaatacaatagggttaatctcacttactttataataatcctcaaatcctaggttttctaaagctctgttagcattatattgtaagaaatttataacttcatctataagtccactaccttcataaatctttttagtgtaatttatttcattttccataagagcttcaaatatttcatacattttaacttttaatttaaatttttcatcttcattaaatgtatcatatatctcttgagctaaaagacctatatacttaccatggagtgattcatctctaagtataagtgatattatttctccactagctaccatttttccttgtcctgctagatatagtggatagaaaaatcctgagtaaaataaaaagctttctaaaaatacactcgtaaccattgataagtataaacttctttggtctgttgtattttcatattgagctaatactaaatctgcttttctttgtaatgtaggctcactttctatccaatcaaataattcatctatttgagttgtagtcaataatgtcataaatatagaagaataacttttcgcatgtatttcttccatagttcccataaaagataacactgcttttctttgtagattatcagttaagctcatcattgaaggaactccgttatttccttgctttgtatcaagcagtgtaagtcctgctagtacttttttatatagttctttttcactttcttttaaatcattccaggtttttaaatcttttgatactgatatttcttctggtagccaaaattgttttacattttgatcccaaaacgcttgcgtaaatccatcatcttctttgttccagttaacagctttgtgtactttatttaaattaaatgtcatactattttcccccttatactgaacacattagacattcattgttatctcttgtcatttttgttcttgtgtaatacaaactttttaaaccttttttatatgcatatatataatatcttgctatatctctagtagttttatcatctgttacaaatagcgtcgttgatattccttgatcaacatgttgttgtacggttgctactacatctataacatttttcatatccatcctatatgctgattgataatatagcatattttcattagttaaaaatggcataggatatattgtcgttgaatcaccataagttctaacttctacaggttccataataggcattatacttgatgttgcattttgaacataacttatgctttgtgttggtgcaatagctgttaaatatgcattatatattccattttcttttactttatttaataaatcagcccaatctttagacgttggtatatctattccttcaaatagtttagatactttattggtttttggtaaatatgaattattataatattttgaaagtacactactagcttgtcctttagcatattcagatttttcaaatccatcaaaagtagtatttttttctatagctatttccatagaagctttaatcgaataatatcttatcattgcaaaaaatacatttgaaaagtctatagcttcttctgaagtatataaaatattttctcttactaaatatccgtgtaagttcatagccccaagccctattgcatgagaagcattattccctttttttatagtaggaacttctttaatatcagttttatccgatacaaaagataatgctcttatagctgtatttactgtattttcaatatctttattatccataacattggctatatttaatgaacctaaattacaacttatgtcttgcccccataagttttcgcctccataaccttttatgtctgatggtgtttgatattgaaaaatctcacagcaaagattagacattttaatatttcccacatcttttaaaacatgttccttatttgcaatatcaataaatactacataaggatatccgctttcttgttgcatttgtgctattttagttaacatctgtctagggtttatttccttttttagtatgtcttcatcattttttaacttatcataccaatcatccatttttatatcatctaaatggactttatactttttatatactgaatgaggataaaaagcataagcaatttcatttttttctgcaagttccataaatttattaggtataattgctccaagtgataaagatgctaatcttatcttttcatccgcatttatctttttggtatccattaatatttcaaagtctggatgaaatactgttaagtaaactgctcctgctccttgtcttgctcccatttgattaaaatatgtgaaagattgttctagcatttttgcaacacctactactcctccagcagctccagctatgtcttttattggttctccactagctctaagccttgataagtttagagctactcctccacctatcttagataaatgatttgatgatgatatagcatatgatataccttctgtactatcttctactgatagtaaaaaacaagaaaccatttctcctgctctttttctacctgcatttaaaaatgttggtgtagctggttgaaactcttgttttataagttttttagataaatttaaagctaattttttatctccattacctaatgctaacgctacaattagaactttatcattataattttctaatattttttttccatcattagtttttaaagcatagttttgataaaatttatttgcactcatatatgacttaaacttaaagttttctttttctatattgttataaatttcttttataaaatctatagaatatttatctattacatcttttgaatagtagtcattctctattaaataatttaatctagtttctagattttcaaattttttcattctaggatttatatattcttctaagtaactattaagagcttctttatctttttctagttgatattttccttgtttatctttaattattacttcattattgagcttaatataattcattttttcccacctttacaaaatagataaataaattcactttcaaaatacaatatgtagttatttttccttttccttatactacatattgtatatacaccacttttagaatttttaatctactatttttttaaattaattttttaattttaatttacttagctatttcaaggtttttagttttttaaatttttcaaataaatttatttgtttacaaaaatcatattttgtattatactaacttttagtgggaacttatgctcagacataagtatacgctagcccataaaaaacacctatcttttgataggtgttttttcgttaactaaagaaatttataaatgttactattgttggtatggctactaagtctattaagaatgcccctactaatggaactatcaaaaatgctttagttgaattaccatattttgatgttactgaatttatattagctaatgcatttggcgttgcacctaatccatgacctaacattcctgaaaccattatagctgcatcaaagtctttccctaataccctaaatgctataaacactccatataatgctataaatataacttgagatgctactattactatcataggtcctgctaatcctgacagttcccataattttatagtcattaacgccatggttaaaaatattcctaagcaaatattacttattatatcaattgaatacaaatctaaatcaattattttaaatctatcatttatatttctaaatattactgctataaacatagccccaacatatcctggaagcactattttagttacagatgaaaaccaagttccaactacacttcctacagtcatacaagatgctattactgctatttgtacaatcatagtatttgaattaaaagaatcactaagttttataccagctacgtcttctactgaaacattgttattaatttcattttcatttggtgttaatttatatttatctatcaaatatctggatataggtccacctataagtcctccacacattataccaaatgtagcagctgccatacctattgtaattgcgccatttactcctaaggattctatcgttgcaccaaaagatgctgcagctccatgaccaccttccatagaaacagccccacacattatacctattaaaggatttatatttgtaattttagcgcctataactcctattaaattttgtgctattgaaagtaatccacataaaatccaatatattataagtagtttacctcctttttttagcaaattaaagctagctcctaatcctattgttgtaaaaaaagctatcatgaaaggcgattgaagtgttgtatccatagatatatttagcatattagaggtttttaatataaaaataataattgcaaataacaatcctccaattactggtcctggtatgcaaaatttttctaataattttatttttctttttagaaaattaccaaatagtaaaagtaaacttcctaatgcaactgtagctatcatatctaaatttatattatttattccatctattatttcaaattccatatacacttcccctttattttataaatattgagctttataaatatatactcatcaaaatataaagttagaatctaaaatttataaaataaaaaatgctttgattaacaaattagtcaaccaaagcatttttaaataattattttttaattttcattaccaaaccttctatatccatcattctatcgagataataccatttacattcacttttaatttttgcatatctatcttttttatcataattagaagcttttttagtataaaacttatattcttttttcccatcttttttagtttaaactctcatcttctatatcgatatatatagtttttatatctaccattagaatacctcctgtttttacttatatattattatgtatgtaatttgtgtcaattttgttatatattttgtaatctttatagtattgaatatatgtttatagtttaatataattaagtgtacgttaaaaataataagaaagaagggatttttttgtcgaatttaaaaaaattcgttattgcgctaatactattagttatactaatacctgcaggtgcatttggttatgtatattttaaattaaacactgtatatgatgataatgcagatacaaaactacttaataaaacaaactataaagtagaaaaaggaataactaatatattattagtaggtatagatgctagaaatatgcatgaaagatctagatcagattcaatgatgatacttactgtagataataaacacaaaagcttaaaacttacatctttagcaagagatacatatgtagacataccaggtcatggtatgcaaaaattaacacatgcatatgcatatggaggtataaagcttttagtcgaaactattgaaaataatttcaaaattgatttacaaaactatgcaatagttaatttcttctcatttatggatatagttgatgctcttggtggtgttactatagatgttcagaaaagtgagcttaatgaattaaaaaaatacactcaagaatgttatgaccttaatacaaatcctaaaaaaggttctcttgagtttattacttctcctggatatcaaaaactaaatggataccaaactcttgcttatgctcgtataagatataatgattctgcaatgaatagagatcatcgtcaacgtcaaattatgcaagcattaacaactagcttgaaaaatctaccaataactaaatatcctgaattagtagatactattttaccgtatattaaaacaaacatgaaacctggtgaaataatcaaacttggtgcaacagtccttaatataggaaattttgatataaagcaattagagtttcctgtcgaacaatatagtaaaggtggaatcgtaggtaaaaatggatgggttcttcaatttgattctgataaaaatctacctatacttaacgattttatatttgaagatattatatacaataaacctaattattagagtattataataaaaagattgtagataatttaaaatggatcctatatagtgaacgcgaaaaaagtgtatctatataggatcttttttctaaaacattaatttaggagttatttaaaaatggatacaaatatatttacagaacaagaaattctagaactatctaaaaataaatatataaaaatgaataactcgtaccaatgaatttaaattgtaattcattagtaaatatgaggatagcaaaacttcgagaaatatttttgaagatgtagggttttaggtttcgatagtcgtaattaaacgtatagattctgatagtttaagatggagagcttcatataaggataaagtggttttagttttagaagatactagaactttaaatttaataatgtgacaagacatttattcaaaattgctaatgtatctacttttggttatttgaattcttaaataactttaaaactgaaaatattactaaaagcatttaactttcgtggatatgaaaaatattttaaaactattatgatggtattaaataataaattcaacataataataaatagaaagaaaatccaaaggcttatgagaaaatataatattattactcatatacgtaaaactaatacatataattgtatagctaaatctacaaaacgggtatagaattgttacaaataaactaaatagagattttaaataaaacataccatgtaaaatagtattaacttatattacatatataccatatagtaataataaaattgcatatctatctactgtaaatgactcttcaactatagaaatattaactgaagctctgaataaactggtcaatcgatgtatcaaagaggtggttttttaggataatactacgcagaaatcattctttagacatatggattacaaaaacttaaaaaagttgactcctacacaatacaggaatcaacttttaacaatctcttaaaacactctttttttactgtccttactaagaggttaatttttttaatatgagttcattttttatatatttaaattagttagtgaataaaaatttcatagaatatcaaaatttatgatttatcttttctatctaactgcatcttatattattttttatttattttagatttgataatatttacaatatctattaactcttctgtttttagtaataatagtattaatccatatacaatagcacctatacctacagatatagttaacgatattatctgagatactgtattagatcctattgcattatatgagatagagtatatccatttagaagctactcccataatagtagcagctattaatgattttataaaaactaaatttactgcacctaaccctatatcacctatacgtttccttaagcttattatgaatataattagtcctacaaacgcagatatagaactagctatagctaaacctgcataccccataaatttaatcaaagttatattaagtattatattgacaaccattactatagctccatttatcataggagttttagtatctttaagcgaataaaatgctctagatataacatcatttaatccaaatgctaccattcctattgcatataaagataatattgtagatgttactatagtagctttatatgtgaatgcacctctctcaaaaacaagctttactactggctctgagaatactatcgttcctattgttataggtataattaataatataatcgtattcatggtttttattaaagactctttaaatcctaagatatctttacttgatagtaaatatgataatttaggatacattacagttactatggatgctataaacaaaccttgtacaaaataatacaatttattagcataactgaaagatgcaactattgaaggtcccaatgtagatgctaatgacctatctatcatattattaaattgatttacagaaactcctattaacacaggtataactagtatcattagtttctttatattttcatctttaaatgataatataggtttatatctgaatccttttttatatgcaaatggtaattgaaatataagctgggatatagttcctattaaagttccataaacaagcacatatacaccatatttagcacttaatattattgatacaataattatgatacttgatggtaaacttattaatcctggaatattgaaatttccttttacctgtaaatatccaatcatcacattactaatacctgtaaataatataccccaaaataatattttagtaaattgtacagataaattaaatgtctctttttcaaatccaactgcaaaaagtttaactatcggatccgtaaatattaatcctattattaatataactgaacataaaataaatactattccaattatattgtttataaatttatcagcttctaactcacttttttcactttgtatgctcgtatacataggaactaaacttgttgatattgctgaacctaagcttgcaaatataacagtgggtatatttaatgctgtaaagtatgctgctgcatagtttgaggttccatagtaatatgctaatacttgctctctcgcaaatcctattattttagataatatagttactatcataagtccaaatgcagctttagctatcttagacatgttatttctcctctcgtgtcttaatctcaaaaagcatttacctatatagataaatgctttttaattataattctaaatttattaagtgcccataccttttatctttatcaggtaatttcatatagtctccatataatttttttaaatagttatcataatttctaggtgcataaaatttatatccttcaaattcaacttcaactagtggatatacgtctgattttttctgagcatatttaaattccataaatacagtttctattccatatactaaataatcagactccccttccttttccaatttattgcatttttttatccatatattttctataggcatcttttgaagaatatgttttacataatccttcatacaccttttattccttctctccatatgaattatcttatttattaatttatatttagattcatcacaaatattttcatctactgaatcaacagggaatatatctataaatgcacctatatgaatttggttcacttgtatatcaaatcctttaaattttcctgtataatatatttgagtaaatccatgtttttctgttttatgtttttgaatccattctttagtttgcctatttccaaatttcatgtattcaggtaaaatcccttttttaagcaattcattcaactttttataatcttctctaggcatacatatatcacaatcatcatcccaaggtataaatccaccatgtcttattgcacccaagagagtccctgaatctatccaatattttaaattatattttctacatattgaatcaattagaaataacatttcacattcaactaattgatattttcttaagacatctatacttttatcttctattattttatctattttttctttaagcataataaaacctttctaaacacatgactatatttggaagttttaataattccttttaagtccattttaatatcctctatcttgtaatatttcttcggattatatatttgttcttttagtttttctgttattataccatcagtattatttaactggtttacgatttcagaccttaatttatctttcactaccttatcttcttgcatcttatcgcaatatctaagtgctgcccaataaaaatatcttattttttctcttattttttcatttgtcttattattaaatttctctttattgcttatataaaaatcatatccatccttagccacaactttcatactatatgcatttttataacttattttactcgtcattatcgaactttctcttactcttctattaaaaaattgtttcggtatatacataactcgtttagcacttgttattgcctttaaagtatgtatttcatcttcatgtattattccctcatgaaaatctaacttatttttcattaaaaactctttattataaaaatttaaccatacaggagtttcatatcctcctttttcagaagcataattaaaaaattcacttccactcatgataatagattctaattttttacttctatcataattttctattaatttttttcctgtatatctactatctacaaatgattttgcatcaaataatactatatctaaattatcttttttagctatattatagcaatattccatagagtctaatgtgatataatcatcactatctaaaaaatatacatattcacccttagcttcgttaagacctgaattcctagctccacttaagcctttgttttcttgatctactatttttataaatttatatttttcagcatatttcattaatttttctagcgatgagtccgtagatccatcatttactgctattacttcgaaactatctatagtttgatttattgcagtctctatacattcatctatatatttttctacattgtaaactggtataattatacttactttcatatttacctgcctctcaagttctataataattccctttataagttaatttcaacctaaaatatattattctaattattttcaatatttattaacttaaatactttatttgtactttactataagctttaataagtctaatgcgtttttaaagtatctagatgctaatcttcctggttcctgcataactctgtgtaaccattcaagacctagtttttgcattatttttggagctcttgtaactcttcctgccaaggcattaaatgttcctccaactccaatgaatacttttgcatttatatcatctatattatttactataaaattttcttgaataggtgaactcataccagccaaaagtatgtctgctttagactcatttattatctctataacttcccttaagcttttctcgtttttctcaaatcctataggtggtgagattgcacccgcaatattagcattgtatctttgttctaatacttttgcagcctcttttgcaacatcattctctcctccaagcaaaaataatgatatatctttattacttgatttttttgcaagctcagtacagaaatcaataccagctattctactagttccttttatacgttttattttagatatccaatatacaggcattccatctattatagatacatcagctttgtcacacacactcttaaagtcttcactttgattatatctagttaaaaaatctacgttaggtgttattataaaagtttttttattatcataaattctcttaattacattatctgatatacttttaatattacctaatgtaaattgcatccctagtatagtacatttatccatttcacatttactccttttttgatttttcaaaccacgattttgcttcataacttgataccattccacatattacaattgctaacattgatccagccatagctccaaaaaacacatgtcccgctagaaaaccaagaactagtataattattaaagacaatgtatatttcatattcttttcatcaaaacatctatacttgcatatataattaaatatgtatccatatactagaattaaacctactactccatatgagtataataaatcaaaaaaatccatttcaattgccttcattcctatctgtccataaaaattaagtcccactatactctcctttataaaagagctaaatccaaataatatcattattattggatgatttgatgaagaaattgcattattcattatgtttataaattcatttcttccacttaataataatgtcaaaattggatttgtgtcatttgtactataaaagttataaaaatgaatttgcctttttataacttcataaattagttcattaaaaaaagtcattaacattagtataatgataacactagaatatataattaatttatagaattttttcttttcatttttattatatatagattttataaaatatatgattatagctataaaaggtgcagttaatccaacttttgatccaattgatatagtacttataaataaaaaaataaatattaatatattatatatatttacttcattataaattttgtccactgcaaatatacatagcacagacaatattaatcctatttcattatttgcattgaaaaagcctttgctccctatagttgagtcatatgtagtcatgcctattccaaataacataggaattattatgcataaaggaaaaattatcaaattaaaatttataattttttcaattaaatctctaccttcttgggcnnnnnnnnnnnnnnnnnnnnnnnnnnnnnnnnnnnnnatttatagaacttccaatagtcaagtatataccaattactattataggtatatattctttataattatttttatatacagtaaaaaatgaaaatattattaatgcaaacattctatatattatagaaatactaattccaaagtattctattagcaatccatttaaactatctattatgcctaaatatgccaaagttataaaaaatattttttcatatattttttcataattataagttaatatcaactttaatacacctctttattttttatcatagattttctccatagttttggagaattcttcacaactaaaccttcttattaaatctatctttccttgctttgcaaattttttagctttatctttattatttataagaaaaattattttctctgctaattcttcactattttcgctttcaaataataaaccattattttcatcatttattatttctgaaattccaccaacattagctgcaattattggcttattattattcatcgcttctaatatagaaattccaaacgattcttgcctagatggttgtatatatatagccatttcttcaatatatttatttacattcattttaaacccttttaagtttacattttcttgtatacctaattttacaatcaaattttttaaataatcatgctgcgatccgtctccaactaaatttaaatttactttataacctctgtcttttaatatctttaccgctctgattaaaatatcaaatccctttacattttctaatcttcctactgatcccaaatttattatatcacgttctaataaaaattcattgtacatattattttttctaatatcaatacaatgatatactacatctattttagttttacttagtcctctatttattaaatattcttttacagattcagatacagctatatacatatcattgaatgaaaataaacatttctcaattaaactaaacaatttacgttctatataatttctatccattctatcaaaatctgaaaacccatgaactgtggatataattctgacagatttattcccgattctactaaggttactaattaaatctccacttatgccattactatgaattatttctatattatttatattaatgtaatttttaatttcctttataccacttaatacatttttcttatttatatttacctctagtatttttattgattcaatatttttatctatcaatttatttataaaaacactattttttattccacaaatatgaatattgtacttattcaaatctatattatcaattatgttaaatatatacttttcagttcccccaaattctcttcctaaatttaatattagtatatttttcatacaatacctcatttctatgtaatctaactataaataaagcgtcgatacacaatatcaacgctatttatcaaatttatcacatataatatcaactatatatttacttgaattgccatcaccatatggattagaagccttagacattttttgatattctttttcatttataagtaactctctagttttattatatatatcatcttcttccgttcccactagttttaaagtccctgcttttacaccttctggtctttctgttgtatctctcaatactaatacaggttttcctaaagatggcgcttcttcttgtatccctccactatctgtcataattatatacgaactatctaggaaattatggaaatctaaaacttctaaaggatctattagatgaactttttcattgtttcctaaaatttcatttgcaagctctttgactattgggtttaaatgtaccggatatacgacttgtacatcattaaattcatttacaattcttttaactgctctaaaaatatttctcataggttcccctaaattttccctcctatgagctgttaataaaataattctagaacctttcattttttctaaaaattcatttgaataatctttttttacagtagtatttaatgcatctatcgctgtatttcctgtaacatatattgtagattcatttttcccctcttttattaaattctcttttgctacttgagttggtgcaaaatgcatatctgcaattataccagtaaattgtctgtttaattcttctggaaaaggagaatatttattatatgttcttagtccagcttctacatgccctaccgaaacttgattgtaataagctgctaaactacctgctaatgtagttgtagtatctccgtgtaccaatacaatatccggtttttctattttaatcacttcatctatcttttgtaatgatctagatgttatatctaccaaagtttgtccctttttcattatatctaaatcatacttaggaataatgttaaatgcatttagtacttgatctaacatttgtctatgttgagcagtaacacaaactatacattcaatttgatctcttgattctaattctttaaccaaaggtgccatttttatagcttctggtctagttccaaaaatagtcattacttttatttttttcacagttaatcctcctaattttttctattaagatgcatgtttatcacctaataaagccggtattgtcataaaaataagttttaaatccaataaagtactcctctctctaatatattttaaatccaactctacccattcatcaaaatctatatcatttcttccgcttacttgccatatacaagttatgccaggctttacactaagtctttgcatctggtaatcattatattgttcaacctctctaggaattggaggtctcggtcctactaagctcatatccccttttaatacatttattaattgtggaagctcatctatgctggttttcctaataaattttcctattttagttattcttggatcttcttttattttaaaaacaggtccattcatttcatttttttcttgtaatgaagctaataactcctccgcattatgaatcatcgatctgaatttatacattttaaatattttagcattttttccatttctatcttgcttaaaaattattttacctttaggatcttctagttttatcaatattgctactaatatgaatataggagatagtattattaatccaatacttgatcctaatatatcaattattctttttaatatataatatatattatttttcttatttacagtgtaattcatatttttttcataatcgactattttgttcatatttacctcccaaactacactttatatttataactcaataagtatactatattttgatttttttttcaaataactatactaaatacgacagtatttttgatattttaatttggataaattatcagtaaaatcaaaaatagtagagagattactaaaatcactctactattttttgatttttataatatctatagcatttttcgaatttttgaatttatatattgttttattttgatcgctttatcttctacaatcttattatcttttccacaaactccaatataaaatttaagctttggttctgttcctgatggtctaattgctatccaagatccatcttctagtataaatttaagaacatttgatttaggaagtccatctatacattcattataatccttagtttcagcaacttttaatacatctgtctcctccaaaccatttgctctaaaataattcattatttctttaattttttcaattccagaaattccgcttaatgtaactgataacatatcttctttaaagtatcctactttattatacagttctattaatccttcatataaactcattcctttagaatagtaatatgctgccatatcagaaattaacatagcagatacaactccatctttatctctggcatgagttcccactaaataaccataactttcttcatatcccataataaaatttttttcatttgtaatttcgaattgctttatcttgtttccaataaatttaaatccagttaatacatttaaacaatctacaccataactatttgctacttttgctccaaattctgaagtaactatagtttttattattgttggattttgaggaattttatctttattttctaagttttctagaatataatttgccaaaagtgcacctatttgattgcctgttaatagctcgtactcaccaacttttgttcttactgccactcctactctgtcacaatctggatcagtagctataactaaatcagcacattctttttttgcaaggttaattcctctaactagagcttttttatcttctggatttggataatctatccccgcgaagtttggatctggaatttcttcctcttttacaactaaaacattgtcaaatccaacctcttttaaaaccctttgtataggtatattacctgtaccacagagcggtgtatatactattttaaattttttacctactttattaacaatatcttttcctataaattgtttttttacagcttctataaatgccgtatcttgttcttcgcctaacatgactactaattctttatgattttttgccatagtaggtatttcactataatcgtttatacggttaacttcttccgttattttatctgctacctcaggcataacttgagctccgtcttcccagtatactttatatccgttatattctggaggattatgactagctgttataactactccagctatacaatttaaatttctaacagcaaaggaaagttctggagtagttcttaatccattgaagatatatgcttttataccacaagcagctaaagtatctgctgtttttaagcaaaattccttagatttgtatctactatcatatgctataactacacctcgtttttttccttcttctccaatatttttaattatataattagcaagaccaaaagttgcccttgctacagtataatcatttattcgatttgttccagcacctattattcctcttaatcctgccgtcccaaattctaaatttttataaaacctttcctttatttcattttcatcattttttatagataataattctaacttagtatcttcatcaaagtaaggatttaaaatccattcctcatatatttttttatagttcatgatttgattctcctttttataatctctattcctttttataattattttattattttactatatattagaaatattttctatatattaaaaaactctttatatttaaataaaaaaaagcttaaattaatagtactactttgctattaatctaagcatctctatgattattttaactgttttatatatttctcaactacttctaaatctttaactgaatctatctcaaatgaatcatcacttttaattttttcaaaatagatatctaaatcttcaagattatttttcaccatatcatcccagtataagtctgtgaaatttccatttgatatgctttcttctattttttttgcaatcaactgtccatcctttttgctccaataagatattccagataatatatatccatcgccatcttttacaattatatcatttacttttttattttcatcataaactagcatccactcatttttaaaactttctttatatccactaaaataagtagatttatctatatcttcacataaaaaatttctatgtaaatacacatcagcgtctataacataactatcacctaagtaatttcttactaaatacatcgtatatatattgttatatatatcaaacttattattatgtataagcttaaccccatacttacctttaagatattcaaacttttcacttaaatatccagttacaactattatgtcatctatacctttttcttttaaaaattctatttgtctttctaacataggttgattattgaccttgactaaagattttggtgtttctaacgttaatggtcttaatcttgtacccatacctgctgccaaaagtatcgctctcataaatacactcctccataaactagttttttgaaaccattattgaacctattattataagtatactgcatagtattaatttgattgttatagcacttcctaatattattacatcaaatactatagcccatatagaataagttatattcaatgctgtagcttttactggtcctatagaatctatagcagtataataaaatatataagatgctgttccaaataacgctacaaatccgataaataaaaatatgtctgacttcattactatttcagttaagtccaatccatttattaatgggattattattaatccataaaataatgtagatacaacttgtcttatctgtaatgcttgagttggacttacttcatcctctctcattccatatgcacatatcacactctcaagagaccatcccactacacatattaaagctagtccaaatcctaataaatagttactactaattatcttatctggagagtatcctaatataataactgaaattatacttaatataagacctaaaaatcctcttttgcttaatttttcttttaaaaaaatatatgcccaaaaggcccctacagctggatatatagaagatatacttgccgtatatcctggccctatatattttatagctagtaagtatgaggccatacctatcggtcctccaaatatagcagctatacatataaattttccacttcttgttttcaaaacttctatcactttactcatctgttttgtcgctaaactatacaaaatcatccataaactagaaaacaaatcatgtaaaaatgcacttacaaatggcgctaaaaatatagcttcttttgtttctataaatggagaaagactcaacactatactagttaaaacagtatctagaccccatagcattccagacatagcaccagaaaataacccaatatttttaatttccataatttaactccccatatgtttactatagaatttttttaaattatactttgctctattgtatctatcttgcccataggttccaaagttatcaccattagcttcttttatattcgtccatatactccatagaaagtcttgacatattttatatataagaattttagctttgtgaatttcattcatattattttcaaaatatatatctaaaaacaattcttcttcatcttcattaaagtcacattctagtatatgagccgctaaatcccacataggatcattcatccctgcatactcccaatctattaagtatattctattttcatcttttacaaagttttctggtactgtgtcattatgacatggttttaaagctataccataatgttctaatgtatactttaatttaaaaaccttatctcttacttcaaaatagtcattaaatttttttccaccattttcttctagtaaaatttcatactctcttatcttatcaaatacattaaattcattttcaaaagttgatccagaccaatgtaatttttttaatatatcggttacaagtttcatattttcttctctttttgcagttttaggatttatagtttctgcattatttatgtacttacataattttataccattaaattcattaaaatataacatttctgcatctagccctaattcactgacaatcttagtattgtatttttcactttgtctatttatcattgcttcagttccattgcctggtattctcaatatatatttctccatattaatagttactttatagtttttgttcgtcattccaccaactgcttcaatactatttatttcgtcaatatctattttaagagaatctgataacataagttttatattattaacttttacctcttcttcttttctttttaatttaggatatacatattttatagctctatagtaatggtcttcattatctatctctgtccatactaaattatctggctttatatacccaattttataatccctagcaatatccattaatgcatactcataatttaaatacggatttttattttccttaaacaaatctaacattttattaaatacatcatatgatatcttacttataccgatcatttctccatctatcttattgaactgatgcatatcctttgacattttgtatacatatccatctcttatttcaattaaggcttcatctcctgatccactctcacttgttattaacatacaatctctatgtttatttttgagtaactcttctatagctctttcttcaaatatcatatcattttcaattaatataaaatcatcacttatatgatcttttgccaatgataatgagtacatagttcctgtccatttgtatctttcactttttactaaagttatatttggattgttttcatacactttgaagtactcactcttgtaacctgttattattactattttttctattccattattatttagtatatctataactctatctattatttttccatcttctagatctaaaaacgatactggctttttaaatacatctttttctccagcggctaaaattactgcttggctaatctttttttcttcatttttatgtatagatattttctctaacttatttttttgaatatatttttccatatattcaaatccatttttagttaaactatacaactgcttattagattttctctcaacttctattaagttttctaattccatactctttatagctgagtttatatttccaactgatatatctaaagccttactcatattcctttgtgtaatattctcattttcatttatatactttaatatgctatatcttctcacaaatacaccctctttgttcattttttgaatacactttaatataacattgtatataaataatttcaatatgaaattcatataaaaataaaaggttataaataaatttatttataaccttttataatttacaattttaaaatatgctaatagagtttatttatgctaagctcgcaattccgttacttccaattttccatccatcaatagtttcattagttaccattcccccataaatatcaaaatagtaccaatcatttcctattaattcccatcctactgccattgctccatttgattttaagtagtaccatgtatctccctaaatatttattttaatttatatttacaatacaaaagaaatatattataaaatttctgaatttttaaattgatagtaaaaataagttttatgaatttaataaaaaggaaataagttttaatgtatagaataaaattataaatatatttatttgtaaaataagtaagtttattaaaataaactgatagttaaaattaatgatatgttaagggggagtatatgagtaaatacatttgtttagatataggtggaacatatataaagtatggagtgttaactcaagaaggcaaatttttatcaaaaggtaagaatccaacaataaacgaaaatcaacatatattagataatataaaaaatataatcagaagttgtaaaaaagattatgatgtaaagggaatttgtatatcaagtgctggtatagttgatagtaaaaaggggaagataatatctgctacattaatacctaactattcaggtttaaatcttaaagaagaattagaaaaagagtttaatataaattgtgaagtagaaaatgatgtaaactgtgtaggtattgctgaaagttttataggcgaagcgaaaaatacttcatcaagtgtatgcataacagtaggcacaggtataggagggtgtataatagttgacaataagattttaaatggatttaccaatagtgctggggaattaggatatatgcatataaaagactctaggtttagtaaaattgcgactacaagttctttagtaaatagagtatcaaaattaaaaaatagaaaaatatctggagaagagatatttgagttagcaaaatgtggagatgatatttgcattgaggaaattgataatatgttagaaaacttagctataggaatagctaatattatatacataataaatcctgaagttgtaattttaggtggagggataatggaacaagaggagtatataaaagaaaggttatataaacacttaaaagaaaaggtagtaactgaaattttagaaaacacaagcataaaatttgcaaaaaatcaaaatgatagtggaatgataggagcattaaaaaactatattcagaaacattaaaaatttattaaataaaattgaaaaagattaataattgtttttattggaatttacgttttaatcaatatataaaactatatgttatataagtaaatctaataatttacaattattaatctaatagataaaaatataaaattatttaagttcatcatttgcatttttaaaatttgtacttatttttctaagtaatcttaaaaattcttttttctcctcttcagttaaacctgtataagcagtttcttttacttgtgaggaaataaaatcaaacgtatcttttatatcaaaagctttatttgttaagcttatataagttactcttctatctatatcacatttctctttttttatataacctaagctaattagcttattaactaaagctgtaacagtagatttatctttaccaattttcttggcaatttctttcatcgttaatctaccatcactttcataaagtgctgtgagaatattaccgtgagttggaattaaatcatttaagttattcttttttaatttagtatctataaatttaatcatattagcttttgttcggctaataaaatatacaatgtatttatcgttcaaaataacacctccataaacaaggttaattaaattcatatattataataccacattatgagatatacaaactatatatttataatcaggagattacccgtatgaaaatactataaatagtagtttgaaatttttagttattgtttataagaagataattgataattgtaaaaatatgatttttacaaggttagtatttaaagcaaaagggaataaatagaattataaataaaaaggaaaataataaaaatgtaaaagtgaggagggtattttatgaaaaagttagcaacttttgctggaggatgcttttggtgtatgttcaaaccatttagtaattacgaaggaattgaaaagatagtagctggatatactggtggagaagacgaaaaccctaactacgaaaaagtttgtcaagaaataacaggacatttagaagctatacaattgacttatgatgatgaacttgtaaattatgaagacttactaaatatattttggaaacaaatagatccaactgatacaggaggacaatttaatgataggggaaatagatataaaactgctattttctatcatgatgacatacaaaaagagttagcattaaaatctaaaaaagaattagaggaaagtaatttatttgaaaatccaatagttactaaaatattacctgcgcaaactttttatatagctgaagaatatcatcaagattattataaaaaagaacctatacattatgaaatgtattataaaggatctggaagatatgactttataaaaactcattgggataaaaataataaaaatagagaaaatcttaaaagtaaattaagtcctatacaatttgaagttactcaaaatgataaaacagagccagcttttaataacgaatattgggataataaagaagaaggtatatatgtagatgtagtaagtggagaagtattgtttacatctaaagataaatttgattcaggatgtggatggccaagctttacaaaacctataagtaaaaatgttttaagagaaaaaagtgacttctctcatggaatgtataggacagaggttagaagtacaaaggcaaattcacatttagggcatgtatttgatgatgggccaaaagaagagggtggacttagatattgtataaactcagcagcccttagatttatacctaagaataaaatgaaagaagaaggatatgaacgttatttgaatttactgaaatagccttaaatttgtaactataatttaactttatttgggtataaaaaagttataattattttacaaactataagggaagtgaattaaggtgaataaaacagagtttaatccaatggctgaagtgtttaaatacttagctatatcaatattattttgttttgtaggctatgcatttggaaaggcatttattccagagagtgtagttatggtagctaattttatatttatatttgtggttttaggattattaattttatgtttactatcaagaaaggaaattataccagatcgatttagtatgaactgggtatatttatttacttttataaatggaatattattatatccaatacttcaaatgtatataagtgggctaggtagccagacagtaataataattttattagttacagctttaatattttttattttatctatggtagctaaaaaagaaaatagcgataaatatttaagactaggaaatatattattaattggattagtaattttaatacttttaagtatagtatctatatttattggatttaaaacgtttaatatattagtttcagtatttagtgtagtaatattctgtggatatatactatatgttgtaagtttaataaaatatgaaatagttagtggagatataaatgatagtaaagatttatcaatgcatgtacttaatttatacttagactttataaatatatttttagatttattaaatttagtatataattttagagattaaaatataccccttaccaaaatggtaaggggtatatttataggatggtgaaatttatgatattaggaataatttcagatacccatggattgttaagaaaagaagtaaaagataatttaaaagattgtgatttgataattcatgcaggagatataggtaagatagaagtaataaaagatttaaaagatatatctaaagtggaatatataaaaggtaattgtgataaaaagggtgaatttaatgatgttaaagaaagtagtatagtcgatataggaggcgcaaaaatatttatagttcatgatataaagactattaaagatagtttaaaaaaacttggagtaaatatagttatatatggccattcacataaaaatgaaacttacaaaaaagatggaatactatatattaatccagggtcagtaggaccaaaaagatttaaattaccaactacaatggcaaaattgaaaataaacgataaagatataataaattcaagtattgagtttatagaaatatagtatgaaaaattgaacattggttattaacatttgataaaatgatgtatattacaatataggaggacttaaatatgagtaagtttgatactttaataaacaatttaataaaaaatgcacctgaatttatgctaataaaagaaaatgaagatacatatgtagtattagattatatagtaagcagtttagataataaggctatgacttggctttttaaagtatatttggacaaaaattttaatataattgttgaagataatcttacagattatattaagaataaatataaagatagaaatttaaaattaattaatttaaatggaaatttatttttaaataaggatgttattagtgtgatattagaagaattagaattatctaatcagggggaatatgatgaagaaaatttaacgttttctttgaaatagacgcatcataacaaattagtgatataattatctcaaagaggttaaattaaggatatactattttattatggagggttttagagatgacttttaaattaagagagtacagagaaccagatttcacacaggaaagatttattaatgctccagatgcaaattatggggtagttgaaaaagatggggtagcaccagataattatcacgcaatgtcaatttacccagaatattttaaagtaaatggaaaatggatattggctgaagaaagtagaatggactgtgtacctgtaataacaactgataataaaattgaagttgtagaatttagaagacttaaagtaggggataaagtaattgtaggaagaactgaagatgcagtagatggaatatacttatacccaaatggatttcaaagcgaagaggaagcaaagggtgatgtttttgcttttagatcaggtagatcaagagagacttcatatactaaagactatgaaaatatgtatgatttattaagatatgaaaaagaaaatggatacatagtttgggtgttaggtccggcggctgtattttcaaaaggtgcaagagatgctatggcatctttaatagataatggttacgttgatgcatttttaggcggaaatgcagtagcaactcatgatttagaagcaggtatattcggtactgcattaggccaacatgtgtatactcaagaatcaataaaagatggacattatcatcacttagatttattaaataaagctagaagagctggatcaatagaaaagttaatagaaaatgaaaatataaaagacgggataatacatgcttgtataaaaaataatgtgccaatagttttaggtggatctataagagatgatgggccacttccaatagtatatggaaatgtctatgaagctcaagatgctatgagaaatcatgtcagaaaagctacaacagtagtttgtttagccactcaacttcattcaatagctgttggtaatatgactccttcctatagagtcgttgatggtaaagttagacctgttaatttctatactattgatatatctgaatttgctgttaataagttaagagatagaggtagtttagaagttactactatggttactaatgttcaagactttttagggaaattacaagaaaatttagtagattagtttttatatttaagatagaagctataggaattaatagtttaatttctatagctttttttattattaataggaagttagattttgatatagagttataatagatacagataattaatatatattaaattaatttgaatactattatataacgattgatataatgataaaaaatgtatattatataaagaaaaagataatatatttataataaataatagtttatatattataaatataattgcatttatacaagaaaggataagtatgtttggatatgttagaataaataagatggacttaacctttagggaatttgatgtctataaaggttattattgtggtttatgcaaatatctaaaacaaaaccatggagaaatttcaaggctatcattaaattatgatataacatttttaatacttcttttaacttctgtttataggccaaaatctactataactcaggaagtatgtatagcaaatccaataaaaaagaaggcaagaattgtaaatgaaataactgaatatgcagctagtatgaatgttcttttaacttattataagttagaagataatttacatgatgataaaggtataaaggatattttagcttacaatatatataaaggaaagttaaaaaaagcttatgaaaaatatcctgaaaaggctgattatataaaaaatcaattattagtattacaaaatttagaagaatgtaatagtactgatatagatgcagtttcaaatacttttggaaaccttatgggtgaaatttttgcttataaaaatgataagtatgaacatgatttgagaattatagggtttaatataggaaagtatatatatatattagatgcatatgaagatttagataaggatattaaaaaaggaagatacaatccttttattgaatatgctaacaaaaaagaagaactaagaaaaagagtagataaacttatatctataagcttaggacatttagcacagtctatagataatttacatataaagtttaatataaacataatagaaaatataatctactcaggagtttaccttagatataaaaatatattaaataaagggtgtgaagttaatgtacagtaatcctacttataatgaaaagtttaatttagctaaaaattttatagacaataaagaatttaataaagcctatgatttattatcttctatatctgataaaagtagtgctaagtggttttatttaatgggaattgcatcattgaacctaggatattatgagcaaggtgaagaatatttaaaaaaagctgtctctttaagtccagaaaataaagaatatgaagacgctttaataagctataatcgttactataatgattatgatagaagagctagacaatataataggagaagacatagtgatttaggtggttgctgttgctgttgttgcgatgattgttgttgctgtggagatgatttctgtgaagtttgtactcaattatggtgtttagacacagtttgtgaatgctttggaggagatttcataacttgttgttaagggtgattaaatatgagtaagaaaatagcatatacaggaatactattagctttaaatattattttattactattatcaaatatcatacctattaatactgtgttttttatgggattagcttcatttttgatatcaatagtaataatggaatatggatttaaattaggaatattattttatatagcatcatctgtattaagttttttagtacttcctaataaagctcaatggttaatatatatttttacatttggaatttacggattgattaagtatttagttgaaaaagacagacctttttatatagacatattacttaaattagtttatgctaatttaagtatattaagtttgtattttatgattaaaggtataatatatattcctataaatatatttactatattagtatttcaatttgcatttttgatatatgattatgtttatactttatttatagattactatgaacaaaggattagaaaaataataaaaccaagataataaaaaccactctttaatttcgataaaaagagtggttttttatatataatttccggggaaattacaaattatattaaattaaaatattctagttgaggtttttctagtgattttctacaaggtttgcaacaatatgtagaacctccatcttcaaacttaccattatctttattaaaacttacagaaacctcttttaaaactcctgatgtaggtatgtgtgatccacaatttacacaattttctatatttagtatatcctctaattttttaggagtaacatcttctatttccttattgcaactagcacaaataatagtatctagttccattggattagatctaactatttttctatcactaggagaataagagcaagttgaagatattaatactttatatccaaattcaaatacatttaagttacaatgaggacaattataagaagccccagaatagttagtaacagatttatatttattagcatcaactaaatttatttttttattagatttctctacctcttctgtatattcttcaccagttaagtaagataaaatgtcagaagctttttctgaatgagcaacatctattagatgtttttttacagaagaaaaagccttgtttttagaagtggaatctaagtcaaatttatttacttctacagcatattttattatagatataaaattatatttagctgcaaagtatagtgacatttcatcaaaatttttatcagaagatttttctaaaaaatctagccataaatcaggattatctaagtataaagttctacttagtgattctatatcagcatctagttttttcataaattcattgtctttaattaaatccattaaaacctccaaattaaaatatttatatgtctaaaatttctatagaagaaggcaattgataaattaaatcttttctttccactattattttagagatattatttatagattcatcagatcttatttgatgaagtaactctttagtcggatttatagctacaggatttccaacccttctaagcatatttatatctccatttgtatctccgtaggcatatgatttagataagtcaatattatatttatctacaaaattatcaatagctatatttttactagctgaatcccacataggaataacttctccattaaattttccatcttcaaatacataattacttccaataaagtcagtagctttatatttacttgccatttttgaaactagaaaatcagggcttccagatataaatattacaacatgaccttggtctaagtgccattttatttgagaacgggtatatttataaactctatctgactttaattttataacttgatcgctagtaaaatgaatagaacataaatctaaaccttttaaagattctacgtatatatcacatacttcaaataaataatcatcataattaccttgtcttttatcccagtttacaaaagtatctctagcattaactaaccatactttctcgtctattatttcatattttataagtttcttgaagtgttcaaccattaatgaatctctatatagagtaccatctatatcaaagaatgctgcaatttttttcatatatatcacctcaattaatacgttttttcttttatctattatattataaaatttgcatgtagttgtaaaaatataagaaataatttaaaattaatttttaaatgggtatattctaaaatatgctaattaaacttagtaaatatagttgataatagatttatatctaaatagtacatattttaaggaagggtgttcaataaaatggatttcatttttgctaaagtaaccaattcgagattgatgggtagtatgggtcttataataggctgggaagataacgaagatatactatatcaatattatttgatagatgcagaaggactagggatagctgattatgtaagtttaagaaatgcttcatatgaagagttaaatagagaacaggaaaggttaatgggtggattaggctcagatagaatacaacttacaaaaaaagaggctttaagtttagttaattattatggcaaaaagaactattactgggagaaagaattaccaggagatgttgatgaatacattgattttatagataattataaagctgaagtagatatatttgatttatatcctaaattatgcaagaaaatagatacagatatagaatttataaactacatgactatgagatttatagcatgggataaggatagtttaaaatatttttctaataatgaagatatagctaatatgcacataactaatataaatggagctttacttaaaaataaagttactagaaaagatgatgatatgtacatatgtgatgttttatatgaagataacgatggatattatacatgtaaattagcatttcatataacttatgaaaatgatgaatacaaaataaattcattaatgtttactgataaagaaggtatttttgattttgaagtatttgatgaaatatcaaaacctgaatatatagcaatttatgatttaaataataaagatgaatttgtagataagttttataaactgaatccatttgttcttagaagtgatttagatttaggagttttatttactagattcaattttgataataatcatgtaaaagaagaaacttacgtaattaataacgacttaagtgcattatactatcagatgaatgacaagttttttgtagctacatataacgaaaaagataggctatatataaataagttacttcaatgtaactttaagaattatgtaacattaaatgaagaattattttttgaacaaaatgtattatatgagttcgtagaatctgaatctgaagatttttatgactttttagattaaactaacaatattttacaaaaatagttagaaatattacagtttgggtataaagtaaatataagaactttggaggggatattatgaacttaacaaaaaaaatagaacaaagaaaaaaagctaaaagagtagctgaaagaaataaaaaaatgaaaatagctactgttggaatggttgcaggagtaacagcaggagctttaggaggaatactattagcacctaaagcaggaaaagaaacaatagcagatataaaagataaatcacaacaagtagcaaatacagttagtgaaaaatcacaattagctaaagtcagagttaatgaaaatgtaaatgaatcaaagagaagaataaaagagtatttacaaaataagaaaaataaagatttaaatttagaaaatactgaagaagaaatagataagttagaaacaagcgaagcagtagaggcgtaatatgtatatagatataaatgtattatattgtatagctgctttattaggatgtatagcattaatatacctaatatttactttgaaaaatttaaatgattttataaaaaatttaaaagacttgttatcttctaattctgaaaatgtatcaactactataaccaaattaccagaagtagcagaaaattttagtgaaataagtgataatttaaaagatgtaacaggagttattacggatacaactgctgactttatcgtagcaaaagaacgtgttaaatctaatgtggaaatagcagcagatatagtaagtattataaaaagtgttattacaaataagtaaaaaagcccttagcaatatgctagggctttttccatgtatttataatattgggggaatattatgaggaatacatttatattatgaccccaagttaaatactttatacattaaataaaaaataattttaaaaattaattacatttcttcttcatcaaattcttctatatttatattgggcataccaggcataccacccatcataggcataccaggcatgccgcccatcataggcataccaggcatttgtttcataggatctggataaccattattcatagaatcttgcatcattgtagggtctattcccatattgttcataggatttatgttattcatagggttcatattaggtacacaacccatcatttgcattatctgaaccatttgcatatacatttgcattaacatactagggtctataccacccatcataggattcatcatataagggttcatatacatcataggattgtattgagaagtatttgtatactgctcagtttgactttcattgttattttgatttttattattctgataaggcatggaattcatcatataagggttcatatatatcataggattaacataaggcataggatatatatacttattatccatgtcagaaaacatagggttcatgtaattatcaaaactcataaacttgacctcctggattaaaaacttttcgaatcttatttcaaaaacactttattatatatatataagaaagaaggctgtattatgtgcatttaaaattaaatttatataattagttgcaaaattatggacatatacatataatatattatatatgaacaattgttcatatataatgatttacataaactcaaggaggagttaattgatatgtgtgatataggtgagataagagattgtatatgtgaagaagttcatgaagaacttgtatgtaaagctaaagaaaagatgccagaagatgaaactttatacgatttagctgaactatttaaggtgtttggagatacaacgaggataaaaattttatatgcattgttctcgagtgagatgtgtgtatgcgatatagctgatttattaggaatgacccactctgctatatcacatcaattaagagttttaaagcaagcaaggttagttaaatttagaagagaaggaaaaactgtatattattcattagatgataatcatataagtcaaatctttaattgtggattatctcatatacaggaaatttataataaataaattgacatagatgggaggatatattatgagtacagatgttctcattaaaagagagataacattagaagggttaaattgtgcacattgtgcagaagttataaatgaaaaagtaaacaagttagaagaaatagaaagtgctaatctgaactttataaacaaggtattgactttaaatataatatcaagttttaatcaagacgaagttataaataaagtaataaaaataatagatgatacagaaccagggttaaatataaaagtaaaagagcctaaaatgaagtctaaaaagaaagaattagtattaaatggattaaattgtgcacattgtgcagaggttatctgtgaaaaagtgaataagttaagtgaaattgaaaatgctaacttaaactttatcaacaaggtgttaacagttaatttagtttctggagcaaactctaaagatacaatagataaagtaataaaaataatagatgatacagaaccaggacttgatattgaatttagagaaaataaatcttctaatgataaaaaagaaatcaagactgaggataatgataaaaaagagttaattaaacttataataggaactctagtttatctatttggaatatatgaaacatttactggtattaagtcaagtatgaatacaattgtatttatagttgcgtatatagtggtaggtggggatgtactattaaaggcgattaaaaatataggtaaaggtcaaatttttgatgaaaacttcttaatgtctattgctacaataggagcattatcaataggagaatctgcagaagctgtaggggttatgctattttacaaaataggtgagttcttacaaggtaaagcagtaggtaaatctagacagtctatatctgaacttatggagataagacctgattatgctaatttaaagttaggatctgaaatcaaagaagtttcaccatatgatgtggaagttggagatataataattgtaaagccaggagaaaaagtacctttagatggtactgtaatagatggatctagcatggtagatacatctgcattaacaggagaatcactacttagagaagtggtagcaggagaagacgttttatctggatttataaataaaaatgcagttttaactataaaagtacaaaaagaatttgaagaatctacagcatctaagatacttgatttagttgaaaatgcaagtagcaaaaaatccaaaactgagaattttataactagattctcaaaatactatactccaatagttgtagtggcagcattattaatagcgttagttccgcctatttttataccaggcgaaaatttcagtaattggttttatagaggattagtattcttagtagtttcttgtccttgcgcattagttttatctattccattaagtttctttagtggaataggtcatgcatcaagacaaggtatacttataaaaggaagtagctacttagaagctttaagaagtgttgacacagtagtatttgataaaactggaactcttacaaaaggtgtgtttgacgtaacttgtgtaaaacctgtaggtataagtgaggatgaattattaagatatgcatcaattgcagaaataaactcaaatcaccctatagctaaatctattgtaaaacattataaaggtaatgttgatttagataagataaaaaattatgaagaaatagcagctcatggaataagagtagattatgagggagaacatatattagctggaaatgaaaaactaatgatgactcaaaatatattcttctctaaggctaatgaagttggaacagtggtatatatagctgttaataagaaatatagagggtatatagtaatatctgataaaataaaagaagattctaaggcttgtatagaaggacttaaaaatataggtataaagcaaacagttatgttaactggagataaccaagcagtagctaatgatatagcaggaaaattaaatttagataaagtttatgctaatttacttcctactgataaggtaaataaattagaacaattatatgagggtaaaagtgataaagagaaaatcgcttttgttggagatggtataaatgatgctccagttcttgcaagagcagatgtagggattgctatgggaggattaggttcagatgctgctattgaagctgcggatgttgtacttatgacagatgaaccaagcaacattgttaaagctatagaaatagctaaaaagactaataaaattgtatggcaaaatattgtttttgcattaggtattaaagtaatagttctagtgttaggagctgggggtattgctaatatgtgggaagcaatatttgcagatgtaggagttgcattaattgcagtattaaatgcaatgagagttatgaaatagtaatataacttaatattgttagatgcaaataagtttggaagttaagagataaatttaaggactgattctagaatgaatcagtccttgttttatattacgtatttaaaaacacagtaaaaatgtgttaggcttcctaacataacaaatatatggaatatatcatgaaatcctaaatatttaaaatttaaaaattttggtttaagtccataaattatcccgcctattgtgtaaaatataccacctaatgctaaatagaaaacaccttgaggagatatagccttagataaaggtcctattataaaaatagatatccatcccattcctatatatatagaagttgaaagccatctaggacaattaaaccaaagcattttaaataataccccagcaatagctattcctgatactacacaaaaaagtgcaatgccactagtttcttctaatgctattaagcaaaatggcgtatatgatcctgcaattaaaataaaaatcattgaatgatcaagttttcttaaaaatttaattactttatcagatgatactactaaatgataggtagcagaagctgagtataagagaatcatacttatcccaaaaattataactgcggttaaactcataatagtagggtcattcattgttgtttttataactaaagctaataaaccaacaaaggaaagtatagctcctgctaaatgagtaaatccacttacaggctctctaaggtaagcacccaatttaattcctccttttattcacatcataaatttttctatttgaaattatgtccgatatatatgtgtctaaaatattttatcatatttatagtgaatttatgttaaatgtgtaaattatttattaaaaaataatattatttaaaattttttttaagtgagctataatgtagatatataaacaagtatacagctttaaatattacttaatttataactttaaaaataaaaaataaaaaaacttttaaaaaggtattgacgatatcgatttaagatgataaagtattacttgtccttaagaaaagggcaaagacaaaatgaactttgaaaattaaacagtaggttaattataaaaattctttttaaagaattaatatttaaaatattttaaatattatatttgggtattaattatacaaccattaaaatcgaggtgaatatatggatgttataaatattatagaaaaattatataaaacaaatgatgcaagtaaggaagaattattgtatttattagacaatatagatgaaaattcaaaagaattattaattaaaagagctaatgaaaccagaaaaaaatattataaaaataaagtttatatgagaggtcttatagagcttacaagtttttgtaaaaaggattgtttgtactgtggacttagacgacacaataaaaatgcagatagatacagattaacactagatgaaatactagagtgtgttagaaaaggtgataagctaggatataaaacttttgtattacaaggtggtgaagatgaatactttacagatgataagatggtagagataattaaagccatcaaaagtgagtttccagataatgcaataactctttcactaggagaaagaagttatgattcttataaaaaaatgtatgatgcaggagcagatagatatttactaagacatgaaagtgctagtaaagaactttatgaaagtatacacccaggtgagccttttgaaaaaagaagaaactgcttaaagaatttaaaagacataggatatcaatcaggtgctggatttatggtaggtataccaggacaaactaatgaagatttagttaatgatttaaggttcgttaaagaatttgaacctgcaatgtgtggaataggtccttttatacctcataaagatacacctcttagaaattatgaacacggtagcttagaaaaaacagttatatgtttggctattgttagattattacttccaaaagtattactgccagctacaactgcactttcaagtatagacccaaaaggaagagaagaagggttaaaagctggaggaaatgtcataatgccgaatttatcgccaatgtcagttagaaaaaaatattctctatatgataataaagcatatatattagatgaagatgcagagtatagaactatgatagaacaaaagataaatgaagcaggatatgaagtagaagtaagtagaggagataatcctgagtttagaaaataataaaggagattaagttatgtttataaatcatgaagaaatatataatattttagaagaaacaaaaaatccttcaaatgaagaaataaaagaagttttaaatagagcaaagaaaaaagaaggattatcatataaagatatagctatattattacaagcagaagatgaaaaagatttagaagaaatatattctttagcaggtgaaataaaaagagatatatatggaaaaagaatagttgtatttgcaccactttatgtaagtgattactgtgtaaacaactgtgtttactgcggatatagaagagataataacttctgtagaagaagattaacaatggaagaagtagcagaagaagttagaatactagagcaaatgggacataagagattagcacttgaacttggagaagacccaagcaatgctcctatagattatgttttagaatgtttagatactatatataaaactcaaaatgctaatggagaaataagaagagttaatgtaaatatagctgcaacaacagttgaaaattataaaaaattacatgaaaaaggaataggaacttatatattattccaagaaacttatcataaaccaacttatgaaaaaatgcatccaaaatcactaaaaggagattatgaatatcatttaactgcttttgatagagctatggaagctggaattgatgacgttggagcgggagttttatttggattagccgatcctagatttgaagttttaggtcttatgatgcataatgctcatttagaagaaaaatatggagtgggattccatacaatatcagttccaagacttcaacctgcaacaggcgtaactttagaaaactatccacatttattagatgataaaatgtttaaaaagatagtagcaattttaagaattgctgtaccatttacagggcttatcttatcaactagagaaacaccagctatgagaaaagaattattaaaatatggagtaagtcaaatatcagcaggatcatcaactggtgttggaggatataaagaaagagaagcaggaaatgaaagtaaacaatttaaaactagtgatgaaagaagtcctatagagattttaaaagagttattagatgatggatatataccaagttactgtacagcttgttatagaaaaggaagaactggagatagatttatgcaacttgctaaatctggtaatataaaatatgtttgtgagccaaatgcgcttatgacattacatgaatttactctagattatggagataaagaattatacaacaaagctcaagaagtaataaaaaatgaaacagaaaaaattcaaagagaagatttaaaaacatacactaaagaaagtatggaaaaaatgaaaaaaggagaaagagatttctacttataggaggtatatatgaacactactccaaatgcaaatagaaaacaaattggtatatacggaaatacaaatagtggtaaatcttcattgatgaatgctatattgggtcaagaaatatcgttagtatcaagtattgaaggtacaactacagatccagttcaaaaggctatggaattaataccatttggtcctatattattaatagatacagcaggtcttgaagataatagtgaacttggagaagttagagttaaaaaaagttatgaatatttaaaaagaatagattttgctatatatgtagttgatggtaataatatagatattaatacatataaagcttggaaaaaagaatcaaataagtataatgttaatcatgtagtagttgttaataaattagatatattaaatgaagaagaagttaataatataaaaaaattatttgaaagtccgatatttatatcagttaaagaaaataaaggtatagatgatttaaaaaaagaactcataaaatacttagaacaagaggaagaagataaacctatagttggagatttattaccttatggttctaaagtgattttagtagttccgatagactcagaagctccaaaggggagaattatactaccacaagttcaagttataagagattgtttagatcatggcataaaaacttatgtagtaagagatacagaacttgaagacgcacttaatgatataaaaaatatagacttagtgataacagattcacaagcttttaaagaagtagaatctattattcctaaagatatgaatttaactagcttttcaatattatttgcaagacaaaagggtgaacttaatgatttcttagaaggaactaagaaattaaacactctaaagccaggagataaaatacttatatgtgaaagctgtactcataatgtatctcatgaagatataggtagagtgaaaatccctaatatgctaaggaaaatagcaggtggagaacttaatattgaatatagtatttcttatgattttaaggaaaacatagaagattatgaccttattattcactgtggagcatgtatggtaaatagaaaaagtgtattaaataaaataaatatatgcaaggaaaaaaatatacctataactaattatggaatggttatagcatactttacaggtatattagatagagctacttgtatattcaaataacaaaaaaaggtgtataaatttatacacctttttttgttataacttccacattatcattaacataatctttaacaaatccataaggtacagttttattaaaagctggataagaagatataaaccttacaaatataggagtagcaaataatatttttctattatttaaaaatgctctatcgccattgactactgcgctaatagatagtggtaataactctaaatacttttcatatctatattttgctacatcataagggtagttgcctataaaaacaaaaaatgtaagttgatatatatctccaaaaaaccaataccattgggcataaactaaatctgtacttgtagtaaataaatcaagattataaaagtaaggtgaaatagataaatctactattgtaggatcttctaagtgagttatagtatatcttctaaaccttacaggctcagtagctgtgtaaggtttttctatacttacattaactttcgataaacttaaattagccaataaaatcacatcctaaatataatgtctagtttattatatttttttattaagaatttgtgatatgtatatagttaaaacgatatacatacatagccatagttgaataatatactagtaatatctacagttttaaaattttataaggggtgagtattatagaatatgagaactttaatttaaatagagatatacaaacagacaaaagcatatcaaattctatattcgtaacacatactgaagcttttgctcaagaggtagaaaacttaacaatagattatgaaatgataagattaagtacaactagaactcttatgttatttacagctttaactaaagcaaatgtaggggcaattttacaattagattctgtcctaattattgaaaatgttgtaagagttgcatctttatcaactataacaagaggaaccgaaaatggaataacggcacaagaagaaataggagttaatttttttaaaaataatcctaatgtacaattaacaggtcaaggtacagtaatagctgtaatagatacaggaatagattatttgcatgaagattttatatatccagatggaactagtaaaatactttatttatgggatcaatcaaaagaaggaaatccaccagaaggattttttataggtacagaatatacaagggaagatataaataaagctatacaagaaaaagacagtaccttatctatagatgaagaaggacaggggactatgattagcggaatatgtgcaggattaggaaatataaatagagaatatgaaggtatagcaccaggagctgaacttatagttgttaaacttgggaaaataaatggatattataatagtgcaatgttatttaccgcactccaatatgtatataaaaaatcagatgaactaaatttaccaacagttgtacatgtgtcaatgggaagtactggtttagctggatatgcaagtagagtaaatagtagggatacatatttttcaaatggaatatgtatagtaactggtgcaggaaatgaagggaatacacaaacacatgtatctgggattttaacaagacaaggagagacaaccgacataggaatacaaattgaagaagaagaaaaaagtttaatgatagaagtatggcttagtagaccagacagagtaaatttacttataatatctccaagtggagaagaaagtaaaatagtagatttatcaaactatgacttagtaagtggaatatttgatttagaagcaacgggttattccataagatattcatatccaacaagttattcaggtcaagaacatacaacaatttatcttacaaatgcaaaaagagggatatggagattaagattagaaggtgcttatataactggaggacagtataatgtatatttagagaatcgcgtatttttaaatgagggtacaaaatttaatgaatctaatccaaattttacaataacatatccttctgtacaagatgatgttataactataggaacatataactctataactagaagtctttggccatcttcatcaagaggacctaatatggaaaataggcaaaaaccggatgttgtagcaccaggagtaaatataataggtccatatcttaataatagttatgcaacgataactggaagttcagcagcggcagcacatgcatcaggagctatagcattgttttttgaatatattattggtcaaaatagatatccaaataaagggtttatgcaaatgataagaacatttatgcaaggcggagcagttagtattggagatgcaatatatccaaacaacattactggctacgggttactaaattttaagagaatgtttgatcaattaaaataggaggcaaagatgtggataaaacagaaaaatctttttacttaatttataaaggagatataataagttcatttagtagaaataatatagaaaaatatattattttaaatgataagcttgcagctatatacgtacctcttgattttgatgaaactgtactaagtaatataagagaaattaaatggtggagtgggtcagatcctatgagttctcttatgcagataactaataatgtagaaaatggagaaagcatttcagatgcagcaggaactagttatatagaaacaaatccatatattaatatttctggaaaagatatattaatagctgttatagattccggagtagattacttacatagagatttaatagatgaaaataatacaagcaaaatactgtatctatgggatcaagaaaatgataccaaaagacctccagaagggatgatatttggaagtgaatttacaagagaagatataaataacgctataagagaaaatgacaatacattaagtgtagataatactggaacgggtactatggcttgtggaattttagtaggaagaggaaatgtaaatcctgaatatagaggaattgcaaaagatgcagatttggtagttgtaaaattaagaggatatgaaggggtttattatccaggaaaaataagttatacagtatctgattttttagcagctattaaatatgttcttgacatagcaaaaaaagagaaaaaacatatgataataaatttaacagtaggtacaaaatcaggtattagagtagaagcatctatattagaaatatttgaagaactagacagatcaggcattatattagtaagcggcgctggaaatgaaggaaacacagacatacattattataataaccttaagaatgttcaagattatatagatgtagtaattcaaaatggagaaaatactaacttagatattgtgttaagaggtacagggccagataaaatatcactacaaataatatctccgtctggagatgtaagtcaaactatagtatattctccagatgatcaaatatatacgggaagattctttatagaaaaaactggatatagagtagtatacagatttccatggttagaaacaggtgcacaagcattagaaataactttaacagatataaaaccaggtgtttggaatattaggctaaagcctgaatttataataagcggagaatatcacttatatcttcctaataaaaatataatatccgcaaataccagatttacagattcaacttctatgggaaccataacagaatttgctttatctaggaaagttataacaattggagcatataatgataaaactaacagtttatggataggatcatcaaaaggaagtatacgtggaaatcgtataaatcctgatataatagctcctggagttgatattatatcaacttatgcaaatggagattacaatactgctacaggtacaggagtaagtagttctattgtatgtggagtacttgcacttattatgcaatatttagaagaggaaagtggtgtaccaaaactatcattatttacagaccccttaagaacatatttaatgcttggggcaattaaaagtgaaatttatgattttcctaatgtatctcaaggatatggagtattaaatttaagaaatacatttatacaaatatctagaaatttatagatatttaaaaactattaataaaatattagattaatttcatatttataaaaatattaaataatagtgaaaaaagtgtggaaaatgttatcctagcgtgttatactttgatagtcataataaatttttaaaagggagaggcaaaatggtaaaggcaattttaggattattagcagtaataacagcaggtttttcaacagtttatgtaaaggattttagaaaaaaccaagacaaaaacaaacaaggtatacttaaaacaggtatatttataggatttataacagattttttagatgctataggggtaggatcttttgcaacaactacaggaattttaaaattaaataaaaatatacatgtcccagataaagtattaccaggaacattaaatgttgcacatacattaccaatgattgttcaagcatttatgtcattaaattcaatagaagttgatttattaactttaataagcatgataatagctgctgtggttggctcttgggtaggagctggcataatatctaaactaccagaaaagaaagttcagctaactatgggaattgctttagtaggtacagctatattaatagtattaggacaattcgaattgatgccatcaggtggagatgctatgggacttagtggagttaaattagcaataggaatagctggaaacttcgtattaggagcacttatgacagctggtataggtttatatgctccatgtatggctatggttgcattattaggaatgaatccaaaggcagcatttcctataatgatgggagcttgtgcatttgttggaccaatagctagtattaaatttgtaaaagaacaagcttatgaaagagaaatatctatgggaataactataggtggtgtagtaggatctattttagcacttttatttgttactaatatgccagtatattggttaaaatggctagtagtagctgttgtaagttatacagcagtaactatgtttaaggcgggattaagtaaggacgatgctatggaacttaatcaagttagttagtatataatattaaataaagctataaagcttaaatttttttagttttatagcttttttattattataaacaagaataatgggtaaaagttatatataataaaaatatgagtaaaataattgcaacaaacgaaaaagtgaggtaatatcatgaaaaaacaagataaagaatataaaaaaattgaaacaaattcatatgaaaaattatttataccaaaaaatacaccatatgaagaattatttgaaggaggagctatagaagaattaacagatgaaacaccatactcttttatacatccaaaccattatgaagtagaagaacttttagaaaaaagtaaaagtgataaataatacaaatagtaacaaaaacaacaccagattaatataatatatttgaaagacttatatttgtacattaaggagaatgaacatgaaaataagctataaaacttcagggtgttgttgtaaacaaattaatttagaaatagatgaaaataatataataaaagatgttgaatttgttggaggatgtgcgggaaatttaattggaataagatcattagttataggtaaaaaagctgatgaagtagctaaaaagttaaaaggaataccttgtggaacaaaatctacttcttgtcctgatcaattatctaaggcaataagatcaaatatataaataaattttaaaaaggcagacttgtaagagtctgtcttttattgtcgaaaatatagactattttaaataataatgatatagtttgtaataataattgataggggagataaatatggtaggagtaaatcaaaaacttaagattaatgataaaaataaactggcaactgtactaactataagtatgtcagcatgtctagtcttattatatatgtttgttttgatatttttatttaaatttgatttaaacaacagtataaaaccagaatattttataagattttttaatatattactttcttttttagcaattacaagttgcttactttgctatagtagtagtaagaaagaagaactttttataatatcgttaatgtacattatattttttgtagatattgttttagggatatttgataatttaacattagaaaatactattatgagtatgaaagggtatattgcaatatctacatctataatgagaatagttataattttaataacagcttttccattaaaaaaaactagaaagcttataatggataataaacttttagttataaatttagttttcgtaggtgcaatatgttttggatatttagaccgtgaaagcattatatttcctatgaataaagatactaatttctttataggatataatcttttattagttattatatacacaataacaagttttatatttttaagaaaaggcattaaagaaaatgattatacatattcagtaataggtgctagtatattaatgctttggattaaagctatatatgccattacaggagctaataaacctataatagatataaaacttgtatctacatctataacatatatggcattcataacaattatagtaggtttatttttagagcttataataagtgtaaagaaaaaaagagaattaaaagaggaaataaaaatattttataatttagtagaagaaaataagcaaagttgtatatatatatttgatttggaaggaaatataatttattctaataaaaaaattaaatcatatttttttaaagatgaagagtatgataaagaaaaattaacaaataaaataaaatatagcatttcaactataaacgaagaagttttaaaaaatatcaagttaagcatgaaaaatgaaggttgttggaatggtaagatagaattgaattcaggaaaaaatataattgattgtagtgcacaaactgtactagataatagctcacaaattataggtgattcaaatcaacaagatatagaaggtaaatcagtaaaatttgtagtaacatttactgatgtaactgaagagcatagaatggaaaaatatattatggaatatgaaaaaatgaaaaatcatgagaaagtaaaaaatgaattttttgcaaatataagtcatgaattaagaactcctttaaatatattttattcaattgtgcaattattagatttaaaaatatgtaatgatgaagaagattttagaaagtattatggtaaatatagacaaagtctaaaggtaaattgtcaaagaatgttaagacttataaacaatatagtagatataactaaaatagatgtgggttgtacaaaacctaatatagtaaattgtgatattgtaagattaatagaggaaataacaatgtctgttataagttatgcaaagcaaaaagatataaatatattatttgatacagacatagaagagcttataattaaatgtgatcctgagatgatagaaagggtaatgttaaatttattatctaactctataaaatttacaaaaccaaatggtcatgtatttgtagatatacatgtgaataaagagtgggtacaaataatagttgaagataatggtataggtataccactacatatgcaagatttagtatttgaacgatttgtacaagcagataagtctttaaatagaatgaatgaaggaagtggaattggacttagcatagttaagtctataatagagttaaatgggggagaaatatatctagaaagtgatggtaaaaacgggactgaatttgaaattttgttaccaaataagaaattattaggggatacagtagaagatgaaagtaaagattataaagttgatgttcaaaaaattgaattagaattttcagatatatatgaattatattaatatactaaggttaaattttaaaataaatttgaaattaatatcttattatattacaatgaattagattaattgggatttgggttgaaaggaaagtgtatgggcaaatttagtttattaaaaagatttaatgtgtttattgtgattaatattattgtttttttgtattcaagagttaatatatatgcagattttgagcatataaattttaacaatgcaaatatagaacaaggtataagtcaatcgactatagatgtaatatttcaagatagtaagggttatgtatggctagggactaatgatggattaaataaattcaatggatatgattttaaagtttataattatgaagaagagaaaaatagtataagtaatagccatataacagacatagctgaagataactatggaaatatatggataaccacgtctaagggagttaataaactaaatcccgacactgatgaaattataaattatacagaagaaaataatttaatatctagtgataatgctacagaagtaatacttagtaaagataataaaataatagttgcaacatctaatggattaaacgtttataatgaaaaagaaaataaattcaaacaagtactaggtcaagaaaaagatttaatatgtaagtttatgtattcaatagacgaagacaatttagggaatatatggattggaactaaaaaaggagttattaaagtatctaaagactttaaaatacttaacagttatcctgcaaatggcaaaaagaattctgtaggagaaggcgatgtatataacatatattgtgatgatgaagatggatatgtatgggttggaaatgctaattcaggtttatcaaagataaatatgaaaactaatgaaataaccaagtataaacacagttcatctgattcaaagtctttacctagttctagtataggggcaataacaaaagatagcaaaggtaatatatggattggaacttctaatggtcttgcaaaatacaataaaaaagaagataatttttatacatatcaacataaagtatatgataaaaatagtttaattaataataatataaaaagtttaatggaagatagtgaagggattatatgggtaggaacatactcaggtataagtatgtttgatacagaaagtaaaattaaacattataaggctggtttagataaggattatttattaaatgaaaatatagttcatggtatatatgaagatgatgatggatatttgtgggtaggaactaattcaaaaggtgtaaatataatagataaaaaacataataaatctaaatttataaattcaactacaaatgaagagtttataagtgattctataaatgatataactggaaaaggtaatataatttatatagcaactgatgatgggcttataaaacttgacaaatctaacaatgttttaaaacattataatgtagaagatggattattagatgaaaaagtaacagatatattagtagatagtaaaggctatatatggttaggtactcccgatggagtaaatatattaaatccaaaaactgaagaatttatagatataaatgaatttataaataatggtcaagctccaaacaggtacgtcaggcatatatatgaagatagcgaaggaaattattacttaggctttttagaacaacaaggattaagtgttattaatacaaaagataaaactattaaaaattataaatatagcaaaagcgataaaaatagtataagtaataaccatgtaagatatataaatgaagatagtaaaggaaacatttgggtaggtacaagttatggactaaacaaatttgataaaaaaactaaaaagttcaaaaggtatacaacaaaagatggaatagcaaataacactatatatggtatattagtagacaataaagataatatttggataagtactaataaaggaatatctaaaatagatacaactaataataaggtacaaaatttaggtgtaatagatgggcttcaatcaaatgagtttaatggtaatgctgcttataaaaataataaaggagagtttttctttggaggagtaaacggactaaattcattttatccagataaaataataaaatcaggagaaaagcctaacttaatatttgatagatttattataaataacaaagagtattgtaatatagataaaatgaaattcaatgaaaatactgatattataactatcaaattctttacatcaaactattcaagttttcaaaatacaacatatgaatatagtctagaaggaacaagcaaaaatgttgtaagaactaaggataatcatgttacatataatgatttaccgccaggaaaatatacatttaaagttaaagctatagattcaagtggaaatataagtgatgaaaaacaagttgagtttactataaaacctccattttggttaagtggatatgcttgtgttatatatatattagcaataattatatttataataaatcataaaaataaagttaaaagattagatagattagtacaaaagaaaactttaaggctaagagaagaaatggaaagaaacacaattttattaaataaaaatataaaactagagagaaataaaaatagttattttgtgaatttatctcatgaattaagaacaccattaaatgttataagtagtactaatcaattaataaatggattgataagaaaagatggagatataaaaaaacaaaacttgggtcactatatagatgtatcacagcgaaattgtaaaagattgttaaatcttataaacaatatagtagatagtactaagttgcaaaatgatatgtatgttatttctttaaaagaaaccgatatagtatatttagttgaagaaactgctttaactttaatagattatgtaaagacaaaaggaatacatttaataatagatccagaaatagaagaaaaaacaataatgtgtgatagtcatgaaatagaaaggtgtattgttaatttagttggaaatgcggctaaatttacaccagaaggtggaaatataactataacgattaaagatttagaagataaagtcatgattagtgttttagatactggaattggaatcgatgaaaaatatcataaagttatatttgatagatttagtcaagtcgtggatttaaacaatgaagttaaaggtggtagtggattaggccttactataactaatcatataattaaacttcataaaggtgaaatctatgtagaaagtaaagttggagaaggtagtaattttgtaataatacttcctgtaaatcctaatatagaagatgaaaataaatatgtggaatctaatgtagagcaaatttaattaaaagcggatactaattaaagtattcgctttttaaataaattaataataaaattataaaaaagtatttacaaaaaacactaatatatgatatattatatacataagttaatgaaatacggagaggtgtccgagtggtttaaggagctggtcttgaaaaccagtgactccgaaaggggccgtgggttcgaatcccaccctctccgccagttagtaaagtacctattatttaggtacttttttcatttgtaacaaatcatttaagaatttatacttaaatttaaataaaataaaagaacatgtaaaaaataaagaagttagataaagcatataagacctgtatatatacaggtcttatatgctttataatataaagggaggtgataagtttgaaaataagtactttaaaaacaattattgaacacaatacagaaaaaaatagacataatgctggagttatgctatataaaaataatttagtaagtcatagttatataaaaaaagaaaatggcaatataaacttttatgctacagtagctaatgaatattataatgaattaaatactacgttagttgtagtaaatgataaaacacatagacttgtaaatacaagttgtgattgtaatgattggttaagtaaaagtagtgaaaataatacatttatatgtaaacatatggtagctacagtttttaaatgcatagatgatttaaaaatgaaaaaactacaaaaaaatacacaagtatctaaatttaataataatgaaataaattatgtaaatgtaaaaattagtgcaagtatatctaatgataaaaataataatttaaacttttcttttaaaataggtgattttaataaatctagatgtattgatatataaagaggtgtaaccattcaatggaagaatggggagcaagtaggatttaaaaagaaatagcagtaaaaataggcgagataattcaagatgaatttgtatcaatagatgatatacttaaagatttggtaactgaggaagataaagaaaaggctgtagagtatataaaagaaaaagttagaactataattgatgaaaaggcagctttaattcctagctatataaaatcaattataaaaggctatatagatgaaattatagagaaagaagtaaatgattctataaatgagttaggtgaagatatagttcaaaacgctcatcaaagagttaacatacaagaaattgttgaaaataaagtgaatgatttagatttaattgaattagaaaatataattttgagtgttgcagacaatgaattaaaacatatagaattattaggattgatactaggatttttaataggtatagttcaaggaataataactatatttatataataattttagttgccataatgaattgaatttgttataatgtaaataattataaataatatagcgatgaaaaggaagagtaaaatagaaacaatttacagagaggatatatcagaggctgtgagtatatctaaatatgactatttgaaaactaccttggagctgagtttagtagcttaataagtgaaagtgctcggatgactaccttatagtcaacaagagggtaatgtacatcacataccaacttgggtggaaccgcgaattatactcgtcccatgattttcatgggccgagtttttttattttatacaaaaattttaaggaggtaaagacatgataaaagttactttaaaagacggatctgtaaaggagtacgctaaaggtacaactgttatggatatagcaaagtctataagcgaaggtttagctagaagtatagtagctgcatctgttaatggagaagttgtggggttaaactttgaagttaatgaagattgtgagttaaatttatttaaatttgatgatgcagaaggtaaagatgtatttagacatacatcagctcacatgttagctcaagctataaagagattatacccagaagctaaattagctatagggccaagtatagaaaatggattctattatgatatagatttagagtatagattaactcctgaagatttagaaaaaatagaagctgaaatgaaaaagatagctaaagaagatttagctatagagagatttgaattaagtagagaagaagcaataaaattaatggaagagcaaggggaaaactataaagtagaacttatatctgaattaccagaaggagaagtaatatctttctacaagcaaggtgatttcacagatttatgtagaggaccacacttaccaactactaaaaaagttaaagctattaaattacaaaatgtaactggagcttattggcgtggagacgaaaagaacaagatgttacaaagaatatatggaacatcttttgaaaaaaataaagatttagaaacttacttacacttattagaagaagctaagaagagagatcatagaaaattaggtagagaattagaattattctttataccagaagaaggaccaggattcccattattcctaccaaagggtatggaacttaaaaatgaattattaaaattctggagagagttacacagaaaagacggatatgtagaaatagaaactccaataatattaaatcaaaaattatgggagacttcaggtcactggtatcactataaagaaaatatgtatactgtagatatagatgagcaacaatttgctataaaaccaatgaactgtccaggtggtatgttatactacaacttcaaacaacattcttataaggatttccctatgagagttgctgaattaggtagagttcatagacatgaattatcaggagctttaaatggacttaagagagttagagcatttactcaagatgatgcacatatattcatgttaccaaatcaaataaaagatgaaataaaaggtgttgtttcattaatagataaagtgtattctgcatttggatttgagtatcacctagaattatcaactagaccagaagattcaatgggaactgatgaagaatgggaagctgctgaaaacggattaagagaagcattagaagagttaaatctaccttatgtaataaacgaaggagatggagcattctatggacctaagatagacttccacttaaaagattgcttaggaagaacttggcaatgtggaactatacaattagacatgcaattacctcaaagatttgatatcagttatataggtgaagatggagagaaacatagacctgttatgatacacagagttgcattaggaagtatagaaagatttataggtatattaatagagcattatgctggtaaattcccaacttggatatctccagttcaagctaagatattacttgtatctgatagattcaaagattatgctgaagaagttagaaatgcattatttgataaaggtataagagtagagcttgatgatagagcagaaaaaataggatataagataagagaagctcaacttcaaaaggttccttatatgttaatagttggtgaaaaagagcttaatgaaaagaaagtatctgtaagatctagagacaacggagaaatgggagctatggatgttgaagaatttatagctaatgtattaaaagaagtagaagaaagaactaatgtaattcaagcatagttaatttaaaaaagttagccctagggctaactttttttatacacattcttttcttattatatctttaagttcttcgtgagtcatagtttccttatcaaataaatgttgtgaaactaaatgaagatcatttaaactagaatttaaaagattcaatgtttcttcgtaacaactatttattatattagttgtttcttcttgtattttctttgataagaaattcttttgattcgagtctatagtcatagcgccaagactactcataccatattcacataccatttgagttgcgatatctgttactttttttaggtcgtctttagcaccagtagatttatgtccaaatataatttcttctgcagctttaccagcaagtaagatttttatttttcctaaaagttcatctttagtataaatatatctatcctcatctggcagttgaagaacatatccaagagcttgacctctaggtattatagaaatcttttgtattggatttattccaagagcattactaacaagagcgtgccctgcttcgtgataagaaactatacgtttttccttttctataagtttagcatttttagattcaagtccagctataactctttctattgctttatcaaaatgaaggctatttatagtttcactgctgtctctaactgcaaagattgcagcttcatttgctatgtttgctaaatgcgctccattaaatccgtgagttttttttgctaatatatctaagtctacagaggcatcaataggcttatttttagtatgaacttttaaaatttctaatctagtatgatagttaggatctcctatatgaacgtgtctatcaaatctaccaggtctaagtaatgcatcgtctaataaatctagtctatttgttgaaccgactataagtatattagaatctttattaaacccatccatttcaactaataattgatttaaggtttggtctttttcattattactttctaagtgtctttttgcacctatagcatcgatttcatctataaatattatactaggggcatcttttcgagctttttcaaataatgttctaaccctttttgcacccacaccaacgtatttttccacaaactcagagccagttacgttaaagaaagatgcatttgtttctccagccatagctgaagcaagtaatgttttacctgttcctggaggtccataaaataatacacctttaggaattttagcacccatttttttatacttatcaggacttttcataaaatctactatctcaaaaagttcttccttgacttcttctagtccagctacatcattaaatgtagttttgggcttagatgaatcggagttgtcattaggagtttctttttcaagtttagtctgattaaacgcaggagctggtttattaatttttttaaaaaaattatctaacattttcatagtcaaacacctcagttataaaaaattgttgttactacatatatttgccgttttttgaattaatattattaaaattttacatttagaaatttaaatattgattttattaaaagtataaccataaagggaagaattaattaacaaaaaatcaaaaaagtaattgacataaattttaaataatgatatattagttaagtaatgaaaaacaagaagaagtccgcttctcaccttacgacaaaataagttagtaaggtaaatataagttacgattttagattaggtttattaattgagataacttatatggcggatgataatatcattcgccttttttaatataaaattggaggtgtcctactattagtaaggaattagcaatcaatgatgaaataagagataaagaaataagagttctctcagaaacaggtgagcaacttggaataatgtcttctagagatgctcaaataattgcaaataataagaatttagatttagttaaaatatcacctaacgctaatccacctgtatgtaagataatggattacggtaaatataagtatgaacaagctagaaaagaaaaagaatctaagaaaaagcaaaaggtcgtaactgttaaagaagttagattaagaccaggtatagaaacaaatgacttaaacacaaaagctaatcaagctatgaaattccttaaaaaaggagataaagttaaagttgagcttagatttagaggtagagaattaggacataaagacttaggaaaacaagtaatgcttaaatttatagaactagtaaaagagtttggagaaccaactaaagccccagcatttgagggtaataatatggttgtaatgatagatccaaaaaaatagatatatatttgagaggaggatattaatatgcctaaaatgaaaactcacagaggtgcagctaagagattcaaaaaaactgcaagtggaaaattaaagagagctaaagctttcagaagacatatactaactaagaaggatgctaagactaagatgcaattaagaaagtctggaacagttagtgaaggagatgctagaagaatagcacaattattaccatacctataagaacgaaaaaatatagataaaatttattaaaagagagaaacgaaggaggttacgacgatggcaagagttaaaaaagctatgaacgctcgtaagaagcataagaaaatattaaaacttgcaaaaggttttagaggatcaagaagtaaattatacagaccagctaacgaattcgttatgaaggcattaaagcatgcttatgttggtagaaaattaaagaaaagagatttcagaaagctttggatacaaagaataaacgcagctgctagagctaacggaatgtcttactcaagattcatgaacggattaaaattagcaggtgttgaagttaacagaaaaatgttatctgaaatggctataaacgatcctcaaggattcgctaaattagttgaagttgctaattcaaaattagcttaattatattaaaaactctgagttaatactcagagtttttttgtgtataataaaataatattttaaaaattctaaatttcaatttttatgtagatatatttaaggactaggtatataatgtattttattataaatataagtataataatataagtggatgcaatacgtaatttaatattaagatggagaggagaagataaagtagatgaaagatattatttcaaatataaaaaagtcgataaataaattgaatccatctcaaataatggttattggatttgcctctgtaatattaataggagcaattttattatccttacctattgcgactaaaacaggagagagcataccttttgtagatgctctatttacatctacatcagctgtttgtgtaacgggacttgtagtagtagacacagctacatattggaatttatttggacaaattataataattattttaattcaagttggtggtttagggtttatgaccataaccacattatttgcattaataactaagaaaagaataaatcttagagaaagacttcttatacaagaagctttaaatcagatagatttatctgggttagttaaattaactagatatgtgttattgatgacttttattatagaaggaataggagcattaacactatctactgttttcataccagagtttggaataatcaaaggaacgtggtatagtattttccactctatatccgcattttgtaatgcaggatttgaccttatgggtactgtaagtggtccatttacatctttaactagatatgtaaataatgtgactataagtcttaccatatcagtacttataatacttggagggataggattccctgtaattttagatgtagtaaagaataaaaggatttctaaattaaatatacactcaaagattgtattaataactacatctgtactactattagtaggtacattacttatattatttatagagtattctaatgataagactttaggtaatctttcgttaaaagggaagttattaggagcatttttccaatctgttactccgagaactgctggatttaatacagtagacttaggtgcaatgaatcaaggtagtttatttataatgattatattaatgtttataggaggatctccgtgttcaacaggaggtggaacaaaaacaactacacttgcgacaataatactttcagtaagaagctttatatttgaaaaagaagatatagaagtttttgaaagaaaagtaggattagctacggtaagaaaagctatagctatattttttataggtatatcagtagttattgcaggtattatattaataaacataactcaagattcatttgatttaatagaatctgcatttgaagtagtttcagcattcgcaacagtaggatcaagtataggtggaagtcctaacttaaatatatttggtaagatcataattatgatgtatatgtttatgggaagagttggatttttaactatatttatggcactaatatacaaccgcaatacaaaaaaacaagttataagatacccagagggtaaaattatagtaggataaaagattaggagagatcagatatgaaacaatatatagtaatagggtgtggaagattcggatcatcagtagcaacaacaatgcatttattaggacatcaagtaatggctatagataaaaatgatgatgcagttcaagctctagctgagaaagtaacacatgcagcaatagttgatgttacagatgaacaagctttaagagcattaggaatgggaaattttgatgttgcaataatagcaataggttctgatataagagcgtctataatggctactttaatagctaaagaaatgggtgtagaacaaattgtgtgtaaagctaaagatgaattacaagcaaaagttttatataaaataggtgcagatagagtcgtatttccagaaagagatatgggggttagagttgcacacaatttagtatcaaataatatactagatcatatagaattagatccagattactctatagtagaaattgtaactcctaaagaatgggaaggtaaaactttaatagaactagatcttagagcaaaatatgaaataactgttttagctataaaaagtggtaaaagcataaatgtaactccatctccagaagaacaattaaaatctggtagtatattagttgttataggtcaaaatagcaaaataagtacaataacatcagatacagactttacatttaggagaaaataaatatgataacatctataataagcaaagataatgaaaaagttaagttaactaaatctctcttaaaaagcaaaaatagattaaaagaatctaaatttttaatagaaggatttagaatattaactcaagctatagattgtaaagctgacttaaaatatgtttttataaatgagaacttcgaggagaaaaaagaacatgtagaatttttaaaagtgttacaatctaaaaatataaaaatatataaaactacaaataaaatatttagtgattttgtagatacagaaaatactcaagggatagttggcgtagttgggattaaggaaagaaaaattgaagaaattttagatgatagttgtaagttcgtattaatattagatagaatacaagatcctggaaatatgggaactataataagaacagcagatgcagctggagtagatgctataatcaatttaaaaggatgtgtagatatatataatagtaaagttactagatctacaatgggatctatatttgatatgaagataataaatatgactcaagatgatgcattaaaagaattaaaacttagaaattttgatatagtatctagttatctaaatacagataatttctatgatgaagtagagtacaagtgtaaaactgcgcttgttataggaaatgaagctaatggagttaatgatgaacttataaaaaactcagatactttagttaagatacctatatatggaaaggctgaatctttaaatgcagctataagttcggcgatattaatgtatgagattaaaaaatatatgatataatagagctatattgaaaaaatatgataaatatgatataatctacaattaaaagttatatattttaaatacaatgaaagagaaaagtattttaataaaacttagtacagagataagtacctaggctgaaagtactttctaagctattaaaagaagttccctctggagtatcatagctgaaaataaagtaggttatgacgttataaaacgcgttaagtttttcgagtggtttgcatagtttatttaaataaggcaaactactagggtggtaccgcgaaataatagcctttcgtccctagatagggatgaagggctttttttatatgaaaaattaaattgaaagggtgactatagtgcaagaaaaattacttaatttacaagaaacagcattaagtgaaataaaagacatgcaaagtatagaacaagtagagtctttaagagttaagtacttaggaaaaaaaggtgaaataacagctatattaaaagaaatgggtaaattatcagctgaggaaagacctgtaataggaaaggttgctaatgaagttagagaagcaataaacgatgctataagtgctaaaaaagaagaattaaaaaatattgaaaaacaaagaaaattagctgaagaagttttagatgtaactatgccagctaaagagtttagagtaggtaaaaaacatcctatatctaaaataacagatgaaataagtgagatatttataggaatgggattctctatagctgaaggtccagaagttgaaacagttgcaaataactttgatgcattaaatgcaccaaaagaccatccatcaagagatatgagtgacactttctatataaatgaagaattattacttagaactcaaacttctccagttcaagttagaactatgaaaaatgaagatttaccaataaagataatatctccaggtagatgcttcagatttgatgctccagatgcaacacattcaccaatgttccatcaaatagaaggtcttgtagttggtaaagatgttacaatggctcaattaaaaggaactttagatatgtttgttaaaaagctatttggagaaaatacaaaaactaaatttagaccacataacttcccatttacagagccaagcgcagaagtagatgttacttgctttaagtgtggaggcgaaggatgtccaatgtgtaaaggtgaaggatggatagaaatactaggtgctggtatggtacatccaaatgtgcttagaaactgtggaatagatccagaagtttacagcggatttgcttttggtatgggacttgatagaataacaatgcttaagtatgaaatagatgatataagattattattcgaaaatgatatgagatttttaaatcaattttaattaggaggaattaatatgttagtacctttaaaatggcttagagactacgttgatatagatagagaaactcaagaatttgctgatatgatgactatgacaggatcaaaagttgagaaagtagaattctttggaaaagaaactaatggagttgaagtatgtaaaatacttgaaatagaacaacatccagatgcagatagattaaaagttactaaagttgaggttgctgatggtcaaatacttcaaatagtaacaaatgcaacaaatataaaggttggagattttgttcctgttgctagaataggtgcagtattacctggtgattttaaaataaaaaaaggtaagttaagaggagttttatcagaagggatgttctgtggagctgaagaactaactataccttctcaatacgttgaagaacataaaaaagatggaatatatatactagatcatcaagattcattcgaattaggtatggatgtaagagaagttttaggtataaatgatgctttaatagagtttgaaataacttcaaatagaccagactgtagatcaatattaggaatagctagagaagctgctgttactttaggaaaggaattaaaattcccagaaataaaagtaaatggttcagatgaagaaatgagctttgaaatagatgttcagactgatttatgtaaaagatattgtggaaaagttgtaaaagatgttaaggtaggtccttctccatattggatgcaaagaagacttatagaatcaggaatgagaccaataaacaatatagtggatataacaaactatgttatgttagaattaggtcaacctttacatgcttttgatttagatgatataaaatataataaaatgacagtgaaattagctcaagaaggtgaaaagtttacaactttagatggtgttgaaagaacattaacatcagatatgcttgttataggaaataaagacaaaactttagacttagctggtataatgggcggagaaaactcagaagtaaaagatacaactacatctatattcttagaaggtgcaagctttgctaaagaaaatataagagctacatctaaaaaattaagtttaagaacagaagcatcatctagatttgaaaaaggaatagatataaacttaacagaagttgctgtaaatagagcatgccaattaatagaagaattaggttgtggtagagttcttaacggtatgttagattattatcctgaaaaagaagaaatacaaaaaataacagttaacccagaaagaataaacaagttattaggtgttaatgtagcgatggatcaatttttaaacatattagagagattagagtttaaatgcaacttaatatcttctgataagttagaattagaagttccaagctttagattagatataactgaagatgcagatatattagaagaaatagctagaatatacggatatgataatataccatcagctacattagaaggaaatgctacagctggtgttaaaacagaaaaacaaaagttcatagatgatataaaattcaactctatagcggtaggtttaaatgaaatattaacatattcatttgtaagtcctagaggagtagataaaataaacttagctcaagatgatgagagaagagagtttgttaagataataaatccattaggtgaagaaacttctgttatgagaactactttaatacctaatatgatagatgtaatatcaacaaacttatctcataaagttgaggaagcttatgcttttgagtgtggaaacacatttaaaccacaagcaggattacctgtagaaacaaagaaaatgtctataggaatgtatggaaaagatgtagatttcttcacattaaaaggtgctgttgaaactatattaaacaacgttggatttaaaggttatgaaattgaacctgaaactaaaaatttaacattccaccctggaagatgtgctaaattagtgtataataatatatgtataggtacttttggagaactacatccagatgtattagaaaactacgatttaaatcaaagagtttacattgctgaaataaatgtagatttagtatttgagaacttaaacaatgcgaaagtttataatccattacctaaatatccatcaactactagagatatagctttattagttaaagatgaagtatttgttaagcaaatagaagatataataaaagcaaatggagaagatatattagaaagttatcaattattcgatgtttataaaggcgctcaaatagaagaaggacataaatctatagcatactcaataacatatagaagtaaagataaaactttaactgatgaagaagtagctaaagttcatgataaaatagtaagtgaactaagtgaaaaattaaatgcaaatttaagatcaaactaattacgtaacaaatgtagggggggttaggatgaataaagttacagtaaagatacatggatctgaatatcctatggtgtctgagaaatctaaagattatatgataaaaatagctcactatgtagatgaagaaatgactagaatttcagaatcaaattcattacttagtacatctcaagtagccatattatcagctttaactgttacagacttattatttgaatgctcagaagaaaatgataagttaactaaagaaaatgaagagttagttaaaaaagcagaaaagcctaaccaagaagttcaactagagatgagaaaattaaagttagaacttaataaaaaggttgaagaacttggaacaaaacaaactgagatagattctttaaagtcagaactagaaaataaatcaaatgacttagaagaaatgaatcctctgaaaaaagaaatagaggaacttaaaaatagtttagctgaagcaaatgaaaaaactgaaatagctgaaaagctagcatcagattttcaaaataaattatatgacttacaattaaaaaatattgagttagaacaagagttaaattatataaaagcttctggtaaattattaaaataatagaatacttaaaaaaaccttcaggaaaactaacctgaaggttttagtttttaatgacttaaggaggtagttatgaatacagaattactagcacctgtaggtagttttgatgcattaaaagctgcagtacaaaatggagcaaatgcagtttacctaggtggaaaagaatttagtgctagagcctctgctaataactttgacagagaagagttaaaagaagctgttagatatgctcatataagagatgtaagagtatttgtaacagcaaatacacttataaaacaaaatgaaatagaagattttttagaatatataaaatatctatatgatatagatattgatgcagttatacttcaagatataggaatggcaaagttaataaaatctatgcttcctgattttgaattacatgcaagtactcaaatggtagcacattctcttgaagacactttatatcttcaaaaccttggatttgatagagtagttttagcaagggaacttaatattgatgaaatagaatatatatgcaaaaactctgatgttgatattgaaatatttgttcatggagcgctatgtgtatgctattcagggcaatgtttaatgagtagtatgattggaaatagatcaggtaatagaggtagatgtgcacagccatgtagacaaaagtatgaattaatagatataaactcaggacaaactataaatacagaaggtgattatttattaagccctagagatttaaatacaatagaagagatagatagaataattgatgcaggtgtgcattctcttaaaattgaaggaagaatgaaaagacctgaatatgtagctacagttataagtagttatagacagacgatagatgaatatataaataaaaataaagtaaatgtatctaatgatacaatgaataatttatatactatatttaatagaaagtttactaaaggatatttattaggtgaagttggagaagatgtaatgaactcaaatagacctaataatgtagggctttatattggaaaagtattggattataatagaaaagctaaaagacttaagataatgttagaaaatacacttaaaaaaggtgatggaataaacttaggtggaggtactatagggagaattataaaaactaataaccaaattagcgacaggggagaaagaggagaacttatagagttagattttataggtgatgcaaaaagaggtcaaatagtatataaaacatcagatagtgatcttttaaattcagttaaaaagactttcgaagaagagattgaaaatataaagatacctgtagatgctaaaatagagctaaaacttggtgaaatgccattgttaagtttaaaagatggaaatgggaacagtatatcagttagggcagataaggttgtagaaaaagctataaaagtgtctttaggcaaagaaaaaataatatctcaaataagcaaattaggtaacacaccatattttataaatgatatagaagtagatattgatgaaaatataagtttacctataagtatacttaatcaattaagaagagatgctatagataaattgagtaatgaaagaatatctataaagaaaagagtttataaaaatcaaactctaatatatactcctaaatctgtaatcagagataaagatataaagcttagagtaaaaattaaaaatattgatcaattaaaatatgtattaaaatatgatatagatgcagtttattatgaagatataaatactttagatgaagccattgaaatttctaataataaagtaaaaataatatattctccaccaagaatacttagaaataaagattacaaaattttagataaattaaaaaaagatagtaaattatcagtacaagcaggaaatttagggtgcgttagtttatttaaagaaaatgaattatatatagatacttatttaaattcatttaatagtgaaacaataaatcattataaatctgaaggtgcaaagacagtgtgtatttctcaagagctaaacttaacagaaattaaagatatgttaagatacacagaaatagatatagaaagcattgtttatggatatactcctcttatgattagtgaatactgtcctatgggagttttagttagaaattgtaaaaaagataaaagaagtgctatatgtaataagagtatgtatgcattaaaagattctaaagatgaaatatatagattatcacaagatatattctgtaggacaagtatatataattcaaaacctatatgtatgttagaagatttaaatgaactaaaaaattcatatataaacatatttagattagatttcacacttgaagataacgatcaaatagaaaatataatagaagcatatttagaaactatagaaaataattttattattggaagtaagtctagaaagttatttaataatttagataaggtaggaattacaactgggcactattataaaggtgttgaataaattataattaatatagtatataaggtatatacaatgtcaaaatataagggttgtaattgagataaatttttattttctaaactagctattgatacagtactaaatgaaacaatacagctaactcctataaccaaaaataaaagtttttttactttcattttcccccctataatttgtatacccttttaaattaataatatttcttacaatacaattaaattgtagcttttatacatccaaattcggtaacgaataagttacataatcattagtcaaaataacacttaatatataaaacttccttataataaaaaagtatggataatttatccatacaataatttatatcaaaaaataaaccttaaatattaatacaaatagatttgctagacttatacgttaaataaaaacctataaagaatgtacaaacttcagcaaaaggtacactcatccaaactccactaactccaaatatcataggcagcataactatgcctataattataaataataaccctctgctagctgctactataacagatgatcttgcattcccaatagctgtgaagtacccagaattaactatattaaagccattcataaaaaacgcaaaggcatatactttagctccacttgctgctaaagatattatatcattatttccttttacaaataattcaactaaatctttaccaaagaaaaataatgttacaaatataaaaatacctgctactatacatatctttaaagctaattttaatattttatcaaccctttcatattgcttacttccatagttgtaactaactattgggcatataccatcagatataccaaacattaaaagtataccaaactgtgctatatagtttattgatgtaaaagcggctactccaccttcaccggctatattcataaaagccatattaaaaaggtaagcacaagttgcagtagatattgagtttatcccttctgatgatccattatataacataggatttataacacttttatcaaacttaccgacaaatatatttataacactttttttatcaagcattggccaaactacaaccataaaagcagctaaatatgaacatccagtagctgtagctgtccctactatacctaaatttaattttgccgttaatatatagtttaaaacaatatttgtaaataaacttaatatcatacctctaaaatatagttctggtttttctattattctatttgaaaagccaaataaaagcattaagtttatcgggattgtaaatatggcaaacacttttatatatgttgaaacatctttaactaatacatcatttgcacctaataatattgcaagtttttcattaaatataagtcctaataaagttatacttgctcccattattaaaataaatattatagatgttttaaaaacattctgtgctttttctatatttttatttcctaaattaagtcccatataactttgagctcctacactcactatgaaacttattcccattatcaactgtacaaatggatttgcaatatttacacttgccatagcatttggccctaatatattacctacaaagagtccatctaccatagtttgcattccagatataagcatagctactatggccggtactgcaaactttaaaaataccgttgaaatctttccatttaatagcatattatcttgcactctaatctcctccatatcatttattatgtctacattaataataaagtcttgagtaagtctagagtcaagtgaaatttactaattttttggaatatataatttaactaaatatatattttctttttcttttcttgataatgtaaacatagtttctactaaaacttcaacttctttatctttacaatttatattatttaaaatttcttttgtaagtttttctatattagaaaaagtatcttttctagttataactatataatctcctttaaaatttttctctgtaaaatctgtatattttttatattcaaatacttcatcttcaaacacctcaattcctactctacttgaatctcctactatgttccctttatcatctttatttaaaagtatcattaaattcttagtttttaccacagttgctatgtatgaatttccattttgattaaaaaatattacttttttatttatatattcagatttaaacccatctttaatttctttatttttaaattcactcatttttgatgccatatctttagatattttcacacgatattttaaatcagttaaatattttattttatcctctagaaacttttcatgccttgtaaatagctctacataagcatcttcatcttctttttgtactatatcttttatatctttaataggtatttctaattgtttagctattaatataatttctaataactctatttctcttatagtataatatctatatccattttcctttttaacacttggttttaataaatctattttatcgtaataccttaaagtatcatgacttatgttgtacattttagttacttggcctatagtaaatagcaattatttatcctcctatacttatacttggtactaatcattctcattttaacataatatcataaaaaatttacttatttaaaaattactaattctatattaaaaaagatccctctatgggatctttcattatatttatattaatataatttatttagatttattgtaatcacttaaaaacttttctattcctatatcagtaagaggatgtttagccatttgttctaacactttaaatggtattgtagctatatcagacccttctattgcacattctgatacgtgtattggatttcttatactagctgctattatttctgttttaatatcatgtaccttaaatatagttgatatttcacttattaattctacccctctagctcctatatcatcaagtctacctacaaatggactaacataagttgcacctgcttttgcagcaagtagtgcttgttgagatgagaatattaaagttacattagtttttattcctttttcattcagcactttaactgcttttaatccttctatacacataggtatttttataactatatttttatgtaatttaactagctccatagcttcttcaaccattttatcagcttctaagcttattacctctgcacttattggtccatctactattgaacatatctcatttattacttcttgtaaatttcttccttcttttgctataagagatggatttgtagtaacaccatctattattccccaagtatttgcttctcttatttcgtctatatttgctgtatctataaatattttcattgtcttaatctcccttatctttttatttttataaagcaactattgctcctactattaatgaacttaaaacacttacacaaaatccacctatcattcctctgaatgcaagttctgctaattgtcctcttttttctggacaaaatactgatattcctgatatacatatacccatactagatatatttgcaaatcctgttaaagatatagccatcatcaatccagttctataatctagagtctttaacattggtcctaattcaccaaaagcaacaaattcattaagtgctaacttacttccaagtaattgtcctgctgttaatatactatccttaggtattcccataaagaatcctataggtgcaaatacataagataatatgccttctaatgataatccaactatactaagtccaccgttaactaatgcaactaaagctattatagctactaaagatgcccctataccaagtgccatatttagtccatcagtagctccttgtgatatagcctccattatattactattatttcctttattatctatagttacttcatcactatttatcttagttgcagcacattcaacatctactataatttcagtatcttctttattttctatagttgtagtttctacacttgcaatttcttgtactttttctggtaaaataatttttgatacaattatacttccaaggggaactagtgctcctcctattaaaaggtacttcataggtataccaagtcctgcataccctccaagtacagtagctgacatacttcccataccagatattaaaactagcattatttcactttcgctcattccagatagatacttacttacaagaattggtgattcagtttgtcctaaaaacatattggcaactgcaacgaaactttcgaccttactagttcctagtactttttctattgcaccacctattattttaacgacaaatcctataagccctatataataaagcgctgctactaatgctgatataaatattatatttcctaaaacttgaattccaaatatcatacctgttggagctcctgcatctgctaaaggtccaaatacaaaacctaaaccttgtgctccataacttaatacattagttacaaagtctgatactttctctacagctattctaccaagaggaaattttagtaataaaaatgctactattacttgaattattaaagcttttaatatcatttttttatttacatcttttttattaggtgatataagatataatccacctaataaaagagctatccctattatgtttaatattattgccatcgtcttgtcctcgtttttctatatgataatttaatagattatataatatttttattaattagttgtactaacttaaatgttagtacaactaattatttttatttaaaatttataaaatattatcttgattatatgttttgaactatgcttttaactagatttaagaattgttgttttactctttgtgtagtttctattacttcttcatggtttaaaggttggtctaatattcctgctgccatattagttatacatgatatacctacaacgtttaaattactatgagatgcaactattacctctggaactgttgacattcctactgcatcagcacctaatatttgtgccatttttacttctgcaggagtttcataagttggtcctgtaaagaatgcatataccccttcttttatatctatatctaattcttttgcacattttctagcaatatctatgtactttggagtgtatgcagttgacatatcaggaaatcttactcctaatctatcatcatttttacctattaaaggattatttcctcctaagttcaaatgatcttttattatcattaaatctcctggtttataagacttattagctccaccagctgcattagttacaaatacagtttctactccaagttctttcattactcttactgggaaagttgtttcttgcattttatatccttcataaaaatggaatcttccttgcatagctacaacatcttttccttgtaacttacctataactaattggcctttgtgtccttcaactgttgatactggaaaatttggtatttcatcataacttattattactgggttttctatttcatctcctaaaactccaagtcctgagcctagtataagacctatagtaggttttgtatctgttttagattttatgtactttgcactttctactattttttcatataagttgttcattttctttacctcacagtttctgttatattttttaaaacgatttcctaatctataaatttttaatacctctacttattaatactatattgatttgacttaatccataaatctaattctttataagttttgggtattatgatcttattatttactatagatttttttatttcttctaaatttttaattatatctgaatctatatatacattagatccttctctttcatacccaataacatcttctttaagtccaagcttatgtactcctggcttccaagaattatttattacagattctatttctttgtatattatattgtttgtatatctagttgctgttgctactatattatcaggctcaaaagaattttgatttgcatcaactccaaatgcatacttatttacttgtttagcagctataaatactccaagtccagactgtcctgctagttgttgtatatagtctactcctttattatacattgaaagtgcaatttcttttgctttaactggatctgaaaaatctccaactacagctttcataacctttatattaggatttacatatttaactcctgcttcaaatccaatggctccttcttttaaatggtctaagttttttcctaaaataacacctacagttttattatcgttttcttttgaaatagataatcctgctataataccattaaaaaaagtttgttgtgcccaatttgtgcttatagaacttacgtttggtaagtctagttttgagtcaattatagtaaatttttgatctaaaaactcttttgaaaccttagctacagccttttcttgctctccccctacagagattataagattataatctttagtttttgcatattctcttgctagtttctcataatcacctttagattgagagtaatcaaattcaattgaaagattttcttgtgcttttaacataccatcatagcataaatcattaaaagctttatctcctaaaccagcttcattaaatatgattgcaaacttttttgtattatcatttttaatttctgatttactttgattttgttcatataaataagcaattatcataattaatattaaaataattaatcccattattttcttatagtgtaatttcatttattaattattcccctctgctttaataacattatattcaatgaaacgttttctttccataaactctattgacaattcattaaataatattgatacttttagaatgataaccttacttacaatgaaaaatattgacattttatgaatatttttgacataagtaagattatcaaaataattactatctatcttcttccgggcatatccccttaaattttttatagcttttagaaaaatatcctgcatttaagtatcctacatctttggatatttgagaaattttcatatttgtatttttcaaaagatactcagccttcttcattctataatttgtaaggtatgtactaaagttttctccaacttcttctttaaataaccttgaaaagtactcatgagataaatatacgtggtttgctatatcatttaaggaaatatgctctttatagtttatatctatgtactctattgctttttttattgctttagaatatttattttctaatttattatcatcagtttttatttctttttctacttctatgtttttatttttttttacactattatgtattttgtcaataacctcttttaattccttaggtcttatatctgattttattaaatattcataaaccccgcaacttatggcttcctttgcgtaagaaaactctgcataattagttagtaaaactatataaatatttggaataactttttttatttccttagtaagttcaattccatccattataggcattttgatatcacttataataacttgtggatttaacttaactgctagctcatatgcttctttaccattttgtgcactagctattacattaaagtctttagaaatatttgaaatagtatatgctatccaatcccttattggtgcttcatcttctactactaatatatctaacataattgctcctcctaacttggtagtataaaggtaattttagtcccctcatcttttacactatctatttttagtccataattttgtccatagtttagctgtattctttcgtgtacgtttataacacctaccctgtttacactagcttctttatttaatacactttctaatttttctttagacatgcctattccattatcttttataactatttttataccatctttatccttgtatccaattaagcttattaatcctttattattttctttttccatactatataaaatagcattttctataattggctgtagtataaaagaaggaactttaaaatcttttatattatcatttacttcatatgttacttcaaaacaatcaggatatctcattttctgaagttccacatagtttttaatgttttctaactcttcttcgaaactaatcatttcactagcttttggtaatatacttctaagtaattttgtaaatctataaagcatttcctctgctatttctgttttgttcatagatactaaaaatcttattccacttagagtattatataaaaaatgtggatttatctgagcttgtaaaaaacttagttctgctactcttttttgtttttcatacttttttatattttctatagatgaatctagccaacttaccatactattaaaagatgattgtagttctcctatctcatcacttctatctacatttactttgacttttaaattaccactcataacttcatccattttatttttcatattcaaaataggatttgttatccataatgaaattttataggtaattattaaagctggaatacttgttaatgcaattataaagaatgtcctttgagctattttatttgatacttctttcattatatttgaaggtatttcttgaattatactccatccatattcatcaatattagatactatctttatattttcatcaaaaatatcatttgttttattttggtttatagccttttcataattactacctattaaccttttatctctactagatattatctttttattagagtcaattatataaatagaagttccctcatctattatatctgaatatctatcataaagcattgtttcacttatatccattattaatattcctaatgtttcattggttattaaatcttttataattctacccattttaaatatatttttataaggacctataccattttcatccttataggtatttataagcactgtctttccatttgcttttacaattttttcataccaattttcattctttatactattaatatcatatttgcttttagagtatgtactatatgtcaaaccgttttctcctattatatataactctggtttcatattaaattttccatatttaaaaacttgatccataagcaatccttctacataagaatcattggctttagttttattttcatcagaagaaatattttcttttggagtagataatatatttatcaatttactatctacaacaatgttatttcctatactttctacattagatagtagtattgaaatattattggatacttcatctaaaatttgacttctcatgccttgcatttcttcttgtattatttcattgctatcatttataacccatgcactaataattcctgttattaaaactattagtacaaatattagtaagaatagtttaaatgtgatactatttgtctttatgtctatcatcctttcttacttagatttccaactaataagtttaacctatataaattattaaatcaatatatacgattataatttgataccaataaataaaaagatgagtgtcatttagacatctcatctttaattaaaattttatttataaatctttttttagatacaccatatctataagtttgactccatcttcaaaaatctcatgatcataattatctataaaaaaattttcaatcctatgagaaatcttaaaaccacaatgtttataaaatccaatagttacctgactatctccggttccaacaaacatgatttttcccttatctttatagtaatttaatatatattttattaaatagcttccatatcccattccttgataatttttataagttgctaagtttttaagttcatatgtatctttatcttctttggttactacacaaatacttcttaacttgttatcatataaagcaaataaatctcctctgtctaaatacctatcaatcatatcttcctgctcatctgctaatagtaataaatctagaaatctttttttatcctccaaaattcttttaacttccattttatccccctatttttcacatataaaaaccttttttctaataataaatatctgttaaatttctcttttatttatatactattatatcattgttatttattaaatttttatgtaaaaacaagcatagtaaagttttttaaactactatgcttgttttcttattttgtaatttatatttaattattaagtaaactatggtcttctagctcctctgtaatgagtttgataatatcctgttaatttagattttttaattccatccttttcattagctgcatgtataaattcattattcccaacatacatcccaacatgacttactctgcctttacccatagtatcgaaaaatactagatctcctacctgcaagttttctttattaacagcttgtccaaacttactttgttcatatgaagtccttggtatattttttcctaaagcatttttataaacatattgaactaatcctgaacaatcaaatgtatttggtccagtagctccccatacatacttgtttcctactttactttctaacaacttaactgcattttccattttattagataattttttagtagtatctacaatattttctatattttctttaattgtatttactactttagattctttaggtttactttcagttatatttatttttttatttaattcaactttattttcatctttactttctatattagaaacttcatttgtatttaatttactactatttatagaacttaataatgtatctaaagtttctaaacttccttggaagttatgattacattggcatgtttgcctagaatttaccaatccacctaatgcatcttgtaatataaaatcaaacatatctgattgattatttgaataacctctattatttgagttaacttgactaatagcatttaaaagtttaatagttactatttgattaatatccatattaaatctcccttgttttgtaattacctataatgaatatttaaaataaaaaaccgtatactaaataatacggttatctattaaatatatttaggatttttattcaaattatctaatttcctattccttgtggaaaagaaaaaatattatatggatcatattttttctttatatgatctaatttaattatattaccaccataatactcaaacttataattattaagtttattatatggaaagtttacataagatcctttagttaaattatatatatgtgggaaattttcatttacccatttttcatttatttctttgtaataattacctttaaattctgactgtaaaagtaatatatattttgcatctctataataaaaagctgtagcatgattgtctacttgagatacttctcctcctaatccatacatatttattgatgttaaaatagagccttttggtctttttctattaacaatatctataatttcccttatctgtgatgatgataaatatttatttgcaaatctaccaggaaatttaaaatgttcatatttaggatatatattagctacttcattaatagcttttaaaaatgatacatatcttaaattcatatttgccccttctatattagagaacggctgtaaaagttttttagtttctcttatatccttataacaaattcctattgtgtatatatacattccatcatctaatgtattatatattcctgctctcatatttatatcattatctacactatcaatccatctttgccatatatcaaaaaacttacattgagtatttatgcttggattatcataatttatttcaaaaaaagtaacattttctactttacttggtaatttaaattttatagatactacaactccaaaattacctcaaccagctcctctaactgcccaaaataaatcttgatttttataattattggctactatcaaatctcctttataatctattaattcaacttcaagtaaactatcacaaccaagacctaattttcttgatgataatccccatccaccacctaatgagtagccactaacacaaacagtaggacaagttcctcctggaaatgggtaacctttttcagaaatgaaattatatagttgtgaattcctaacaccaccatctatcttaactgtattttctttataattaatgcttatattgttcattttacttatatctataactagcatgctatttccattagagtatccttcataattatgtcctcctgaccttattctaataggcacagatctatcattggcccataatatagcattcctaacatcataataattttcacaataaactatagctatgggaaatttttgtattgcacgattccacatttgtctaagaacttcataattgtagtcacctttagttacaacttctccacttaaaccacaaaaatacatattatccaatataaacacctactataatattttattttaaattataatctgtattttttatctgattgttaatatatcataaaaaaagagagagcttatctactctctcttttttaataatatgtataattaattattactcatttctaaatttttctttacttttatcttattttctaataaggaatcataaataggaggacaattaagtaaattagccaccatatatgaaactgcacaaacaactataactggtcctaactgtgaaattgatccgctcatctcacaaactaatataaatccagtaataggagctcttacgactgctgaaaacatgccagccatagataaaagaacaaaattatttataagtgatggatctactccaatcataaatattgaaatcttagcacaaattaatccaactaaaccacccaaagttaaaatagggaataatattcctccaggagttcctggtgcaaaacttataagtgaaaatatgtactttcctattaatagtataatagctagcttaatagcaattccacttccaagaatattatttataagtttatctccaccacctaaaacttgtggtaaaaacataccaaatataatagcaaacataaaaggtataatcattttatatcttgagctaatttttaactttccataaatatctatagttttaagtaaacctttattatatataacgccacataatccaattattattccaagtaatattaaaactacataatacttaggtggcatgtttaatagcttttttacacttaaagtatatttctgtccgaaaaatatccatgtaactaaatcagaagttacacaagaaaaaactgcagttaaaaatagcatcggagaaaaacttttatgtacttcttctaaaacaaacataactccagcaaatggagcattaaatgcagcagcaagcccagctcctgctccacttgaatataaataaatttgttctttttttgatattcttaatttttctgaaaaaccatgtgcaaagctagctccaagttgaattgaaggtccttctataccaagagataatccagcacccatagctaaaaccccatttacaaatttacttaataaaattttaaaagaatgtaatatatttaattttccctttaaatatccttcaatttgtggaataccacttcctgatatcataggatttttctcaagcgaatatcctactatatatccaattgtagcaaatactaatattcctaaaattatgtatatataatgatttgtcatgaaattgtatgcacttaagctaatttgacttgcataatttgaacataatctatacaaggaaactataaacccagcagctgccccgaccaaaatactttttaaaacaagctttatattggaacattctaagccattatcttcattgtttataatattgttcgttaatttattcattttatcacctcacaatactattaccccaattaaataattaattaacttataaaattaaaatcatttttctttaggtaaaaaataacgttcttcattatctaaatttaacttaatcatataggagcaatgctcattaactgttttaaatcccatatttttataaaaattttctttatcaggagtagctaaatacactgttctgacattcatagtactatgatttaataatttatctataatatttcttcctatagattgttttctgtaacttggatgtactaatacatcaataatagttgcccatctaacttcataacttaaacttctagccattcctactaatttgtcttcatcccaagcagttattatacaagatgatttttctaaaattttttcccagtcttttttattatcatttactttccaagttgcatatctgcaataaaaatttttaatcttatttacatcaatatccttagaatcagaaaatttaatcataatctactccttttttattttttttaatattcctaataaaaaaatcacaagaataatttttacttttatcttttttatttttatgattatttaaactaattatagaacaatgtataatataaattttttcataatttaaatatatttaagttatatttttactcaaacttagctataattatcataaactttttaatattattaattacataagggggtataaaatgagtaatatagttagagattactataatgaaaatgccacaagagaattcaatagattgtctaatccatatagtataattgaatttaaaacaacacttgctatgatggataagtactttagaaaatcaggtaaagtacttgatataggctgtggacctggcagatattctatagaattattacaaaaagggtataatgtaactttgtatgatatatcagaaaaagaacttaatttagctaaatctaaaattgaaaataataacctaaaagcagacaattacatatgtggagattgtagtgacttaagtcaatttaaagataatagttttgacatagttttattaatgggaccaatgtatcatatacaaaataaaaattttagattgagtatacttaatgatattaaacgtattttaaaacaagatggactttgtatgatatcctacttaaatggattgggaattcttaaagctgcaattcatgaatgtagtttagaatttgaaaatataattaatatagaaagattattttcatcacaatcttggagtaacgaagaatcctttactgaaacctatttatccataccatctgattctattaatgaaataaaaagcgttggattaaatatagtaacatactttggagcagaaagttttgcctcaggtattcattatgatattacaagaatgtctgaatatgaaaaaaaagcttataaaaatctaattcaaatttgtataaacacatgtgaaatgaaagaatataaagacgctacagaacatactcattttatagtgtctaaataaattttaatcatttttataactaattataaattcatcctttcaatcaatgtttttaaacaaaataaaaaaaagttataactatacttataatcatatttgatgtgaatttttatagaaaaatctcagataaattaataaatattaaagatagttctctagatatcataataatttaaattcaattattaaattttaaaggatatagtaatgattagtataatatagtattaattggatttagtttaaggggggttattatgatatatatttttttatttctacttttactattttataatggtaaaattgcaaacaatgtatatatagaaagtgttaatgtatcaaatctcaaccgaaaagaagctaaagaattattaaataaaaaatatacacctaaatctattgttatatcttatgaagataaaacttttaatataaagccatcagatataggattaaaatacaatttggatgaagctatatctaatgcttacagttttaataaaacagattcatatttagaaaatgttaagaaagtaatttctttaaaaagtggaaataaagaaagtttcaaaataaaatcaatatatgatgaaaataaattagataattacttgcaaaatatagctaaagaggtaaattctaaagtaaaagatgctaagctgtacatatctgattcaggtagatttgatataactccttctgttgttggtaaagaagtagatataaaatcaagtaaagataaaataaagaattctatagatgagaaaaactttaaaactgtaaatttagttgttaaaaaagaggaaccaaaaataaagacagaattattaaaaagtgtagattcagtattagctactcatagcactaaatttaacaattcagtacctaatagagctcacaatattataaaatcagctaatagtacaagtgatataattcttatgccaggagaagaattttcatataatgaatcaacaggacctagaagtaaagctaatggatacaaaaatgcgcctgttatagttaatggtaaattacaggatggtactggaggtggggtatgtcaggtatctacaactatatataactcagcactatattctgggctagatataaccaaggttagaaatcactctttaccatctgcttacgcacctgttggtaaggatgcaactgtggttgatggatatttagatttaaaatttaaaaacccatataatcatcctatatatataaaaaatacaacttataatggtgttgttacaagtaaaatatatggaaattcacaagatagaaaaaacataagcataagagttgaaaaagttaaaggtggaaatggtaatgtagtcaaaacctacagagattttaaagattcttcagggaacataataaaaagtgaatatataacaactagctcatataagaaaaaataaaattaattaataatttgctaaataatataagtatatatccgtatataatttctataaaagtagtcaagttgactatgttgattaggaaatcatatacggatatttttatagaatttttaaatgaaacctattttacgatttaagtatttaaatggattataataagataattcttaggtatgatgacatagataaattataatatcttaaaacttgacaaaactatttaaatatatttatacaattcttatttactttccaataatttacataaggtgttataataagaatgaagtgttaaagaataagttcgtaatacataggggggagtttatttgttatatataagcaataggtatgagataatagacaaaattggaagaggatctaaatcatgcttatataaaggtaaagattcttatgatggccaaatggttattataaatataatagatcaagatgtaataaggagtaaaaaatttgtatctaacttaatagatgaagctacgactatgaatgaaatagattctccaaatatacttaaacttaaagatgtaggggttcatactctagaagatggatgtagtttatactatactataagtgaatatgtagaaggtagtaccttagaagaattaactaggtattatagattaaacatggatgaaattgttattatattaagacaaatattaaatgcattagaagtagctcatagctatgatatatatcatggttttttgcatcctgaaagcataattatagatgaaggatataatgtaaaattaggtaatataggaattataaaagctaataataaaatttttaataatggaataaagatgttttctgaagatttaagatatatgtgtcctcatcaaatttgcttaggttacactgataaaagtagcgatttttatgcacttggagtaattatatttgagttagtttttggagaacatccatttggaagcttagaaaatgaagaagatattctaatggaaatggataaaggtataaattggaataagtttaatactgaagttgtaccagaaaaaatattacatataataaataagttattaagtagagatgatagatacaaaactccacaagaggtaattatagatttaagtgaatatatgtatgaagttgaaaatattcaggagaataaagaaaatttagtagaagagttagaagttattaaaaatatagatgttgtgaaaaaagattataaatttaaaaaaattgcagcagttgggttagttgcaattatttcatttttaatattaggtatttcgatgtaaaaaaagctgtatcaaagttaagttttgatacagtttttttatttacactgaaattgaataaaaaatattataaattcaaaaataattaataaaaataaatttggaggcaacataacctatggatattaaaaaagctaaagaaaataagctagaaaaagaatatatagattatactaatttaatatttaatgaggttatagttattgatactaataaaatagatgaattaagacaatataaagatataaatttttcaaatagcatatttaataatgatgttatatttgaaaactgtgagtttaaaaaagatataatttttaaaaatactagatttaagaaaaatataacatttattaattgtattttttatggagattgtatatttaaaaatataaattttaacaaagatataactaataaaaatatatttataaagtcaaaaataaaaggacaaaaattgctttttgaagatgtgcataatttacctaaattagatggtgtatttttaagccattgttgtaaattaatacttaaagatatagtttacgaaaagaaagattatgaatatgcaaaggtgaattataggatagctaaaaatcaagctggtattattggcgattatgaaaagcttggtcactattattatatggaaaggtattatgggggtaaatgtataaaaagaaaaaattttgatagcaatgttgaatatgtaaatacaaagtttatagatttattatctcggtatgtcattggatatggcgaaaaacctgtaaatatatttataatatcacttttaataataagcatatttgcgttattttatatgtttactggagtaaaaaatataaataatgaatttataggattaaatacaattaaaaattataatattaataaaatagtaaaacattatatagatttatggtattttagtatgattacattcactactgtcggatatggagatatattagtacctaatattttagggaaaatattagtaagcattgaagtgtttcttggattaactatggcagcttcttgggcttctgtaatttttaggaagatttcaagaaagtaaataattactagatatatatttagattaataagttaaaaattaatatatacttattaatctaagaaggtgaaaaaatgacatcaggagtaaaaaagtttatatcatttattttaattttagcagctataactccatatactgcatttgcaaatgaaaaagaagtagataagtattctttatcatcaatattaatagaccaagatacaaatagagtactatatgctaaaaatccagatgaaaaaagaccattagcaagtttaagtaaaatgatgactttcttaatagctatagaagctatagaaagtaataaagttaatcccaaagaaaaagttaaaataaccaaaaagatagcttcagtaagaggttctagttaccacttaaaagaaaatgaagaagttccttttattgaacttatgaaaggacttatgatagtatctggaaatgatgcagcaatagctatagcaactcacatatcaaaagatgtagatgattttgtaaaacttatgaataaaaaagcaaaagaaataggaatgaataatactaattttgtaaatcctcatggtttacctatatatgatttacaaaacccaaaggctcaacctaaacaaaatatatctacagctagagatatagccactcttggtaaatatttgtttgataaatatgaaaaacaagttgtatctattacagatatgataacttattctaacccagacagaggatttgaacgaaacaatacaaatccacttcttagaatgataccagacgtagatggaataaaaacaggatatacaggtaatgctggatactgtttatcattttctatgaatgtgaaaaaagaaaatgacatgagaaaatatagaatcataggagtaagcttaggagcaaatcataaaaataagagattatcagcttctcttgatatgttaagatatggtaaagaaaattaccatacagaaaaagttataactcaaaatgaattgataggaaaaaaatatattaaaggacttaaagagctagaagtagagttaagaacaaaagaagagttatatactattataggaaataaagaacatataaatactcaagttacattgaaagaattagaataccctgtaaaaaaaggtgatgtagtaggtgttataaaatattatgctgataatggagaagtattaggcagtgtagatataataagtacaaatgatgtagatagtgcttctcttattacaaaagtaaaaatgttatttaacaattaaaattaatataagataggggttatatccctatcttatattaaagaataatataatgaatatttaggttattatttgtaaataattatttaagaaaatgtaagttaatagtacatatatataatgatataaaatttataaaaaatattgtaatttataatcgcctatgatatactaactgaggtaaaaaataaaataacgcacggctttgtgatctttaaaaggtgcctaaatggttttttaaagagttgaccaggtcggaggtaaaaccaggaggtaaaaatgtcagtaatatcaatgaaacaattattagaagctggtgttcacttcggacatcaaacaagaagatggaaccctaagatggctcaatatatattcacagaaagaaatggaatatatataatagacttacaaaaaactgttaaaaaagttgaagaagcttacaagttcactaaagaaatagctgaaactggaaagccaatattattcgtaggaactaagaaacaagctcaagaagctataaaagaagaagctgaaagatgtggaatgttctacgttaatgaaagatggttaggtggaatgttaacaaaccacaaaactataaagactagaatagacaagttaagaaagttagaaaaaatggaagaagaaggagtattcaacgttcttcctaagaaagaagttataaaattaagagctgaaaaagaaaaattagaaaaatacttaaacggtataaaagatatgcctgaattaccagctgctatattcgtagtagatccaagaaaagaaaacatagctatacaagaagctcacagattaggtataccagtaataggtatagttgatacaaactgtgaccctgagcaattagactttgctataccaggaaacgatgacgctataagagctgttaagttaataactggtgctatggcaactgctataatagaaggtagacaagctatagctgatgatcaagaagaagtaactgaagatcaagaataataacataatttaatggtaagggtatatccccttaccattagtaatatataggagggaataccaatggctataactgcacaaatggttaaagagttaagagaaactacaggtgccggaatgatggactgtaaaaaagctttacaagaagctgaaggaaatatggaaagagctatagatatattaagagaaaaaggattatctaaagctgctaagaaatctgatagaatagctgctgaaggtttagttgctatagaaataaacgctgacaacactgttggggctatagttgaaataaactcagaaacagatttcgttgctaaaaacgaagatttcaaaactttcgttaaagatgttgctgaaatagctttagctactgaaaaagaagatgtagctggattattaactgaatctcacaaagaaggagctttatctgaagtattaaataacagaatagctactataggagaaaagttagatataagaagatttgctaaaatatctacaaacggacaagttgctggatacatccacggtggtggaaaaataggtgtattagttgaattagaaacagaagctagagatgctgaagtattagcaatgggaagagatatagctatgcaagttgctgctatgaaccctaaatatgtttctaaggatgatgtagatccagagtacatagctcatgaaactgaaatattaactcaacaagctttaaacgaaggaaagccagctaatatagttgaaaagatgataaagggaagattagaaaaacaattaaaagaagtttgtttagttgagcaaactttcgttaaaaacccagatttaactataaagcaattagttgcagacgttgctaaaaaagtaggttctgaaataaaggttgctagagtcgtaagattcgaagttggtgaaggtatagaaaagaaagaagaaaactttgctgaagaggttgctaagcaacttaagtaattaaccaaaagagaacacttcggtgttctcttttttaaaaagttaactaaggaggatttcaaatgacaaagcccatgtacaaaagagtattacttaaattaagtggagaagcattatctggagataagggatttggtataaataacgaagttgtaaatgacatagcacaagctataaagcaaatacaagaaattggtgtagaagtagctgtagttgttggaggaggtaacttctggagaggaagaacatctgaaggaatggatagaactactgctgactatataggaatgttagctacagttatgaatgctatggcgctacaagatgctcttgaaaatatagatgtattaacaagagttcaaactgctatagaaatgagacaaatagcagagccttatataagaagaaaagcagttagacacttagaaaaatctagagttgttatattcggagcgggaacaggaaatccttacttctcaactgatacagcagctgcacttcgtgctgcagaaatggagtctgaagttatattacttgctaaaaatgtagatgcagtatatgataaagatccaaaggtacatgctgatgctaagaaatttacagaacttagttatatagatgtattacaaaaagaacttaaagttatggactcaactgctacatctttatgtatggataataagataccaataaaggtatttgaactttctacagagaatataataaaagcagttatgggtgaaaatataggaactactgtaaaataattaaatataaggaggattaacaatgagcgcacaagtaaaaaaacaattagaagaaaaaatgagcagaacaatagaagcacttaaaacagaatttactactataagagcaggaagagctaatgctcaaatgttagataaaataagagttgattattacggaacaccaactcctataaatcaagttggtgctatatctgtaccagaaccaagaactttaatgataaatccttgggataaaacagctatgcctgaaatagaaaaagctataagaaactcagatttaggattaaatccaactaatgatggacaagttataagaatatcagttccagctttaacagaagaaagaagaaaagaattagctaagcaagctagcaaagttgcagaagagtttaaagttagattaagaaatgaaagaagagatgctaacgataagcttaaaaagatggaaaaagaaggcgaaataactgaagatgatttaaagaaatctcaagatgaagttcaaaaagtaactgataaatttataaaagaagttgattctttattaaaagctaaagaacaagatataatggcggtataatattgaaaaaatactacaatttattaggacttcatacaaatgaggtagaaaatttctttaaaaaagaaaatgaaaactatactataactaccataaaaggatataaagatgaagaaaaattaatcgtacctagagttattaaaatatctgagttagataatagtgtagagataatacaaacttactttgctgactccttaaaataggagtcagaaaattttattgggaggtagtttatgaataaaaataatatatatgacataaacttaagtaatgtacctactcatatagcaataataatggacggaaatggtagatgggctaaagagagactacttccaagaacagttggacataaagctggggttgaagctataagggcagttacaaaagagtgctcagcattaggggtaaaacatttaactttatatgcattttcaacagaaaattggaaaagaccaaagttagaagtagatgctttaatgaatctattatatacatatttaaataaagagttaaaagaattacataaaaataatgtaagaataacaactataggtgatatagatgtactaccacgtaaatctatagatgctataaaaaatgcaattgatgtaactaaagataatactggattaaacttaaatatagctttaaattatggtagtagaaatgatataaaaaatgcagttgtagatatagtaaaaaattataaaagtggtaaaatagatatagaagatataaatgaagatactataacaaaacatttaagtacaaagtctataccagacccagatttaataataagaactagtggtgaacaaagaataagtaacttcttattgtgggagattgcatattctgaattttattttacagatatatactggcctgatttcaatgaaactgaggttagaaaagctatatatgtttaccaaaatagagatagaaggtttggtggacttaagtaaggagattattttatggttgtaagaatcattgcagcactagctttaattccattattactatttgtaatatatggaggattgccactatacatagcagaggctattataggaataattgggttagatgagttctataaagcatttaaaagcaaaagtatacaacctataagtattttggggtatttatttgctatatacttatctataaaaaatatttttaaattacaaaccgaatatacatatatatttgtatttatattattcttaataggaatagtttatattttatcgaataagaaaaacataatagatttttctataacatttataggtatattttatataccaatatttttagattatatagttttaacaataaataattttagattaggcggaatttatgtatggttgatatttataatatcatttatgacagatacctttgcatattttagtggatatctatttggaaaacataaattaatacctagcataagtcctaagaaaacgatagaaggtagtattggtggtattttaggttctacaatttgttgcgtaatttttggatatatatttaaattagatataactcatatgattttagtaggaagtattggaagtatcgtagcacaatttggagatctatttgcatcagctataaaaagatatgtaggaataaaagattatggaaaattaataccaggacatggtggtatattagatagatttgatagtgttatactagtagcaccatttgtttactatgcaatatatatatttatttagcttcaggttcctctgaagctttaattgtatagtatataaattattggaaaggaatataaatagtatgaaaaaaatatcaatattgggatcaacaggatcaataggaacacaaactttagatgtagttagaaaaaatagagataaatttgaagttgtagctatatctgcaaatagtagcataaacctacttttagagcaaataaaggagtttaagcctagatatgttgcggtatataatgaaaatagtgcaaaagaattaaaagaaatgataccaagtgatataaaaattgaagtattaagcggaatggaagggttaattacaatatcgtctttagatgaaattgatgtgcttttaactgcaatagtgggtatgatagggttagtaccaactcttgaagcaataaaaaaaggtaagactatagcactagctaataaagaaacattagttacagcaggtcaattagttatggaagaagcaaagaaaagaaatgtagcaatacttcctgtcgatagtgaacacagtgcaatattccaatgtttaaatggggagagtaaaaaagaaatagaaagcataatattaactgcgtctggaggaccatttagaggtaagtctaaaaatgatttaataaatgtaactaaaaacgaagcattaaaacatccaaattggagtatgggaagaaaaataagtatagattcttctactcttatgaataagggattagaagttatagaagctaaatggttattcgatgtaaactcagataaaatagatgtagttgtacatcctcaaagtataatacattcaatggttcaatttgtagacagttcaataatagctcagatgggatgcccggatatgaaacttcctatacaatatgcattaacttatccagaaagaatacttaatgattttgaaagattagatttttctaagttaagtagcttaacatttgaaaaacctgatttaaatacttttccttgtttaaagttagcatatgatagtttaaatatgggaggaacatactcagcagttttaaatgcagctaatgaagttctagttaatgaatttttagaagataaaataaaattctacgatattccatactatatagaaaaaacattagatgctcataagagtatagaaaagccaacattagaagaaatattatatacagataattggagtagagaattcgtaaaaaaatgtattaaataaggtggtgaaggtatgaatataataactgtattagcagctattttagcttttggtataatagtattcattcatgaattaggacactttttatttgctaaaagagcaggggttaggatacatgaatttgctataggtatggggccaaaaatatatagttttcaaaaaggagagacattatacagtataaggttattacctcttggtggatatgttgctatggagggtgaagatggtgattcgaaggatccaagagcttttggtaataaaagcatattacaaagggctagtatattatttgcaggtccatttttcaatataatacttacagttataattttaattcctgtatttatgtatataggaaatccgagtaagccaacaacaactttacaaactgttatggaaaatagcgtggctcaaaaagcaggaattaaatcaggggataaaataactgaaataaatggagttaacattaaaagttggaatgaattaagtaaagaaattcaatcgtcaaatggaaaagagttatcaataactattaatagagatggaaaagaaaaaaatgttaaggttaagcctgagcttaaagatggaaattatttaatagggatatctcccaaaaatgaaaaagatatattaggagcgtttggaaatgcaataaaagcaactataaatatgactgttcaaatggttactttcttaggaaaattaataacaggtaatttaccaggtggagtcgaaggttctcttgcaggacctgtaggtgtaataagcattgttgcagatgcaactagatcagggttagtaagtgttcttcaaattgcagctgtaataagtttaaacttaggaatattaaacttattacctataccagctcttgacggaggaagattattctttttatttatagaatttttaagaggtggaaagaaaatagatcctaataaagaaggtatggtaaatttaataggatttgctacattaatgatatttatgttatttataacatataaagatatagttaaattaattagaatgtagcaaagtttgactagaaggtgaaggtgagacaatgagttacgaaagaagattaagtagagaagttagtgtgggaagtcttaaaattggtggaaacaatccaatatctatacaatctatgactaatacagatacaagagatgcaaaagcaactatagaacaaataaaaagacttgaagaagttggatgtgatgtcgttagagttgcagttcctgatatggaagcagctaaaaacataggcgaaataaagaaaaatgtaaatatacctgtgattgcagatatacattttgattataaattagcactagaagctatagaacaaggtgtagatggagtcagaataaatccaggaaacatagggaatatagacagagtaaaaatggtcgtaaacaaatgtaaggagaaaaaccttaaaataagaataggtgtaaacggtggttctttagaaaaagatttgttacaaaaatatggttctgccacagctgaagctttagtagaaagtgcactaggccatgtaaaaatacttgaagacttagatttttataatatagttatatctcttaaatcatcagatatatataaaactatagaagcttatgaacttatatctaagaaagttgattatccacttcatatagggataacagaatcaggaagtgtcaaaaaaggaactataaaatcttcaataggcgtaggagctcttttattaaagggtataggagatactgtaagaatatctcttacaggagacccaactgaagaggtaatagtaggaaaagaaatattaagaagtttaggattattaaatgataagataaaagttatatcatgccctacttgtggaagatgtaatataaatcttatagatgtagtaaatgaagtagaagcgaaaattaataaaattgataaagacataactgtagctataatgggatgtgcagttaatgggccaggagaagctaaagaagctgatatcggtatagctggtggtaaaggagaaggtctattatttaaaaaaggtgagatagtaaggaaaataaaaggagatagtttagtagaagaactgttagcagagatagatttatataataagtaataataaagagctgttaagttaagattttaaatcttaacttagcagcttttttatttatattagccatttaatcaattcttgttattaggatatttttgtataaataacaagaatagtatttatcgataatggataagttaattaatagtttaaataccaatttatataaaggagtgttaagaaatgacagataaaaaaccgagtataatacagagttcattgggatcagtattttctgtgtttagtgaagaagagctaaagcaaataactgataatagcaaaagaaatattgctatttcaggtaaaataaataatcctgggataatcgaaattccagaaaaagctacacttagagacgttatagacttagcgggaggaataataaaaaatagcaactttaaagctgcacaattaggtataccatttgggggatttttaacagaagatagtttagataaagaattagactttaatttttttgataaagatactagtaaaactatcataatactttcacaagaagattgtatagttcagtatgctaaattttacatagattttttaataggaaaaatgaaagaagaaaaatataaaaagtatcaaaaagtaaaaaatgagatacttcatatgtggaaaattttagatagaataagcaaaggcagagctaatatgagagatattttcatattaagagaacttgcaagtactgtaaaggatactttaaatcaaaatcacaacataatgcaagaaattgttgataaattttatgatgaaatagaagagcacatagaagaaggaaaatgttacacagctcaatgtaataatcttataaaattgactataacaactaaatgtataggttgtggagcttgtgaaagagtttgtccagttgactgtatacatggagagagaaaacaacagcattacattgattataatagatgtacacactgtggacaatgtattccagtttgtcctgtagacgcaataacagcaggagataatactcttaagtttttaagagatttagctataccaaataaagtggttataacacaaatggcacctgcgataagagttactataggagaggcttttggatttgaacctggagtaaatgtagaaaaaaaaatagcagcaggtctaagaaaattaggtgtagattatgtatttgatactacatgggcagctgatttaacaataatggaagaagcagcagaacttcaagaaagattagaaaaacatttttcaggagatgaagatgttagattaccaatacttacatcttgttgtcctgcgtggattaaatttatagaacaaaactatggagatatgctagatgtgccatcaagtgctaaatcacctatgcagatgttcgcaaccgtagctaaagatttatgggcaaaagaaaaaggtcttactagagatcaagtaatatcagttgctataatgccttgtgtggctaaaaagtatgaagcatcaagacacgaattttcaagagattttaattatgatgttgactatgttattacaacaagagaacttataaaaatatttgaaaactcaaatataaatttacaggatatagaggatagtgagatagaccacgttttaggagattatactggtgcaggaattatatttggaagaactgggggagtcatagaagcagcaactagaactgctatagagaatatgacaggagaaaaaatagaaaatgtagaatttgaatgccttagaggatgggattcatttagagcttgtgatttagaagtaggtggattaaaacttagaataggagttgcttatggacttaaggaagcaggtaaaatgcttgataaaataagaaataaagaagagtttttccatgcaatagagataatggcgtgtacttgtggatgtgtaggtggaggtggacaacctaaagctagaaagagagcagaaacaatagaaaaaagggcagaaggcttaaataatatagatagatcattaaatttaagaaaatctaatgaaaatccagaagtacaagctatatatgataaatatttagaccatccattaagtgataaagctcgtgaacttttacacactaaatattttgttaaagttaagaaataaatttttaaaattaatattgtataaataaaaattgttatagtggagataataagtttgtaagagattggaaggagtaaacaatgaaaaatcttaaaatattatcagtagcattagtgattatgattggtaatattttgtttatgggatgtgaaatttataataaatatggagaaaataaaatcaacagcagaaataataatcaagaaggtttaagcatatacgaatataatgataaatttacaaatttataatttatctattaaaaccattttacctatagatttatttaatacatcttccaaatctaacccattatttatattagatactatctcatctttatctatttccacaatacttttagcttttaaaatacctttgctataatacatttcagctaatatattaagtactgattttttacctgtccctacatctcctgtgaatatcatatttttatatttatttatattgtttcttttccctagtttttctcttttttcttgtatttttaaaaacttatattgattttttaaaaactctttagctttattatttccttttaattcttgtaatttttcttctaagttaaatgtattttcatattctaatacatttattttttctatatctttaactgttattaaattcatttcataaacgcttatttcttcttcagcaattctaatactttgatttctaattaggctttctacataatttctaaccattctaccatttcctgattgtgaatctgcttcctcgtaaatagattcaaagctctttttaagagacaaataagcatttttagataatttaaatcctttattttctattaattttatggacatttctaataattcattagggttataatctttaaatactgtccatataggaaatcttgatttaagacctatattaacatcaaagaaatcttccatttcttcttcatatccagcaagaattactacaacatcttgtccataatcttcaattaatttaagtaatgtttctatagcttctctacctaatgagtcattagctagtgtataagcttcatctataaataacactccaccaatagcttctttaaatttttcttctgtttttcttgatgtttgtccaggtatttctgaaacaaaactagatctatctgtttctataagctgacctacttttaaaagacccatactatttaacatttctgcaactaatctagctatactagtttttcctgtaccaggattacctgcaaaaaccatatttaaattttgctctatttttgtatttactccagctgattttcttttttcttgtgctactattaatttatattgacttcttagtaagcttttaacttcatttaatcctactatttcgcttaatcttgcttctaagtcaaattttgtttttgctttaaaattaaagttatctctttctaataaatcaatttgctttgatttttcagttaagtattttttagaagcgtcaagtatagcattttcaactatatttctaacaaatctggcattacctaaatcatttttaccacttatttgatttttagcaaataagtctattaaatcatgtttaacatttttagcaattctatatcctttagatttagcaatattaacagctatctcatacatctgtattggagtataatcatgaaaatgaataatatttgcaaatcttgatttaagacctggattaaatgctaaaaattcctccatatcattttcatatccagcaagaattactattaaattatctctattatcttctactcctttaagtaatgcatcaactatttctttacctactttatcatcatcactctcacataaagaataagcttcatctataaataatactcctccaatagcagaatttataatatctattgttcttttagaaatatctgatgcgttttctgatacaaagtctgctttactaacttctttatatattcctctagataatataccaagtgcatttaaatactcaaaagtcactctagcagcattcgttttacctgtacctgcattacctgcaaatatcatattcaaagatatatttgaagttttaagtcccaatctttctcttattttttggactttgtaattattttttacattgttaaggaaattttttaaatcttcaattccaattatagaatttaatttatactctgcttcttcaagggttggcattgagtaagaacttaaattaaactcttctttatttaccttgcaatatatatcattttcttttacgtatattattatagttgttcctgcttttaattgctcttctcttataaaattagtcaatggtctgcttaacttatatgatacgtattcacttattccaaagtttgaatcttttttataagtttcttgcaaaaatctacatataccaaagtattcatcctctttatcatcttcatttatatctaatgttacttttatatcatattctaattctttatttttaatagtttctaaaacctctttttttactattttgtttctttcaatattattaagtggttttgtatgtaatacattatctacattagatttaaaagttttgttaaaatatttatctaactcaaagtcttcatcattgctaatgtatactaaaaatttattatgacaaactatcttatttattttatttttatcttgattatctgctcttactaaaaatttattttttataatatattcatcatttagattaaaacaagtgtttggatatacactagatagtacgtgtaatatttcactacttgctttttctatatttttaaacatcacgcaagcagagttagaccctaacttttcatacaaatctgttaaaaatgcattatatcctaaattaaaattatatgaagctaaatctatttcatctacttgtgaattttctattatatctgtatctttaagatattcaaatattcgtcttatactagtttttttcgctgtttctttttctcctactaaaactaatactcctttttctccttttgtaagtttatctctaaagtaattgcataagtcactaatgaaacttttttgacctataagttctttatttaaacttttttgaatatctataaatttatcatttatactaatcatttatatcccctcctttaaagttataagtataactttgtttctaatcttctatcataatcagaccaaccatcaccatctgaattatcctttatctgagttattttattcattgtagcatctataccatctgcaaaatttaatatgaatgattcttccatattacattctctaggtgaaccatattcaagttttccatgatgttgtacaatacaacctttaattcttcttatgaaatcttcactaaatttatagtccatttcatttattgctctatctataagttgaactccaatagttatatgaccttctagctcaccttgtaatgtgtatttaaatgggccattaaaatctaattcgtaaagtttccctatatcatgtaattttgcacttaatattgctatttctttatatttacaatcatatctctcacaaagtactttagtcagatacataacgcctagtgtatgttccgccaatccgcctatatagttatgatgcatacttaccccacctatccccatcttaaacttatctaaaaattctttatttttaaaaaaataatcatttagcattttagcttcttctgattttatatattcatcacttaaatcatctatatctttcattatatcttctataggtctttttactgttggaagataatcatctaattcataattttcattaattatatttacatgtttgacttcatccatagttggttcttttttactatctatttctataacttgtcctggttttaatttgaatttattaggtattctagcttttatttgctcacttctatcggtaagtatataagttgtcatattactatctttgtgtattcttttcattaccataagtgatgttttaaattgcttattcatttctatatcttttaaaaatagcttcttatgtgtcataatattaactccttttttgttaattaataaattttaataatctaatttttaaacaatttaaattttataatttttcaatctaattagtatttaattaattataagttaaatagtatatcttttattacctcagatgctaaaactaatccaccacttgaagacataaaagatatacttccaggtaatattctgtgtccattggatactttttcttttaactctattggatgttctgttgaaaaaactacttttaaattatctattcctctatctcttaattcttttctcattactttagcaagtggacatgtatgtgtatttgatatattgcttacttcaattttagttggatctaacttatttcccattcccatagaactaattataggtatatttcttttaatacattcttcgaccaaatgtattttagatgaaaccatgtctattgcatctactacataatcataatgattattaaatatactttgactagtttcattattaaatattgcttttatatcatatacatttgcatttttatttatatcctttaatctttcttttactacttttaccttatcttttcctatatttgagttaagtcctggaagttgtctatttatatctgttacttcaacttctgaataatctattattgttatattagcaatgcctgctctaactaaagcttctacacaaaaacttcctactccccctacacctactactaatacatgtgaattttttaatttatctattccatcttttcctattataagttctgttcttgttgtaaactttttttccatataaaatactccttttgtattgtatcttaattagtatttgcaaaatgtataaactatattaattagataaataaaaaagtaccttaaaaccataaaaatcattttaagatacttttttatttatctaatcaaactcatattgatacataattcaataagccttggaaccactaaggttaatactaatattagtgctactatttctaatcctaatacaaacttatcttcataagttaatggcgattttttaactgcctttattcccgttatcctttctaaacttgataaaaatctaattacactttttctatacttatttttcaaatgattcaagtatataatgtttttatcattggtttctataaatgacatatatccactagttgtattgactccccattctaatccttttgaccaacgtctattttctatagcttttcctatgctttttacttcctttacctctataatctttttatttactattttaaaattttcagtaataccataatatattaatttatcttttgttagatatagtttaaaaaaatatgaagctccatgattaatatatgatgtatttacacctggcatagatataaaacttggtacaaataattcatcaataatttcattctttagtgattccatatctttatctataacttttaaaattatatattttaatacattgctattttttatcccatgctcagatatatctccagattcacctagatactttttaatctttaatacttcacttaaagaaacatttatattaaacttactatttgcttcttttaattcttctaataacatgctcattctttttttaattttttctttctgatttttatctaatccgtcttcaaataagccagcttctgtatattcctctatttcaaatttataatcatattttttattatttttgctcataaacatcacccctaatcatttcttcttaatttattttttattctcataattctaagactaattgcctttggagtaattcctaagttatgtgctatatcttttacttttctatcattttcataccgttgagtaaatatttctttatctaattcacttaacttttcaatattttcttttatttcaaatataacctcttttattaaaattgtatcttccactgtagatttatcctttatgttttctttaagttctaaagtgtttttaatatacttaatttcttttctcataatatctattgctgtatactttgataatgtatatatccaatttttaaataacccttcatccttattataaaattcaataccttcccaaatcttcatcagtactaaatttaaacactcctcgctaagttctttattatttaatattttatatgatgctctgtatattaaatctccatatagatcaattaaatctatcaaagatgtttcatcttttttcttaagcctatcaattaactccaaatcatgcatatattcccctccatatttatcttcttgctaatataatcgtaaatttttttttattacttcatatatactataattttttttataaaaaaagagcctatttaaaatagactctttaaattattttattagtagataatgggaaatttggtccatgctattctactgaccctacaggtagcttaactatatctttatcttttctttctattaactttttatactatactaaatttttgtataaatttaaaatttagtctgcctttttaatttttaattaaaatttnnnnnnnnnnttaaaatttatttttttatattttatttttattatttatatctattttatgttattattaatataataaattttagaaggaggatatttatgaggatactattcacagagtgggctatgaatatagctgagcaaactaaagttagaagtacttgtgtatctagacaggtcggtgcggttatttgcatggataagcaaataataagtacaggttataatggagctccttctggtgctatacattgcacagatataggttattgtgagagaagaaaaagaaatatcccatcaggtcaaggactagaactatgtagggcaggtcatgctgaagcaaatgctattattcaatgtgctaaaaatggaactagttgcaatggagctgttttatacgtaactactcagccatgtgtattttgttgcatatctataatacaagcaggtataaaaaaagtagtatttaaaggtgaatatcctacaggtttggggcttcaactcctagaagaatctggtgttgagtatataaagtatgaaaatgaactggaaaatgaaagacaagctactgaattgaaaaaactaagtgagtctaaaagaattgaagagtttttaacaactcctaaaaaatattaataatagtctctttaataaaaagtatctaagtgattataactacttagatacttttttattctataataaatctatattttttaaaatctctatcttattcatattagtcatatctatatttataggagttattgaaatataaccattttcaattgcacttatatcactattttcttcttgaataatctcttttatttttcctcctatccaaacataccttttaccatgtgggctttgtctttcttctatatcattttcatattttcttatacctaatttagttattttaaatccctttatatctctatctggtatattcacatttaatatacaatcatcaaatatatgcatattatttttaatgttattaacaagattaactacatgcttagaagctgttatatattcttcatttgatactttaaatgaatcataagatatagctattgctggcttattctgtataagaccttctatagctgctgatacagttcctgagtatataacatcagttccaagatttgctccattatttattccacttaaaactaaatctatatttacatctttaaaaatagattctatccctagttttacacaatctgcaggagtcccacttatagaatacgccttaatattatcatctatatattcttctttaatcattattgggttatgtattgttatcgcatgtcctgtagcacttctttgagtatctggtgcaactacataaacattagctatttcttttattgctttagctaaagcaattataccattagcttggattccatcatcattagttattaatatgttcataaatctactcctaaatttttattttaatcttaaagctattagctagaaaatctttcttacttttaatttatattatttcttttaaattccttctttaaaatatttttataaaataaaaaagcactcctttaatgagtactatgtataataattattcatttataattcattacttaataagtatattatacatgttaaatctcttttaaaaaccattacctcaacctttaaattttcttacatttttgatatataattttaaattttaagactattaaatttaaaattatttataaattaaaatcattgagtaatatattgataaaacataattttataaagttcaagcaggcaatatactcattttcaatgaatatattgcttgcgaaataacttcttattcatatactgaatatctttcccatatttgttctaaatcatcaaaatatgattttatatcttctttttccttcattcctatagatactacaagtgcattacaaatgctaagtgctggaaccagtgaatcaacaaatgatgccatattacttttaactaaaagagtagtatctgatattgtagctattggagcaaataaactatctgttatagatattacatgagctcctttgccttttgcataatctacaacctgataacttttctttgaatatctaggaaaacttatagccacaactacatcttcttctgtaactcttactacttgttcaaaagcatctcccatatccattcttataatatgcacattatctaatattatatctaagtaaaatcctaaatattgtgctatactaaatgaacttctcatccctaatatatatatttttctagcttttaaaagtttatcagaagcttgttgaaatatttcttcatccagatcatctaaagtatgtcttatattgtctatatcactttttaatactttatttaatattttacaatcatctgagtactcttgattcatttcaactctttgtactgtagtcaacttattttttataagttcttgaagtgcatcttgaagtttagggtatcctgaaaatcctaaagcatttgcaaatcttactacagtagattcgcttactcctacttcttctccaagctttgaagctgtcataaatgctaccttatcataatttgatattaggtattgagctataagtttttgccctttactaagtcttggatattgtttttgaatatcatcaattaactgtttgctatctttaaaatctttagtttcgttcatatttatctcctcatatctactaatgatttttaatttacatattaatctttaactttgtttttcatataacaaatatattatatcaccttttcatatattttgaataatatataagctttttatcataataaattaatgaaagttgttataactgcagaattgaaaaattctataaatagtgcgcctactaaaggtaatataaaaaatgaacttggagatggcccatacttatttgttactgattccatattagctattccattaggagtagctcccataccaaaaccacaatgtcctgctgataacactgctgctgtataatcttttcccataactctaaatgtaacaaagtatgcaaatatagccattaaaattgtttgtaaagctaataaaattattatcggtatagccaagtctacaagttcccataattttaaactacacattgccattgataaaaaaagtgataagcaaattgatccaatactggatatctccgcttctgatgtagtccatatcccttttaggtctgaaatatttctcataattgcagcaactatcattgctccaatatactcaggcatagttattcctattacagaaaatatagatgatactacagttccaaatcccatagctattattatttgaatagctgaacttgtcaaattactttcagataatttttgagaaactttgcaacaagttccatcaccttctaagctaacttccgttaattcttcataattgtttttttcatattcttctgattttaaattatattttacaactaatttattagctaaaggtcctcctataacactacctgcaactaatccaaaagttgcacaagccatagctatactaagtgcaccttctaatccattggcttctataagtggaccaaaagcacctgatgctccatgaccaccagtcatagatacagaacctgcaataagtccaagcaatggattaactccaataattttagcagatattacccctaataaattttgtgacaaaactaataaaactgctactattaaaaatttaataacttttgccccccctttttttaaaaccttaagacttgcagtaaatcccacagtcgtaaaaaatgctgtcataagaatattttgaagagttgtatcaaatgaaattgcaactatattattttgccttagtataaatgctataatcgcaaaagagaaacctccaactacaggtgctggtatacaatattttttaaatatattgactctttcttttataaaagaacctataataagtacaatagtagtaaatgcaatactttgtactatatctaaattcattgtaaacattcctaattcacttgaaaattcaaacataacataccccctttaattttatactatattcattgtaatttaacgaataattttaatatttcatttcttttgattttattttctgaaaatttccaataaaaatttttcatattttaagttttaataaaaaattatcttaaaatatgaaaaataattttcactttataattaaaaagaaaggattaatacttctctttttaattagcataagcaattaatgaacatccaagttcaaaagctctttcatttaaattttcagtccctttcggaactctagctaatatagctttttttaacatttgtttatctatgccttctaataactcacttataactcctagtgcaactatattagaaaccataacttttccaagcttatttttactactttctattataggtatattaaatatttccatttttcttttttctaaattatttatttctacagtagaatctacaattataattccatcttcttttacagtattaatatattcattaaaagatttttgtgttaaacacaatagtatatctgcttttctaacctttggaaaatttatatctccatcacttattattacttcagctttacttgctccacctcttgcttcagggccatatgattgagtttgaacagagtttaaatttgataatatcgctccttctgcaagtattataccagctaaaataagtccttgaccacctgaaccactaagtcttatttcttttctcatattcatatctccttataatcactttaccctttctattattttttcatattctttagtgtactctggcatatcaatatccataaatataccatagaaatttttattttctaatttttctttaggcaatttatcttttaacgctacatctacataattatcttttaataagttcataagagcaacagcagatccttttttattttttctaccataataagttggacatatactcattccttccactatagaaaaccctttatgacttatacctttttttatgtattctatcatttgttttgcatgatatgcagttcctcttgctacaaatgtagctcctgcaccttttgacaattcacatatatcaaatggtttatctatatttccatatggagctgttgttgcaaaatcattagtgttagttgtaggagaatactgacctccagtcataccatatatattattgttaaatactatagttgttatatctatatttcttctgcatgcatgtataagatgatttcctcctatagctgtacaatctccatccccagttacaactataacatgcatattaggatttgcaaatttaacgcctgttgcaaatggtatcgctctaccatgagtggtatgaagtgtgttaaaatctaaatatccagatgctcttgatgaacatcctattccagaaactacacatactttatctttatcaagattcaactcttctatagcttgtgctattgatctcataagaattccatgcccacatccaggacaccatatatgtggtaatctatctgatctaaaattattttctataatgcgacttggcattttttcacctccataatcttatctactatttcatctggtgttataatatctccattgtatttattaattccgattacattacaatctttattagctactcttttaacttctagtagcatttgcccatagtttaattctggaacatatatattttgaacgtttttacttaacatatttactttttcttctgggaatggccaaactgtttttatcgtaaataacccagcttttattcccttatctcttaaaatatctactgcatcttttgtgcatctactcatacacccaaaagttataaataattcttcacagtcatctactttgtattcttcataaattaaaatatcttctaaattttcatctatcttattcattaatctatccattaataatcgagtttgttctgtactgtttgttgggaatcctgtttcatcgtgcataagacctgttacatgatatctatatccatctgagaagtttgctattggtggtactagagttgattgatcgtatatcttataatcatttttatctatgttaattttcattctattatatacttcaagttcattttcttcaggcatttctactttttctctcatatgccctattacttcatctagtaataaaattacaggtgttctatatttttctgaaaaattaaaagctttaactgttaaatcaaatgtatctcttactgttgttggtgataatgctattataggatgatctccatgagttccccacttagcttgcattaaatctccttgagctggagatgtaggaagtcctgtgcttggtccacatctttgaacatttactattacacatggtatttcagcaagtgatgcgtatccaatattttcttgctttaatgaaaatcctggtccactagtagcagtcatagatttaagtcctgtaagagatgctcctatagtagctgccatagatgcgatttcatcttccatttgtataaattttccccctacctttggtagcataaatgatgaaatttccgctatttctgtagatggtgttattggataacctgcaaaaaacttcatccctgcatataatgctccatgtacacaagcttcatttccttgtaacaatttaacctttttaaccatagccattatccccccttgttaattttcatctctagatatataaatagcataatctggacatctaagttcacataatccacaaagtatgcatttttctatatcttctacacctattatgtttttttctaattttaaaatatttttagggcagtattctacgcaaataccacatcctttacaccagttagtatttaacacaagtttacccttattcaaaattatccccccaaaacttttactttcactataaatagtaacgattttatatataaaatgcaattatcatttcattattcataatttttattcaattttgcaattttacttattataatttcataatcttttttaaaaattattatgtattttaaaattaaaatttaaggttatattaactccattgtatttacttattcacatatattttatttttcaattcaaaattttcatttatattttgatttatattttattttttcaaaaagaattcatctaattttttctttcaatataaagcattattttctcaaattttttcgtataaaattaaaaatatattgtatacatttatgatattgctcgtcctaatcaatacataattttttacttgcattttataaacttctcttctttctataataaaaatatattacaaataaattattttataaaaaaggtatagctgctatatttaaatatagcagctatacctttttttaatattcttttttcttttctataagtataagtcttggtgggttatttacttggtttacaaaattgcaatttaatacattaaaattagattgatctaatttacttacataatcaaatactgcattgcattcatccattccaccttcatgtcctgtataaatagcgatacttataacaccatgtggctttaataaatttaaacttttctttatagctttaagtgttgtatctggtttagttattatttgatgtttagctctaggtaaatatcctaaattaaataaaacacaactaacttcatcttttacatatatatctatattttcgtgtccatcaagaactaaatttactctatttaataaattttctttttctaatctttttttagtactttttatagcttcttcttgtacatcaaagctataaacaactccgttttccccaaccttttgtgcaagatattttgtatcatatccattacccattgtagcatctataactgtatcaccttcacttatcacatcttcaagcaatactttatttaaatctgtaactttagttaaatattttgctttaatcatattattcatccttttattttaaattctttaaataatttacttcttcaactgttaaatgtctatatttacctatttcaacatcttttaatacaattttacccatagcttttcttcttagattcataactgggtgatttatagctttacacatttttctaacttgtctatttcttccttcatgaatttttatttcacatacagcataatttttttcaatatttttcttaactatctttattttagctggtgaagttttataatcttctatatataaacctttttcaaaatttgttatttcattttgtgttggaattcctttaactgtagctatataagttttatctacttcatgttttggatgagttaacttgtatgtcaaatctccatcattagttaaaagtaataatccactagtttcatagtctaatcttcctataggatatactctagcatctatatcttttactaaatctataacactttttctatcaaattgatctttaacagttgttacatatccttcaggtttatttaacattatgtacactaatttttcttctaatccaattaactttccatcaacttctactttatcttttttttcatttatttgaaatgataattcatttattaagtttccatttactttaactctattttcaagtattaattcttctgcttttcttcttgatgctattccacaagaagctatatatttattaattctcatgatattctccttatatttaaattcttcacattagattattatactataatttttaaaataattttataatttcatattattttattaataatatttggctaaattaataatattattataaatactcctaaaggaggtactattttgatttcaagagataatattaagtactgtatatttgtggtgtttatttctttattaatatataaagcgatagataatccttatgcaaactttacatgataatattaaatataaaactaattataatttagtattatcaaaagatgaaatagacttaataaattataatgtcaagattaatttaaatggatataaaaaagtaagtgaagaagatgcacttaacaaatcaaagacaaaagtaagaccggtgtataaaaagataaaagggaatattataaaagattataaaatttggaatcaaaaaaaacaaataataatacaagttcctatagatatagaatttatataaaaagggtatctaattagatgccctttttatattaaaattatttttttacaaatacatctataaatacatcattataacctttggattttaaggattcaaccatttcttctgcataaattcggttattaaaagaaccacaaactactctataaaatgtatttgagttttcaactggaacatttgatttctctgagggaacaggatttgaagaatcatattttacacctaagtaattacatatacctcttgcaattgcgactgcaaattcattttgattttcttttaataatttagcgtctaattcattgtcgataaatgcaagttctactaagcaagaacgcatattactgtttcttaaaacatggaaattagcagttttaactcctctattttgagtgtaggacttagattttaatatttcttcatgaatataacttgctaaatcattagttttagctgtgtaactatatgtttctaaacctttagcactaccatcaaatgagttacagtgtatagcaatataacaatctgcactccatttattagcagcattagttctagaatctagtgaaagtgtagaatcattatctctacttaataaaacatctaaaccttgaatttttagtaaattgaacactttttttgaaacagctaagtttatatttttttctaataggttattaactccagaagctccattatcgttgccaccatgacctggatctataaaaacttttttagccatattaacctccataaaacatatttgtactttaggtactacatataatatgaaaataataaaaagtttgttcgagaaattaagacaaaaaaaccctaaatacatatttagagtttttttaataccaatgatttactaaaaatgaagctatattttcaaaaggaattttttcagttttaagaaggctttgaactactaatccatcgactatagagactaataaaaaagacaatgaatctgaatttttagcatttgttttttctatttctgactttaaggtatctctccattttatataattatttcgtattctatgtctaagatcttcattagaagttatagcttcacaaagaatatacatatgtattctacctcttccgcctatggtagatattttatccattattgaactgattaagtcttcctttgaatgagtagattcgatattttgaacacagtctaatactgaactagttattacagataaatgcatatcagcgatatcatatattaaatcattttttgaagagtaataataatagagtgtacctttgcttatgcctacaaatttagatatatcggcaagacttgtatttttaattccgtttttagttataagttcagatgcagctaataaaatagtttgtttcatattatttgattgcttcatataatttacctttccttataatacctttaaattaagtaatattataatattatgtaaatttattgtcaattaatctaaatagtgtgtatagaaatgctaaaaatattttatgtttaaaactaactattttgaggtaaataataaatatattaaaaataatcgactaaaaattttggaggaactaaagatgaaagcatttgtagataaaaatatatgtatcggatgtggagcatgtgcaggaatatgcccagaagtatttgaaatggatgatgatggattagcagttgctatagatacagaaatatcagctgaattagaagaaagtgcagtagaagcacaagaaggatgtcctgtaagtgctataacagtagaatagatatataaaacataataagagtgtctataagtaaaacttatagacattttttttttacaaaaaatataagtttagaaaaaaatgaacttatatgaaggttatatcaaattaatatataaattaaatagaaatgatattataaacatatagataaattttattagtagttagggggatttaaatgaaattatgggagaatatacatatagatggaattaatagattagaatcaagggctcattttttaaattttccatcaaaggagttagctttaataggagataaaaaatatacttacaattttaaaagtttaaatggaaactggaaatttttgtttttaggcgcaccagaatattcaccaaaagatttttataaagaagattttaatacagattcatgggatgagattgtagtgcctgggaattggcaaatacaaggatatgggaatatgcattatacagacctttgctacaattttcctataaaccctccatatgttccgactgaaaatccaacaggtatatataaaaggaaatttaatatagataaatcttggatgaatgaaagaataattattaaatttaatggagtagattcggcgtataatgtatggataaatgggaaagaagtaggatacagtaaaggagctaggatacagtctgaatttgatattactaattatattagacttggagaaaatgaatgtactgtaagagtttatcagtggagtgatggaacttacttagaagatcaagatatgtggtggttaagtggaatatttagagatgtagaaatttttacagaacctttatatggaattgaagatttaactgtaaatacagatttggatgatgattatgaagatgcaatcttaaatgtaaatctaaaatttagaatgtttgacagtcaaaatttagaatttgaattattagataaaaataaaaatactgtttttaaagatattttagatacaaaaaataaattaagttttagtaaaatagttaaaaatccattgaaatggacagctgaagatccaaatttatatacattaattataagtgtatatgataaaaataaaaatttaattcaagttatacctcaaaaagttggatttaggaaaatagagataaaaggcgaagtatttactgtaaatggagttataattaaacttaaaggagttaataggcatgattacaatcctaaaaatggaagggttgtagctaaagatgagatagaaaaagatataatattaatgaagcaacataatataaatgctataagaacatcgcattatccaaattctgagtatttttatgaattatgtgatgaatatggaatgtatgtaatagatgaagctgacttagagtgtcatggttttgaattaacagataattactcttggataagtgatgataaaaattgggagctagcttatgtaagtagaattgaacgtatgattaaaagagataaaaatcatccttgtatattgatgtggtcacttggaaatgaatcatcttttggatgtaattttaaggctatggcaaaaaagtgcaaagaactagatcctaccagaataatacactatgaaggcgattttaaaatagatgataaatgcggtccagtatctgaggtttatagtactatgtacacttggatagaacatgaagataataaattaatggacaagataataaatgatataaaaaaaccacacatactatgtgaatatgcacatgcaatgggaaatggaccaggtaatttaaaagaatatcaaaatttattttataaatatgataagttacaaggtggatttgtatgggaatggtttgatcatggtatacaaagtgtaaatgagaaaggagaaatttactataaatatggtggagattttaacgatgatccaaataacacaaatttttgtatagatgggcttttaatgccagatagaagtatatcaccagggcttttagaatataaaaaggtaatagagcctgtagaaactattagtatagatttagaaaatggaataattaaagttataaatagatatgattttaaaaatttaaatacactagatttaatatacaatataaaagaagataataaagtcataaaaagtggtagattgagtatgcctgatattccaggaaaaaaatctaaacaaataaaaataccttataatttagattttaagaaaattagtggagcaacttactatttaaatatatcttatgtattaaaaaatgatttgaattgggcaaaggctaattatgaattagcaacagctcaatttgaattgcctataaaaatagaaaaattaaaaatatatccaaattcaagtttagaaataattaaagataattataaattaatagcaaaaggggacgaatttaaagttgtatttgatctggtaaaaggaaatattatagaaattgtcaaagataattataaaatagttgagaaaggtccaaagcttaatttttggagagcacccatagacaatgacatgcatatattaaaagattataaagaaaaatattttatgcacttaatgcatgaagttgtaagagatgttaaatacagtgtaaaaaataatgtattgacatttaatgtagatgttataaatggtacaacgaactcatcttggcattataaatctaaatatgaatataaagtatttggaagtggagatatattaattaaagttagtggtatacctagtggtaaaatagaaaatgcacctaatatgatacctagaataggtgtaaaaatgaatataaataaagatttagaaatcgtaacgtataaaggaagaggtccaggagaatcatatcctgatagtaaagaagctaatttatttggagtatatgaaagtaatatagataagttatttacaaattatgtaaagcctcaagaaaatggaaatagaagtgactgttcatgggttagtttaagaaatgatagaggaataagtcttatggctgtagctaatgataagtttgactttagtgcatcttattatgaatcaaatgatttagagtatgctaagcacactatagatttagtaaaaagagattatatactattaaatatagattataaacaaaatggacttggaagtaattcttgtgggcaatggcaattagataaatacagatgcaaatttgaagaatttagtttagagtttaggcttagtatatttaataacaaagaagttagcgaagtaagcttaggaagagaaataattaaaacacattcaataaaataaaaagagaactcatatgagttctctttttattttatttttgatattatctttgcaagattagaaactaaatcttccattgaaactaaatcttcatctgaaagtgtcatcaatttagataaaagtatatctttaagtctttttttatgctctacagccatatcatgagctttttgagttaaatctattctaactattcttctatcattaggatcttcttttctgtatactaaaccttcacttaaaagcttgtctataacaggtgtcatattaggttttgaaatttcaagtttagaagctatatcagatatagaagatgaaccattattaaaaagatggaatataacctttacatgagattgaggaaggggagaacatctaaccattttatcttgattaaaaactttgctatttaattgcattagtaaagtgaataagtcatccgatatcttagttaaatctatattactcatacaaaaaaactcctttgaatatataattatattattattataaactaaaataatgctttatacaatttaaaaaagttattgacttataattattataaaaatataattattataaaaacataactaattaatatcaaaaagggagaacgagcaaaatgattaagttaattaaacatttaagaaactcaataggctcagtgttgcttattatcgtgcttttagcgattcaggccacatgcgacctatctttaccagattatacatctgatatagtaaatgttggtatacaacaaagtggaataaaaaatgcagttccaaaagttataagagaaagtgaaatgaacaaaattactatgtttatgagcgaaaaagataaaaatgaagtaatgagaaattataaattactaaataaaggcgaatataaagatagtaaaattaacgaaaaactttatgaacttaacactaaaaataaggaagtaattaataaattagatcctataatgggaaaatcaatgttaatgctttctggtgttgagcaaaataaagaacaaatattaaaaaagatgatgccaccaggagtaccagtggatcctaacacaaatataatatcagtactaaaagcaatgcctgctaaaactttagatcaaatgaaagcaggatttgaggaaaaagttgataaaatgccagagagcatgataagtcaaagtgcaattagatatgtaaaagctgaatataaagctattggtattaatgtaaataaattacagacaaattatatatttaaaactggagcaataatgctaggaatagctcttataagtatggtagctacagttgcagtaggatatttaggggctagagtagcagcaaaacttggtagaaatttaagaaagcaagtatttgaaaaagttgtatcattttcaaataaagaaatggatgaattctctacagcgtctttaataactcgtagtactaatgatattcaacaagtacaaatgcttatggtaatgttacttagaatagtattttatgcaccgatacttgctataggtggagttataaaggtattaaatacaaatacatcaatggcatggataatcggagtagcagttcttgcaatagtatctgtagtactgcttttatttggattagttatgcctaagtttaaatctgtacaaaaacttgtagatagagttaacttagtaactcgtgagatgcttactggaatgttagtaataagagcatttagcacagaaaaacatgaagaaaaaagatttgacaaagcaaatactgatttaatgaaaaccaatttatttgtaaatagagcaatgtctatgatgatgccgactatgatgcttataatgaatgttattactgttgtcattgtttggaatggtgctcatagtatagattcaggaaatatgcaagttggagatatgatggcatttatacaatatactatgcaaatcataatggcatttttacttatatcaatggtatcagtaatgttaccacgtgcagttgtttctatggatcgtatagatgaggtaataaatactgatttatctataaaagataaaaaagatgcaaaagaatttaatgaaaataaaaaaggtatagttgaatttaaaaacgtaagttttagatacccaaatgcagaagaagatgttttaagtaatataacatttacagctagaccaggaaaaactactgcatttataggtagtacgggttcaggtaaatctacacttataaatttaattcctcgtttttatgatgtaacagaaggtgaaatattagtagatggaataaatgttaaagatgcaaatcaacataaactaagagaaaaaataggatatgttcctcaaaaaggagttttattctctggaacaatagattccaacttaagatatggtagaaaagatgcaactgaagaagaaattaaaaaagcagctgaaatagctcaagcaagtgaatttataaatgttaagcctaaaggttttgaaagtgaaatagcccaaggcggaacaaatgtatcaggaggtcaaaaacaaagactttctatagctagagctatagctaaaaatcctgaaatatatatatttgatgatagtttctctgcactagatttaaaaactgatgcagcacttagaaaatctttaagagaagaaacaggaaattcaacagtacttattgttgctcaaagaataagtactatattaaatgcagatcaaattatagttttagaccaaggtaaggttgttggaataggaaaacatgaagagcttcttaaaacttgtgaagtatacaatgagatagccctatcacaactttcaaaggaggaacttgcaaatgggtaatgaaagcaaaagcatgccaaaaggtcgaagcggtggacctatgggtggtatgagaggaacagaaaaagcaaaagattttaaaggtactatgaaaaaactttttgactatctaaagccttatagattatcgatactaatagttatagtatttgcaataggaagttctgcattttcaatagtaggacctaagattttaggaaatgctactactgaattatttgaaggaatagtaagaaaaattagtggagaaggaaatggtggaattaactttaactatataggtaaggtacttacaggtttactagtactttatgtagttagtgcacttttctcatatgttcaatcatttataacatctgggatatcacaaaaagtatcttatagattaagaaaagaaatatcagaaaaaataaatcgtatgccacttaattactttgataaaagaactcatggagaagttttatctagaataacaaatgatatagacacattaagccaaaacttaaatcaaacgatgactcagataataacatcagtaactactgtaataggagttcttataatgatgttatctataagttggcaaatgactatagtgtcattattagtgcttcctatgtcaatgataataatttcatttattattaaaaaatctcaaaaacactttaaatctcaacaagaatatttagggcatgtaaatggtcaagtagaagagatatatggtggacataatatagtaaaagcttttaacggggaaaatgcagcaataaatgaatttaatcaattaaatgatcaactatataattcagcttggaagtcacaatttttatcaggtatgatgatgccgatgatgacatttattggaaatataggatatgttttagtatctatattagggggatattttacaattaaaaaaactatagaagttggagatatattatcttttatacaatatgtaagaagctttaaccaaccaatagcacaagctgctcaagttgctaatattatgcaatctatggcagcagctgcggaaagagcatttgagtttttagatgaggaagaagaagtacaaaatattgataaacctgtaagcgttgaaaatattaaaggtgatgtaagttttgaaaatgtaaaatttggatatagtgaagataaaattataataaatgattttacaactaatattaaagcaggacaaaaagtagcaatagtaggtccaacaggtgcaggaaaaactactatagttaaactattaatgcgtttttatgatgtaaatgacggagctatattaatagatggaaacaatataaaagattttaatagaagtgatttacgtagcttatttggtatggtgttacaagatacttggttatttaatggaagtataatggaaaatataagatattcaaaacttgatgcaagtgatgatgaagttatagaagcagctaaatctgcacatgttcatcactttgtaaaaactcttccagatgggtacaatatgcagttaaatgaagaggctagtaatgtatctcaaggtcaaaagcaacttttaactattgctcgtgcaattttagcagatcctaagatacttatacttgatgaagctacaagttcagttgatactcgtacagaagttcttatacaaaaagctatggaaaatcttatggaaggtagaacaagctttataatagcacatagactttcaactataagagatgcagatttaatattagtaatgaaagatggagatatagtagaacaaggtagtcatgaagagttattaaaagatggaggattttatgcatctttatataatagccaatttgaagaaagtgaagaagtttgttaaaaaatagcagataaaaatattgtaatgtagatataagtgtgttacactaaatttaacattaataaatgttaaatttagtaacaaggttttaggaggattccgaaatgatgaatggaatagttaaatggttcaacaatgagaaagggtttggatttatatctgtagaaggtggagatgatgtattcgtacatttctcagctatacaaaaagaaggattcaaatctttagaagaaggtcaaacagttaactttgaaatagttgaaggagcaagaggacctcaagctgctaacgtaactatagcagaataattgagtttatatataaaacacaattaagaaataaaactagagaatattctctagtttttttattgaaagtatttgttttttcattattgttacatttatgtgacgattttgttacacaattatgatagaattaatttagggtataaacaagaaaaaagtagaattatggatatttacgacaaaaggagatagtttatgtgtgggcacgtatttatatacaataaaaaaggaaaagtagataaaaatttattagaggaaatgaatcaaaaaatacatcatagaggaccagatgatacggggtattttgtaaaagataatgtaggatttggatttaaaagattaagtataatagatttagctcatgggcatcagccatttaataaaaaagaaagaactataatatttaatggggaaatatacaatcacgagtcattaagagaagatcttataaaaaaaggatatgaattttcaacaggttcagatactgaggttttattaacttcatatatagaaaatggtaaaaatgcagttaaagacttaagaggtatgtttgcatttgtaatatatgatgagactacaaacactatattcggagcaagagaccattttgggataaaacctttatactatactgaaaatgaagattatatagcattttcttctgaatataaagcattaatgccagtagtaaaagacaaaagtgtagacaataagagtttacaaaactatttatctttccaatatgttccaaattataaaactatgatggaaagtataaaaaaagttccaaatggtacttgctttactatagaaaataataaaataaaatttgaaaagtactttgaagctaattttacaaataaaagagaagttacaaaagaagatgtatacaatatattaaatgattctgtaaagcatcatatgatatctaatgttgaagttggtacatttttatcaggaggtatagattcaactataatagctagtttagcatctaaaataaatcctaaaataaaatctttctctgtaggatttgaagtagatggatataatgaattaaaagtagctaaaaaaacagcagatgcattaaatatagaaaacatacaaataagagtaacgcaacaagattatataaaagcattacctcaagttatatataacttagatgatccattagcagatccatcttgtgtaggtatatatttcttatcaaaagaagctagaaaacatgtaactgttgttttatctggagaaggtgcagatgaattcttcgcaggatacaatatatataaagaatataatagtgttaaaccatttttaggattaccttctggaatgaatcgtgctttaaataaaatatttgcaaaaatgccagaattaagaggtaaaaactatttattaagagcaacaactccgttagagaaaagatatataggaaatgctaaaatatttgaaaataaagaagttaagaatataatccatagttatgatgaaaataatacatatagcaatttattaaaaccactatatgcagattgcaaaaagaaaaactatgattatgtaacaacaatgcaagatattgatataaacacttggttagaaggcgacattttattaaaaggagataaaatgtcaatggcatcatctatagaacttagagttccatttttagataaagaagtatttgaagttgctaaaaatttaagattagatcaaaaaataagcagtaaaaatacaaaagttctattaagagaagcttttaaagatattgtaccacctcatatggtagaaaagaaaaaattaggattccctacacctataagagtatggttaaaagatgacttaggaaaatatgtaagaaatgttataaatacatcaaaaacagatgatattataaacaaggaatatgctatagatttactagatgaacatataagaggagataaagataactcaagaaaagtttggacaatatttgtattctgtttatggcatcaaatatttatagaaggaattagtgtagattctttataaatgaaagaaggatataaaagtgaaaagaatattaatagttgaagatgaagaaaatatatcagatatactttcatattctttaaaaaaagaagggtatgaaactaaaattgcagatacaggtaaaaaagcacttgaattaatttcaagttttaaacctaacttaataatactagatttaatgctacctgatatgaatggacttgatatatgcaaagatattacaactatgtattctatacctataataatgctaactgcaaaatcagatactatagacaaagttttaggtttagaattaggagcagatgattatataacaaagccctttaacataagggaagtaatagcaagagttaaatctatatttagaagaataaatttattatcggataatattaaaactgatatagagatagtaaagttagataatggtttagaagtgaataaaaaagaaatgaaagtaagagtagataatgaaattatacatttaactagtaaagaatatgaactccttttatattttgttgataacataaacacagtactaacaagagcccaattacttgataatatatggggaataagttttgaatgtgaaagtaggacggtagatacacatattcaaagacttagaaaaaagcttgggaagcataattgtatagaaacagtaataggaacaggctataaattgtctagtaataaaatataaatatgaataaatccataactaacaaaattatgatgtttttcttggttataatattctttgttatattttctatagtaatgtatagtaattcttcgcttaataaaatagtagaatatttaatagacaatgaaataaaagaaactacaaaaagtataaatttatatttagatcaatattttaagttaaataagatggaatttaataaagttgcttttgttgcagaaagcaatgatatatctagggatttaacttatagattagataaaactgtatatatatataataatagatgccgattggtatatccaaaagcaggaaagcataaaattcctaaattaactaaagatgtaaataatgctaggaatggagaactatcatacactatagagtataaagatgataaagcgttagtttatgtttcttaccctattttaaaagatgataagtttataggtatgataagatttataagtgattatactccattttttgaacaaactaaatcatttgttggaaaaatattagtattttctataattatatttgctgtaagcatcattattgcatatataatatcaaagcaaataactatgcctataaaaaaattagcaaataaaactaaagaaattacaaatggaaattttgatgttgatataaatataaagtctgaagatgaattaggaatacttgcttcggattttaataatatggtagaaactataaagatgcagataaaaactatagaaaatgatagagataatttacgtgaattatcagaaaagcaaaagaaattttttgataatgttacacatgaattaaaaactcctatgactaccataattggatatagtgaaataataaaagataatcaatttagtgatgaagaattttttaataaaggtataaatagaataatatcagaagctaatagattaaatagaatgatagttcaattattagatatatcaaaaaatactaataaggattttgattatgaacttaaaaaattaaatttatctaatattattataaatatgtgcgaagatatgactcacaaagccaaaaagtataatatgagtatagatgtagatgtagaagaaaagataaaaataatagcaaatgaagataaaataaaagaaattataataaatttaatagataattctataaagtatggacaggtaaactctactatatatgttagggctcatgtaaatggtaagcatgttgatatttctgtcacagatagtggtgagggaattgaagaaaatgaaatagccaatatattatcacctttttatagagtatctaaaagtgaatcaagagaattaggtagcactggtttaggtcttgctattgtaaaatctatagtagatagttacaatggcaagatagatataaaaagtgaagttaataaaggaactaaagtttctataaaacttcctacaataagttaaggagatatatgtaatgctaaaaaatgtaaagcaagatataaagaatataacacttttactttttattgtaggaattctttcgcttattatatatatgagtgtatattcaaacaaagaatacactaaaaatgtaaacttagatatagaaacgtataattacaaaaaaagtaaagatataaataaaaatgaaactataaaattaaaatctgtaatacctgtaaaagattatattttagatataaagtttgatggagataatttagtagcaataagtgatcatatgtcaaatgataaaagaggtatcaatgtatataatatagatatatctgataaaagtattacaaatttatatactttaaatggtaatggttttgctatgtataatagtggaagtatatcaccttcgagggaaataatagtttatgatactgttgatagtaaaaaaccagataaattaaatagtgttatatataacatagaagatggtagtagagtaactttagattattattttaatttattaggatggatgccagatagcagtggtttttatgggtataaaaaagataaattatttttatataacatagatgaacaaaaaattactaaaaaatttgatttgaaaaattatggatatatagataaaattgctttttcacaagatggaacaaaattatatacattaagcatacctaaagatgaaatatgtatatatgatttaaatagtaagctaattaaaaagataaaatccataaaatttatatatgattttgaggttatcgatgatgaacatttaatagttgcgactattaattcatcagataagagtttgcttttatataatttaaaagataatactaaaaaaacaattagtggtataatatgaggaaaatcaactggaatatccttaaagaaaatcaaatctcctatagaacaaactatgctccaagaaaaaaaaatattaaataaatggtattttttcaaaagtaaaatcgcaatacatatatatgttgtaattctagttatccctattggtaatgagtataaaacattataacttcttaaggatattaaacaaatttgttctagtataatttcaaatataaatgatatgcaaattattttttctattaaatagctatacggaagtaggtttttagttaatttaggtaatgaaaatagaaatatagcaacaaatattagaattattaagtgttgagtagaaaatacaaaactaggattcaagccgttcccccctaactattggttatgtaaaataaagataaacatatagtcatgtccgtttatacattatattcagtacatacatagatgataataaaattttaaaatttatataaatatttaattgtaacaaaatattaattagttaataaattagtattatagaaattaaaaaatagacatttaaaattgatctaagggaagtgattctttgaaaagaatatgtatacaaccatgtgcagattgtggtagcaagtattgtccatgtcatttagcgtattcaggggattgtattcagtgtagtttaattcaaggcagtaaaacgtgtgattgtatatggcaaggggtatgtatatacaatgaattagagcacaataaaaatgtagcttgtaatcaaaagattgatacattatgtgatgttaaggtaaagaaagaaattttaaaagacatatatttattagaaataaaaactcctaagaagttattagaagaattattaaatccagggtcatatatacttctaagaggtaaaaatgaaattgactcaaagtataatgtacctatatctgttatggatgtagatcttgaaaatgaacttttaaaagtagttataaaggaagtaggacacaaaactaaaagtttattaagttctaatgaggtttgggttagaggaccttatttaaatggggtacttggacttagagaatttaagttaactacaaatagtaatgtagctgtaatattaagtggattatctcaagttaatgctcctaaaataataaaatatattttgaaaaataataattacgtagaagtatttatagatacaagaagaactatagtagatgaagttatagaaaaaattaaagatttaaacgttaatattcactttataaatacaaaagaagatgaagagctaataaaagatttcataagaagaaataatgttaagttagtatatagtggagggtttaattcatttaataaagatataatgaaattagttgatagcgttgatgaaaatattagatttgctatagcaaataataatttaattgtttgtggagaaggtatatgtgggggttgtacagttgtagttgatggaaaaagaataaaatcttgtaaggctcagataaatggaagagattacttgaaaagtttaaaataatataatgtttatattgttaaggggggaatacaaattggcaaaagtagtggttataggtggaggatgggctggttgtgcagccgcaatatctgcaaaaaaagcaggtgctgatgttgttttgttagaaagaacagatttattgttaggacttggtaatattggcgggataatgaggaataatggtagatatacagcaacagaagaagccatagtattaggtgctagtgaattatttgaattaacagataaatattctacacataaagacatggatttcccgggacataagcactctactatatataatgttacagaaatagagaaacctgtaagagaaaaaatattaaatatgggtattgatgtaagattttttgctagagtggttgatgttaagttaaatggtaaaaaaatagagtcagttattctagaagatggtgaaattataagtggagattcatttgtggagacaactggttcatcaggacctatgggcaattgcgccaagtatggaaatggttgtgctatgtgtgtgctaagatgtccatcttttggtggtagggttagtataactgctaaatgtggtgttgaggatatggttggaagaagaaatactggagaacttggcgcatttagtgggtctatgaaacttttaaaagaaagtttaggtgaagatatacaaaaggatttaaatgaaaaagggtgtgcagtagtacctttacctgaagaacttataaatactgaaaagcttgatattaaggtttgtcagcagtactctcttcctgagtttgctaaaaatttagttttaatagatacaggtcatgcaaaacttatggctccattttatccacttgaaaaattaagaaaaattccaggatttgaaggtgctataatagtagatccatactcaggaggaaaaggaaactctataagatatttatctgttgctccaagggataattatatgagagttacaggagttgataatttatttgttggaggagaaaagagtggattctttgtaggtcacacagaagctatatgcacaggttctttagcagggcataatgcagctagaaattcaataggtatgtatttgttacaacttcctacgagcatagctataggcgattttattgcttgtgctaataaagaattaggtaaagaaggtgcagatagattaaagtttacttttgctggtagtgtttactttaacagaatgaaagaattaggattttacactactgataaaaaggtaatagaagatagagtaaaaaaagctggattagagggtatatttaataaaaaaattataaagtaacttacaggtggtaacaaattgttaccgcctttttaaggtttaaagaatatgaatatgcaatataaatacaaaaaattgatttacagattatgggcaggtaaaatggctaaatactgtattttagtacaaaaatttaaataaaattaataaaaaatacaaataagcacataaaattacaaaattgtaattgaatatattgctctaaagtaataatatatttatagattattactttagaggagtataaatatgaaaaaattaacttatttcattataccactattaataggaggtatatttttatttggattaaataaattcctcgataataaaatcgatgaattactaaaagataaggatttagttcctattatgaatgattctttaagcaatataaaagacaaaggaattattgcaaataattatttcttaaaaaaccatgatattatgatgttaggatcatcagaattaggacattcaacaaaacaacatccaacatattactttaatactaatagaagtaaaaatggagtatttactattggtagagcatatactcaaagtttacaagatgcaactatcataggaagtgtaaatcctaatataaaggataaaaaagttgttttactaatctcaatgcaatggtttatggatagagaaggagttacaccacatcattatcaagctagattttctccaactcaattttatgcatttttaaataatcctgatatatcaaaagcaaataaattaaagtttgcaaaaagagcaagtaaattgttagttggatcaggggagtataaaccagaagctgtatatgcaaagttatacgattctaactcattaatttctaaaattgaaaagtttttattagctccttattttgagggaagaaaattctttgtaactcttaaggagaaaggattgttatatgagaaattaattactttaaaaaataaaaaagaagtaaaaccagggaaacctattgattggaataaagaaacagaaaaagctatagaagatgctaaaaaaagagtaggtaaaaatgatttatgtatagataaaatctattacaaaaagaattttggacataacttagataaagtaagaggaaaatataaagacgttaatttgttaaaatcaaaagaattctttgattataaacttacactagatgtatgcaaaaatttaggtattaaacctgtaatagtaatgatacctgctatggacaaattctataatgtaacaggaatatctacaaaagaaagacatgaattttacgataaggcagaaaaaattgcacaaaaagaaggttttgatgtaatagacctaagagaaaaggaaacagagaaatactatttaagagatgtaatgcatcttggtacgaagggatgggtagatgtttgtgaaaaattatttgaaaaatttaatcagcaataaatatttaatgatgagtatctgttttaccgtaattataattgcggctatattagtactgacatttactccatttaaggaattaccatttatatacaatgaattttaataaggaggattaagtaatgaaaattattgaaggtataaaaaagtatgcaagcacagatagaatagcattaaaatgtaatgaagaaactctttcttacaaagatttagataagtattcagaagcaatagctttatacttaaaagatatttataaagaagaaaatacaccaatagttatatatggaaataaagaaaatcttataatggcttgtatgataggggctttaaagtcaggaagagcgtatgttcctcttgatataagttttcctttagatagagtttttgaagtaacaaaagaagttaagcctaaagtagtgtttaactttagtgaagaaagtaactttggagatttaaatgtaattgatgaagataaacttaaatgtataataaaagagtacgaaggaaaaacaatagatcaaagtaattgggtaaaagaagatgaaaatgcttatatattatttacatcaggaagtactggaaaacctaaaggagttcaaataagttcaaacaacttagatagctttgttgattggattagtacttatttaaaaattgatggaagtgagaaggtaattatgaatcaagctgcatattcgtttgacctttcagtaacatcaatatacccaggattagttcatggggctacattattttctttatcaaagaaagtattagcagattataaagagttatttaatcaatttgaaaaatcaaatatgtcaatttgggtttcaacaccgtcatttgcaggtgtatgtgtaacagaaaatagttttaatcatgaaatgttacccaaattagaatctatgatatttataggtgaagctttaccaaagagtttaactaaagagcttttagaaagattcccaaatacaagggttataaatggatatgggccaactgaggcaactgtcggagttagtgtaaatgatatgacacaagaattaattgatgatgaaaagagtcttccagttggatatcctatggaaaattgtaaaattaaaattatagatgaagatggaaatgaacttaaagaaaatgaaaaaggggaaattgtaataatagggccttcagtatctaagggatactttaataataaagaaaaaactgatgaagtcttttattatgacgaaataaatggagttaaacatagagcttataaaactggagatatgggttatatgttaggaggaaatatatattattgtggaagaaaagacttccaaataaaattaaatggatttagaattgaaatagaagatatagaaaataacttaagaaaagttgataatgtaaaaaatgctatagttcttcctgtttataagaatgaaaaaattgcttatttaaaaggtattgtagaattaaaagaagataatgaattaggcaatattaaaaatggtatgataatcaagaaggaattaggaaagtatataccttcatatatgattccaagaaatataaaaattatagatgagtttccaacaaatattaatggaaaaatagatagaaagaaacttatggaggaaaattaatgactttttcacaatatggagattatttttatctttatatattactattaacagcaatacctgcaataattttagggttaagtggtaaaaacataaaatattatggtatgatagcaagtgcatttatgatatttttaatagttggaataaatgtgcatttatcatttttattatgttttataataattgaagttatagtagttaaagggtatgaatatgtaaggaaaaaaactgataataaatttgtatataggctatttctattagcatcaatgtctccaataataattaataaaatttcaccatacacatcatttggagttattggatttataggaatatcatatttaaattttagaacaatacaaatggttattgaaatttatgatggagcaataaaagaagttaaaatatctacaatgctttacttcgtattatttttcccaacattaagttcagggcctattgatagatcaagaagatttgaaaaagacttagaaacaaaaataccaaaagaggaatatataaatgactatttaattccaggagtaaaaaaaatagttatgggtattggatataaatatgtagttgcatttttagttaacacatattggatgtcaaaaataccatctgaaataaattttgtaaatgctttaagttatatgtatgcttatagtttatatttattctttgactttggtggatatagtttatttgcagtagggacaagttatatatttggagtaaaagctccagacaactttaataagccttttataagtaaggatatgaaagaattttggacaagatggcatataagtctttcaagatggtttggagactatattttctcaagatatgttatagcgtctataagaaagaaaagatttaaaaaaagagctacagcatctcatgttgctcaaatgattacaatgatagttatgggattttggcatgggctaacatggttttatattgtttatggaatatatcaaggagcagcacttgttttaactgatatatatcaaaagaaatctaaattttataaaaagcataaaaaagagaagtggtttgaatgtgtgcaaattgtactaacattccatattgcatgctttggactattaatattctctggatattttgcttaatttaaggaggaatacaaaatgcaagaaacagttatagaaatttttgaagatgttttaggatgtgacgagataagagaagatttagatcttaatttatttgatgcaggtcttttagattcactagcaataatagaagtattacttgaaattgaagaaagacttggtataacacttcagccaacagatttagaaagaagtgatatggctacagtaaataatttaactaagttcttagaggcaagaaaataataagtgtaattttattaaatagggtattttattacaaataaaaaaggaggaagtaattcctccttcttgttttataatacatcactataattcatgtactctactatatcattgtaaatttccacaacaggagctatgtttttcatagtattatcaaagtataactttataacatcatcagttttataaagtattaaatctttgttatcttgatttataaatgatattgttttttcactattatattcatctacatcaatagtttttactatgcaattatgtttacttatttttgttgctatattaaataataaatcatcactacaattatctatttgtagtactaaacaatgaaatgtagttttaaaattcatgggaaacctcctcgtattaagtctaaatttggtataaaataacaccttataagaattttaacacatttgataagaaaaacaaatttgcaaaatgtataaaaatgcatatataatatataaaatagattagatatggaaacaattaatcttatacttacaattttagaggagagagttttatgtcaaaggttgcaaaagcagcagtaggtcttatggctgcaacattaatcgctaagatattaggatttggacgcgaactagcattggcgtcggcgtatggagcatctggaactagtgatgctttcttagtagctatgaatataccagcagttatattctcagcgataggaacatcattagggactgcatttataccactttattgtgatatagatgcaaaaaaaggaaaaaaagcttcacttaaatttacaaataatgttcttaatatagttattatactttgtttaatagtttcgttaataggcgttattttcacaggtcctatagttaaactatttgcagtagggtttgaaggaaaaacattagaacaggctatatactttacaagagttttaattcttggaatggcatttttaggaataagttatataatgatggcatttttacaagttaaagaaaactttataataccaggacttatgtctgttccgtataatatacttataattgtatctatatttttaagtgttatgatagatccaaatttattaccttggggtacattatttgggctgtcgctacaatttatattccaatatccttttgctcgtaaaaaaggatatagatatagaccatatattaacttaaaagataaatacttaaagaaaatgttatggttaataggtcctgttttaataggggttgcagttacacaagttaattctatcgtagatagaactatagcatctactcttgtagaaggaagtatatctgcacttaactatgctactaaattaaatcaatttgttatgggtatgtttatagtttcgatatcttctgttatatatccaatgctttctagattatcaacagaaaataatcaaaagaaatttaaagagtctatagtaacggctataaatgtagttatattaataataataccaatatcagtaggagctataatactagcaactcctattgttagattattgtttgaaagaggaaattttgattctagagctactcagatgacatcaatggcattaatattctattcaataggtatgttaggatttgggttaagagatatattaggaaaaatattctattcactaaaagacactaaaacacctatgataaatggtattattgctatgggtttaaatataatattaaacttagcatttgttaaatacactaatatgcaattaggaggattagcatttgcaactagtatatcgtcattagttacaatttcactattatctttcagtttaagaagaaaaataggtgcatttggtggtaaaaaaattataacggttcttggaaaagctttagtatcagcccttttaatggcatttgtgactagatttacatataatatattagatttaatattaagtgatggatttatacaaaatgctattaaattaggagtttctgttggtttaggagctatagtatatggaataagtataattgttctaagggtaggcgaagttaaattattagtaaaaatgttaagaggtaaaataaaacgtaaataataaataaaaaactacagttaaatagctgtagttttttagttattatatttaaagtaaatattgaattacaatgtcataatttgttaatcatcataatatatattattaatactttctagggggtatttttaatatgaatatatcaagaagtattcgaataactaaaaatagacaaagcaaagtatacacattaatcgctatagttgatgtagtagtactggcagcatcttttggaataataatagcaaattggtagaagaaaaaagcaactatctcctttgagatagttgctttaatttataaaactaaaaattttattatgatttagattaaattatttttaactttgattattatacaaaaatatgtttatataataatatatatctaaggagggtaagatgatgaaatatatagatgatataaaaaattatattccttttaatgaacaagaaagaaaagataaaaatataatattagattgtataaatacatacgaaaatatattaactagagaaaatgaactttgtcatataacaagttcaggatttattgtaaataaaagaagagataaggttttaatgattcatcataatatatataattcttggggatggactggtggacatgcagatggagataaagatttattaaaagttgccataaaggaagcaatggaggaaactggagtgaaaaatgtgtatcccgtaacaaataatatatgctctatagagattttgccagtaaactcacatataaaaaaaggcaaatatgtggcttcacatttacatttatctatagcatacatattagaggctaatgaagaagatgaattatttgtaaaagaagatgagaatagtggtgttaaatggatattaataaatgaaatagataagtatgtaaatgaagaacatatgataggagtttataataagcttataaacaaagctaaaagtttatagattttataaaaaattattaggacttataatattataagtcctaataattttttaaaagtattagaaattttaagacttaagataatccattgcaatctataccacaagacgtaattatattatgaagttttgacttaggacatgattttttagattttgaaatttgataagaataccctttatattcattagaagtttttataaaatatttatatatagataggttgaatatattttcttctaatccaaaattcatataatttaaataggactcttctaaatttggattttttgaaagtaaatcatatattttagattttataaatgataagtcagttataagttgctttgtgtttacatctaattcatcatttataaatatgaaatcacgtgaactattagttagaattgatagagtatcatattgagtatgctttatttttgtcattatagaattatataaaaaaaataaatttcctaattctttttctaattcaaattcgccttttaatatcaaacgtatagatttcaattctttaggggatgaaactttaatttgattacctttattgaaaactatattagtaggaaatgatatatcttcacaatcaatggagttagttaatacaccattttcaactttaaaaaactcatcaccatgatgaatgataaaactttcaccataattataataaagggtctttgttgggacattatctccaaatttaaattctattaaattattataagatttaattattttattattaatcaatgatggataatagaaacattcaaataacataaaatcctcctattttatatagtaataatttgttaaaaaattattcattacttactttaaatatagctaataatattagatatttcaagcttataaatataataaaatagtgttggaagtatcaataaacgacataaatatttgtatggctatttaatataaccagaactataatattagtatataatttaattattatgggaggatttaaaatgaaattcatagatttacattgtgatacaatagataaattaataagtattaaagaagatgataaattaaaaataaattctcattctgtagatatagaaaaattaataaaaggtaactgtttagctcaaacttttgctttatatgtagatatagaaagttgtaaagaaccatataaacattgtatgaatatggctaataagtttcataaagaagtcaatttaaatgatgatttaataagtttggcaactaattataaagaaataattgataatgaaaaacgaggtaagataagtgcattattatcgatagaagaaggtgctgttttagaaggagatatcgagaatttaaataagttttataatttgggagtaagaatgatgacattaacgtggaatcatgaaaatgaaataggatatccgcatattagatctgaatatagttctaagggattaaaagattttggaatagaagtagtaaataaaatgaatgagttagggatgatagtagatgtatcacatttatcagatgcaggattttatgatgtagcaaaaatatctaaaacaccatttatagcaactcattcaaatgctagaaaaatcactaatcatagtagaaatttaactgatgatatgataaaaactttggctaatttaggtggagttacaggaataaatttctgtagtgcatttataggagatactcctaagaccatgataaaagatatggtaaatcatataaaacatataagaaacattggtggaatagatgttatagcattaggttctgattttgatggaataggatgtgaggtcgagataaaggatgctagcgaaatgggaaaacttgcaatgcagttagaaagagaagggtttaaaactgaagaaatagaaaaagtattttataaaaatgcattaagagtaataaaagatgtaatgaaataaaataataaaaagccatgtataaatacatggcttttattattttattaactctaagtatccacttggatggaagtagtatatatgtgaagtattttcatcaacgaaatatcccatatcagtatctacatctggtaagaatatatatccttttaatcctttctcttgtaaagatttaaaattatctgaagttcctttgaatatgtaatttactttattgttattatttattaaaagcttttctgcatcagcttgagttaacattgtttgctgttttacagatgatgtagtatttccttgtgcaaatgatatttcatgagtaggatttattaagaataatcctccaactaatactgataaaactaatattgattttttcatatgtaaaacctcttttcttttttatatttatttatatgattataatttcttttctttatctttctatatataaatattaacatagaaaaattttatataacagttacacccttgttaccttggattacaaaattgtaattaaaaaaatgtttaaaattaaagttataaatcaatacatatactctttgtatatagtattatataataactatatagaaaaaattggtacggagatggttttgtggtaaatcgtataatagcagttgaattgatggaaaaaactagttttttgatagttatcttaatattgattagtaaaataaatttttttaagcgtatattgcaaagtgaacaaaatagtaaattcaatttaattataatctcaggcatatttagtggaattgccattataggaacttacataggtattgatgttaacggatctattgctaatgtaagaaatatagctatagtatcaggtggaattttatttggacctatagtaggtataatatctggatcagtagcgggtatacatagatttttaattgatataaatgggataacatcgataccatgtcttataacaagtataattgctggtgtattgtcaggttatttatgtgataaaactcctaatgataaaaagtggttaattggaattatatgtggaatatttgtagagagtataggtatgcaaataatccttttattatcaaagccatatagagaagctaatttaattgtacactatatatacgtacctatgataatcggacaaacaggaactggttttttaatatctatattacaaagcttaaaaaaggaaaaagaagaaattgcagctaagcaagcaaaattagctttagatataacaaatgaaactctaccttattttagaaatatgaatgaagattcattatataaagtttgtaaaataataaaggatgatataggagctgatgcagtttctataacaaataaaaaaactgttttagcatatgtaggtataggggaagagtattttaaagaaaagactaaaacattaagttgtataactaaagaatgcatatataaaggagatattatatatgtaaaagaaactaaagaagaatattttgctgatcagaaaacaccactaaagacggctatgttaataccgttaaaagaaaaaaatgaaactataggaacacttaaaatatattattcaaaacaaagagaaataacagattctcaacaagctctagctatagggttatcacaaatgatatctacattaatggaattatcaaaacttgagaagataaaagaagctgcaaataaagcagaaataaaagctttacagactcaaattaatccacattttttatttaatgcattaaatacgataacctcatttataagaattaatccagatagcgcaagaagtttaatcataaatttagctacttttttaagatataacttagaatttagtgataccctaatagatataaaaaaagaattagagcaagttaaagcttatgttgaaattgaaaaagctagatttggagacaaattaaatgttatatatgacatagatgaaaaaattaatgtaaagatacctagcttaataattcaaccattagttgaaaatgcaattattcatggaataagaaacaatggaggaaaaggaactgttaaaataacagttaaaaataatgattataagactattgtaagtgtagaaaacaatgggattacaattgatgatgagattataaataaaattaaaaatggaaatatgccagaaaacaaaataggactttataatgttcatctaagaataaaacttatgtatggaaatggattagttataaaacagttaaatccaggtacaaaaatagaattttcaatataggaggattaaattatgaattgtattatagttgaagatgaatttccagcaagagaagaacttaaatattttataaaaaattatagtgatataaaaattataaatgaatttgataatggcttagatgtactaaagtttatacaaaaaaatattatagatattatatttttagatataaatatacctatgttagatggaatgttgcttgctaaaactatagataaatttaaatttaagcctaaaatagtatttattacagcatataaagaacatgcagtagaagcctttgaattagaagcctttgattatgtgttaaagccatactctgatcaaagaataataaatacattaaataagttaaaagatagtgaaattgaattgaaaaataaaagagagtgcaacatagaggaaaaaaaagatatgcatgatactgtaactttatggaaagatgataaaatggtagttttaaaatctagtgatatatattactgtgaagcaagtgaaagagatactatagtttattcaattgataataagtatatagttaaaagttctatctctgaattttacaaaagtatttcagaaaattatttttttaagactcatagatcatatattgtaaatgtaaataaaataaaagaaataataccatggtttaatagtacatatatgctaaagttaaaagatgtagatagagaaatacctgttagtaggagtaatatgccagcaatagctatatcttatgattctaatatttttaatacacttgcatttttatcatttaaacctttactattgctttcaattattctttttaacttatcttttttagagctttcgataaaatatacatatgttatcgatattattattgaaataattattaaatatttatctttcatattctattccttcctattaactttaattatccaaattatatccatatttactaatattaataagctcatatgttgttaaaactattattaaatttctctattactatagttatatttgtgattactctttttgttttggtcaataatataaaataagcatagttaggctactatattaaagtttatacaattgtgtttgcaccataattagacaaacttttatagattgctatatattatgtatttacactattatcaaaaccctaaggagtgattaaatgcttatagagcaattagatttagaaacaagaagtaaaatctatggatatacaaaaaaggtattaagaaaatatcaaaagggaattgtaactggtaaactgactgcagataaatttgctgaaaatatattgtcaaatgaagatataactactatactcgataaaaatataataaacgaactggattttaaaaattcatacataaaatatatagaaacattaataaaaaatcaaaatgaaaacataagtaatttcaaaaaaaataaaaatataaaaccagatataaaatcttctataactcaacaaattaaattaaaaaatttattaattgaaacaggatatgagcttactataccttctcagtacttaagttctagtgatattaataatttatttaaatatatatctacaggaaaaatcgatttaggaaatgagcgaatttttaattacataaaaaaaaatgaaaagcactaaggttaaatatataccttagtgctttttattaacctaatgccttttctaattttgataaatgttgtataggataatatttaagtaattctttgaattgttcaacagtaagaccttcagttgtagtgtatatatttattttcccatctaaatctgcatttataaatttagtttttatttcttcaaagtttacagccattttaatttacctcctatatatgtattatcttttatattttatccatattaattttttttactcaataataataaaaaaggaaggtttaaaaccttccttttctattaactattgttgttgaccactcatttgtttttcagccatttcaactaattttttagtcatgtatccaccaacatatccattttgtcttgctgtcatatttcctttatcagcagtgtcatagtttgacattcctaactcattagctatttctaatttcatttgttttaatgctgctttagcctctggtactgatattgaattttggttgttattgtttgtcatgttgattacctcactttattagtttttgtagtggtttatggagtcttaattttattaattggtaaatttaccttgaacaacttttactccatttttcttttgctgttgttcatgttcttattatgccaacttgtactttttatatacttaaatttataaaaattttataaaaatatataaaactttaaactacaaactttataaagcttattaacaacttatacctgctaagtatccagttgaaaatgctatttgaaggttaaatcctccagtatatgcatctacatctattacttctcctgcaaaaaacaatccttctattaatttcgactccattgtggatgaatttatctcactagtttttattccaccagatgttattattgcttcatctatcggtttataatttcttatattaaattctaaatttttaagtaaatttactaaatcttttctttgctttcttgaaatttgatgcactactaaatctttatcaattccacttaaatctattatataaggtattaattttttaggtaataaatcatctaaactattttcaaactttttatttgtatactttttaaaatctttttgtattcttttatctaacatttctttatctaaagctggctttaaatctactatcactttataagtttcattctcaaaagatttcattctacaacttgctgaccttattacaggaccctctattccaatatcactaaattccatctctccaaagtcttcatatatactttttccttttttatctattacttttatagctatgtttctaagtgataatttgtttaagctatatacatcttcaaaagtttcaagccctattagtgatggctttggcttaataattgtatgtcctaagcttttagcaaacttatatccatctcctgttgatccagttcttggataactaactccaccagttgctattataacactatcacactttattactttattattacttaaaacaacactttctatttttccgtttttttgttctattttttttacattagaatttaacaccacatttactttattttgcttcatttgcttttcaagagctacaacaacatctttagccttatcgctttctggaaatactctttttcctctttctgtttttgttttaactcctagtgaattaaacatgtctataacctgttcgttagtgaaagtataaaatgcactatataaaaatttcccattagtaggagtattttctataagttcctctatatcacaattattagttatattacatcttccttttcctgttataagtaattttctacctagtctttcatttttttctaataatgtaacatcatgtcccatactagatgcagttgatgctgcaaccataccagccgctcctccacctattacaactacttttttcaaatttatcattccttccaaatcttctcaaatattagtggtgctatatccattgcatatatcatcaataaaaaatatcttaaaaatccacctatacaatttaatggcataactaattttaatattaaataaattgcacctaaacttattaatccgaatatatatctaaatatttttaatttcaaacttacattaacattaaaattcacatattctttttctattatatatccgattatatatccacttaataaccctaacattttaacatatttagtactgtttacaataaacatccataatatcataggtattattataaaattaaaatatctatactttttatttttttcaacttttgacattatataattacaaataagagttaatattataccaaatacccatccaaataaaacatctgtaggccagtgaactcctaaatataatcgagatatacctatgcctaaaaatataattggcccaaatatgtacaaatatttatttttaaatatactcatcatactcacccaaaatgtagttcctatttgagtatgtccactaggaaacgagtatcctgtagctgttgaaaccctcatagactctataccatctactccaataggtctttgaaccttaaaaaattctttaacgcctgtatttaaagccacatttcctattaatgcaaataataatctttccccatactttttattgacacaccaatataaaatagatgctactattagtacaactggaacttctgtgctaatagttatagtcaaaaatagtatgtttagtataggatttttaaatgattgtataaattttagtatttcaacttgcatgttcatatactaacttaaacctcccgtcaaataaaactactttcaatacttaattctttaaatatataatattaaatttctattatttatgattatataaaaaaagagtagcataagctactctttattatattccttcatctttaaattctacaactttcttttgtggatttattgcatttataccagtctcttttataaagttaacatcaatatcacaccctaaagataccatcatacttgcttcaataagcataggtaaattcgtaccgcaaaatacttttatgttattgttaaatgctaactcactactaactttaaaaggagtacctcctgctaaatctgtaaatatatataattcgttatcactacatttgtctattatagattttatatcattttttaactcttcaggatttttattttctgtaaaatcaaccacttttataaaatcatagttcccaactattaaatctaaactactttttaaccccgaagcaaagtttccatggcctgttattataatcattagtatattccccctagaataatcctatatatgctcctgctatacctattaacaccattattaatatgtttatcataggacttacatttttcttaactagcccatacataccaaatgttaatccaagaggtaataattttggcattataccatctagtatttcttgaactttaagagatgtttctcctataggtatttcagtaacaatatctatacttacatatgaagctattaatgcaccaacaactatcatacctaatatagtagctgctcttgtaaattcctttgcattttttgttatcttcgttataccttcaataccagtcttatatgaccaatgcattaaccaaaatcttaatcctaggtgaactatattaaacattaataaaaatattataggtcctgctatacttccttcaagcgctaagttagctccaactccagcagctattggaagtaaagtaaaccaaaatattgcatctcctatacctcctaatggtcccatcgctgcaacccttaatgaacgtatagtttgtacatctgctttcttttgttctaaagataaaacaattcccataacaaatgtaattaaaaatggatggcagttaaaaaactctaagttatgtttcatagaagtagataagtcttgtttgtttttgtgtatttttttaagtcctggaagtatagaatataaccaacctccagcttgcattctttcatagttaaatgaagcctgtaaaaacatagatctccatgccatttggtttaaagttttcttatctagagtttcaccttctgttttatctatatattcagtatgaatcattgctttttgttctatattagatgccatcactcatacctcctccaacatttttagtttttatgctcacattaaaatcgtatatagctacaactagccctatcatagctaaagctaaaagtggtaaatttaagtatgcaactaatacaaaacctaatatcataaatatcgcatactctttacttaacataaccttaagtaacatagcaaatcctagagctggcatcatctttcctgctgcagttaatccagtccaaacttgttcaggtaatactttagttaaagtatctcctatcgcttgcccagatagtaaaccggctaaaactattaatgcaaaagctactcctaatattcccatagccatatagtttactttatctattcctttagggttagactcttctgctgctttatcacataatctcattaaaggagacattactgtaaataatgcagttactgcatattgacctaataatgcaaaaggtattgcaagtggtaatgctgcacttgtatctaatcctgatgttatagcaaatatagttgccattatacctcctataacagcatttggaggctgagctccacctacaggcattgcgcctatcatcataagttcataagatccaccaactataagtcctgtgtttaaatctcccattatagccccaactataggacccattattataggtctatacaatgattctaaaaagttaaactggtcaatggctgctataaatgtaacaattaaaattagagcaatttgaacaaaccctatttccataaagctacccctttctatttaaataattcatctatactttcagcagattcacttggaactctcctgatttctagctctacacctaactccttaagctttttaaatgcagctacatcatgatcatctacgcaaactgcttttgaaacttgtcttttaccttgtgccatatgcatatttcctatattaaccttctttataggaacaccaccttccacaagttttaaaacatcttgaggattttcacaaattatagctatatgctgagattcactagctttgtgtattatatttattgttttctctattgtaaaatatctagtttgtgcaaagcttggtgcagccatatccataaggccctgtctaaattcatttgttgctacttcatcatttgctactaataataaattagctcctacactagatgaccacatagttgctacttgaccatgtattagtctattatcaattcttgttaatactatatttggcataataccgccccccactaatattttttatatatacttataatttttaatagcttatgcttaattttatgtttttaaatttaaacttatgatgtttttatcatcttttttgcaaattagaaacataaaaaagagaggtttattaaaacctctcttttttatgttaaacttattttaacttaaaaatgcagcaccaacaattcctgcatcagcgcttaacgtagctataactatatctgcaaattcttcatccttaaaaactacatattttttaattgtatcatttaatccatctaatattatatctcctgatctagagactcctccacctatagatataacttctggatctattgtatttataattgccgctatagattttgctaaataatctttaaatctatttatagtttcaattgcaacctcatcattttctctatatgcatcaaatacatgtttagcagttatatcatctaatctattattaactaatgataaaattttgctatctttcccttcttggattagttttctagcatactttattatagctgtagcagaacagaaagtttctaagcatccattgtttccacaactgcaatcataatagtttgaatctacaattacatgtcctaactcagatcccatattatgtgctccactaaaaactttcccatttattattattcctccacctacacctgttcctaaagtgtacataactccaacatcgcaacctttcatgcttccaactttagcctctgctaaagctgcaacagtggcatcattttcagcatataccttaacatcttcaaacttagattgcaaagtatttataaaatcttgtgatttccatcctaaatttacgcatgtaacttgtccttttttatttataaacccaggcactccacaacctatagattttacatctttcatctgtatatcattttcctttaaaagacttctaactaagatgtttatatcttccattaccttgtcaaatccattttctacatctgttgcacattcttttctataaagtatttttccttctttatctactatacctgcttgtatacctgtaccacctatatctatacctatatagtacatatttgttccccctattactaattaagttttagttataattttattatacattcaaacttaattatctaaaatatattttaaaaaaataatagtagaagattactctcctactactcctatatatggtaaattcctatatctttctgcataatctattccatatccaactataaatttgtcttctataacaaaacctgtataatcaacttttatatcaacttttcttctttcaggtttatctagtaatgtacataattttaaagactttggatttctagtttttaatgctgctactaaattgcttaatgttaatccactatctattatatcttcaactattaaaacattttttccttctatatctacatccaaatcttttaatatcttaactgttcctgatgactcagttgagttaccataacttgaaacactcataaaatctatattaacatctaaatttatatttcttattaaatctgcaacaaatacacttgcacctttaagtatacctactactaaaagttcttggccttcaaaatctttttctatcttgctagctatttctttaaccttttttgctatttcttcttcacttatcattacacctgtaactttgtacatagttgtacctccaatttgccgtatattaatatattccattataacatatcttttttatttttttgaatatttttttgtttttttgatttataattcgtgtttgtattttatttgacatataatttatatatatttttaatttttacatattagttatatattatatacaaatttttatatataattattattataaaaatttttttaggaggtaaattccaatgagtataaatcatggtgctaacttatatgatttatctaataagttaggtttaaataaaaacgagttaatggactttagctctaatataaatcctttaggatcttctaaattagctaaacaagctattatagataatatagatatggtctctatatatccagnnnnnnnnnnnnnnnnnnnnnnnnnnnnnnnnnnnnnntccttcatattttaatttaaagacttcaatttctaattattgtcattgttctagtgataatattcttttaggaagtggggcaactgaacttatatcttcatttatagatataattaatcctaaaaaagcagttttactatctccatcttattcagagtatgaaaaagaattaataaaagtaaactgtcatattaataaatatttttcaaaaaaagaaaatctgtttaaggtagatgtaaatgatttcataaattatataaatagtgataatcatgatattgttattatttgtaatcctaataatcctactggatttgcatttacaaatgaagaaataagaaaaatacttgaaaatactaatacttttattatgattgatgaaacgtatattgaatttactaatacaagtaaatattcttcaactagattagttgatgattttaataaactttttgttattagaggtacttctaaattttttggtactccaggaataagattaggatatggacttacatctgatgatttaataaaagaatcaataaataataagttagatttatggaatataaacacattagcatctataatgggtgaagtaatgtttaaagatgaagattttataaaaaattcttcgcaaactttaactaaagaaagagaatatcttttaaatgaactctcttcttttgatgattttatggtttatcatagtgatggtaattttatattaagtgaaataaaatcaaaaaaaataaaagcctcagagttaagagaacttttaattgaaaaacatataataattcgagattgcaaatcatttgaaggtctagatgaatatttctttagagtttgtactttaagtcataaagaaaatgaatttttgataaaatctcttaatgatatatttacaaaagatgaagagtaatttttactcttcatcctttattgagaaagttacaccttctataatattaggatttattatatcttttttaatttttttatacttttcaatttcttcattaattattccaaagctccaaaaaattacaaataaatcatctataaatccaaatatacctgttatcacttctggtataaaatctattcctgataataaatatacaaaggttattaaaattgcaaaagttactttaaatttacttattatatttacacttttatctgtataaaaatctggtagtttaaataaattaacaataaataaaattccaaattttccatttttaaatctaaccaaagttttcttaagaatatctaaaaatatatctattaatttaaataaaattttcatatatatcacctctaaagctataatttaagattattataacttatatgagtatttcgatgaatatattaaatttataataaatgtataccaaatttatcacattctttaatcatatcttctggccatatacctgcttgtacctctcctatatgagctttatttaaaaagtacatacatattcttgattgtccaattcctccgcctatagtatatggtaattctccatttaataaagctttgtgataatctaattcttttctatcctcacatccagataactttaattgttttcttaaactttcttcatctaccctaattcccatagaagataattcaatagcattatctaaaactgggttataaaatagtatatctccatttaattcccaatcatcgtaatctggacttcttccatcatgcttctctccacaagaaagaacttttcctatttgcattaaaaatactgcacctttatcttttactattttattttctctttcctttggagttaattctggatacatatctaatagttcttgtgaagttataaaagttatctcttcaggtaaaactttttttatttctggatatattttgtgtacatgttcttctgtttctttaaatacggtatatatttgtttaactttagcttttaaagtctctatatttctatcatttttatctattataagttcccaatcccattggtctacatatattgaatgaatattatctaactcttcatcttttcttatagcattcatatcagtatatagacctctacctactgagaaaccatactttttaagcgccattcttttccacttagctagtgaatgaactatctccgctttctttttcatatcagtcacttcaaagcttactgctttttctgttccatttaagttatcattagttccagtttccggtaaaacaaataatggtgatgatactctagtaaggtttaacatttctcctaatctattttcaaagaaatcttttaaatcttttatagcttgttgtgtttctataactcctaaactcgatttataatcttttggtattgttaagctcataattatactctcctcttcttcttttgatattttaatgatttattaaagagtatgacgtcatacattttttaattttagtatatgtggccacaattatacttttttccaataaaaaaaaccttcatctctatataaaatatagggacgaaagtttataatttccgcggtaccaccctgattaactagaccaaaatgtcaagttctctcaataacacagcaagactaatcttagtgcgttccaacttgataacggtttggttccgtctaagcctactctttttacaatttcggttagcaactccaggatgttcttcaatataggcttcgtgttggactctcaccataaccaactcgctcataactacttcctatacctactcttcctttcaaggtcttttaactattttttaaattatttaacgtaattttagttgaatatatgaattatgtcaataaaaatttcaagataataataatttaataaattaatttttatattagaaatatatatttttttaaataatatatatatatattaataaataaccttatttaataaagtattaattatcattaactgtattttctaaaaaatttaatttttctgatttatatataaatatcttaataaataaaaatttatattagaatttatacatctaaaaattctgatatattaaattaaatataataactatgtaataaaaaagatcgctaaagttagcgatcttttttattacatattaaaagttttatctacatatgcttttatttcttctgcagttcccatagttagtacttcattagcaaattttttcatatcgtcatacttaacagaagttatgaactttctcgctggaagtattgatataggggacattgaaaattcatctagacccatacctaaaagtataggtatcattctttgatctcctgcggcttctccgcacattcctacccattttccttctttatgtgcattgtctattaccatctttataagtctaagtactgccggattaaattgattgtataagtaacttatcttttgattcattctgtcaactgcacaagtatattgtattaaatcattagttcctatagagaagaaatctacatgcttagctaatatatctgatataacagctgctgatggtatctctatcatcatacccacttctacatcttttgaatactcaataccttctgcatccatttcagctaatacttcttttataatttctttagcttttaatagttcttctaaagaggatatcattggaaacattattcttaatttaccatgtacactagctctatataaagctcttaattgagttttaaatatgtcagttctatctagacataatcttattgctctatatcctaaaaatggattcatttcttcatccattttaaagtattttaattctttatctccacctatatctaatgttcttataactataggctttccattcataccttcaagtacggctttataagcttcatactgttcttcttcatttgggaagtcatcttctttatccatatataaaaactcagttctataaagtcctacaccttctgcatcattttttaataatccttcaaggtcattaggacttcctatattccctgcaagttctacatgtctttcatcaagcgttgtagaagcttttcctattaattgttttaaagcctctttttcttcatcgaacttagcttttagttgactatatttatttatagtttctttatctggattaactataacttctccagtttctccattaaatactacaaaatctccatctttaattttctctgtagcatcattaagacctactactgcagctatctctaaagttctagccattatagctgtatgagatgttcttccacctatatcagttaaaaaacctaaaaccatattcttattcattgtagctgtatctgatggagttaaatcatgagcaattaatataacttcttcagataaagctgataaatctacaacttttatacctaatatatgtcttaaaactctattagtaacatcttttatatcagctgctctttctctcatatattcattatccatagattcaaatatgctaacaaacatatctttaacttcatttaaagcaaaatcagcatttactttttcatcttttattttagatatagtctgatctattagttctggatctgctaatactaataaatgtgcctcaaatatttcagcttcgtgttcccctaattcttttttaactctttcttttacttgctctaattcaacttttgatttttctactgctttttgtaatttttctacttcaaaatcggtattttctatactctttttttctatattaagttcgctgtgttctataactaaagcttttcctatagctattccaggcgatgcccctgttcctttgtacatatatgtttcctcctaatgtcttctgtatacaatatatatatattcaataaacctcggctttcaccgaggtttcttaatttttattattctccaaatccactttctattaattcaactaatgcatttactgctgattcttggtcttctccattagcacatataacaacttcgtctccttgagctaatcctaaactcattattcccattatagatttagcattaacaactttatcttttgcttttatttctactgtagctttaaattcagatgctttcttaacaaacatccctgctggtctagcatgtaatccacttgcatttttaatagttactgttttttccattgtaatacctccataaatttcatttgttataaataatataattagcacttattaagtttgtgtttttatatcatttattattatatttgttaaaagtttagtaaacctattcctatgaatagaaattataggtctaacttcaaaattagactcccaactcatattagaatttatattagtgtttactacttctactaccttattaaaatcatacaaatttaacctatttatattattttcttcaagcttcttttcataaatacaataaaataaatctttgtatgaaaactcttttgataaatttaaactttctcctaattttggtattatagcttctaaaagagttcttttatttatatctctttttatatttagtaatttgcataggctttctatagaatctttacttaaattactaagcttatcaaaacaatactcatcatcatatttataatccaagttgaaataatatcttattccatcatatctgttaaaggttttcatagcatccatgtatcccaatttaatatttttatgcacattatctggatctacatttaaacacccacctaaatactctgatggaactataactttcatattcatatctttatgatgatttaaatttacttttccaaataagtcatcaattaatcttattacaactatatcttcatatcctttttcccttaataaacttacaggtatattattatgaaatacgccatctaggaacaacttatcatctaacttatctaatttaaatataggtaaactagcacttgctataagataatctaataattttccttttggtatattctctataaacataggatttggaactattttaccatcccacataactgtaactaatccaaaatctttatttgaatttcttattaagtcttcatttatagttttttctaatagatttctaaatggacttatatctataccttgattttttctagctttatttatcaaagagattaccatatttaaatttttaggcgtaaaatcaatattttttatgctgtgatatgtttcttcatcaacattcataaaatgagtatagtcataattagtccatatatcctctaaaacttctatattatcttgaactatataagccccatttaaagctcctatagacgttcctgctacacccttaaattctatgcctaactcccttaaagctttatatgcacctatctggtaagcaccttttgtgcctccaccttcaagcactaatcctttcataaatatcaccttaattaagttataaagatatatattcctcaaaacaaatatattacaagtttcatggtatttcaagtaaaaattatatttttttataatatttattaaattttaattttataccttattctacatatcctattaatccttagtattttaaataaaatattaaaaatatttatattttcaatttatagttttgtttaaaattattttatatccgatttagaattaaattcaatagtagataattcactattgatatatttatataacgaatatcttttaaaagatgagtattacttaaatgaattaaaaaggaatataaattatctaatagtagatagtttagaaaattgtccagcatgcgaagtcgatttaatatctaaattactagatagtgtatatgcctcacatatttatattaacgaaactaaagattatgcatcttttaataatgtagatatgatttacacaaaaaaagagatatttaaaaaatgtaaggttatagaaaatggctatattgaagatgtagatataaaaaaattaatcaatttatctaaagatataaatttaaatcaaagtaatcaattatatagcgagatggtagtagagtcaatcaataaagttatacagcttataaaagatggatatgaaccgaaagatatagctataataagtcctgtaaatagtactatattagattatcaagttaaaaatattttattaggaaacaaggtaaatgtttataatacaaaaaaagataaacgaattattgattacccttatgcacatgcattaatggtggcttcatgtatattttatgaatgcgaagaattattaaatgaagaagattatatatgttttataagtcttttattaaataaaaataagattaaatctttaaagatagcaagagataaatatacctgcaatgaatatatagatttactaaattatattgaagataaaaaagataaaaatataagtatagatgagtttttaattaaattttatatagataagttattaaatctttcaagtggaaaagaaaatgtaaagatttgcaaaaaaataattcaagaaagtgagaactttacagataatataaatttattaggatttgatagaaataaaactaaggaaaagatttttatagaggcactaaaaacaagtataaaagattattactctctatctgaattagaggagtttagtgaagaaaactctatagtaatgactacaccatatacttatatatcacataatatgaatcatcccatacaaatatggttggatataggaagtaatatgtggagtatgaaatctgaaaaagaaataagtaatgtacaagtacttaaaaaatcttttgataataatcaaatttatactgaagatatagaagaattctataaggaatactatttatacaatacagtatataatttattattaaacacaaaggaagtatatgcatacaaaagcgaatacacagtaaatggatatatacaagaaggacttttatatagtctgattttaaagttaataaataaaggtgatttcaatgagtaaaataaattacagagaagatcaaatacctataattaattatgagagaggcactatggcagtcccagcagttccaggggccggaaaaactttcatagttacaaatttagttgctaagttaataaaagaaggcatgaataaacctggtaaagtacttatacttacatatatgaatagtgcagttaataattttaagggcagaatagctaagttattagaagaaaatgatataaaagaaactaattcctatgaagttatgactatacatagcttagccgtaaagataataaaagaaaaacctgaaatagttatgttaaatgaagagtttagcatagtagatgatttaaagaaaagtataatattaaatgaatgtataaacaattttaaaaataatggaggagaaaaagctttcaacttctttgttaaagaacaaagagatgatgaatggaaaaatagatgcctagaagcatggaatcaaggtttctttgatttagtagtaaactctataagtgagttaaagtataaatatatttcgcctcaaaaactagaaaatataatattaaatggacataaaggaatactaaagtgcattttacctatatataaagagtatgataggagattaaaaaataatggacttttagattatgatgatattttaatacttgcatatgaagcacttagtaatgatgaagatttgaaaattaaatttcaaaatagatattcatatatatttgaagatgagtgccaagattctaatgaacttcaaggaaaaataataaaattaatatcagaaaataataataatctagtaagagttggtgatgttaatcagagtataaatggaactttttcttcttcagacccaatattttttaaaaattttatggaagaagctgataattgttacaagatggatatgtctaatagaagttctaaagatattatagaattagcaaatgaattggtagaattaataacaaaagatttttatttagatgattgtaaaagtgctttggagaaaatggaaattagaacagttccaaaaggcaaaggatataaggaaaatccaaagacagataaatacttactgaatgcaaaatggtatgaaacttgggaaaaagaaatatctcaaactgttaaatttgtagaatatataaaaagaacaactccagaaaaaagtataggaatattagttccatttaataatcaagtaagagaagtagcggaggttttagaaagtcataatatagaatttgatgagcttggcccaaattcatctcataaaagaaaagtcataaatagtataggatatatagttgattttttagcccagtgtgatgatgttaataaattagtaaatatatttgataagatatatattaatacagataataaaattggaaaagatgagtttttatctaaattaaaaaggtatgatgttgaagatataatatacgatacagataatgtaatcaaagatattgtaatagataacaaagatgaaatatatattgattttataaatggtataaataaaattaaaaatatgttagattacatatcagtaaaattagatgagctaattttattaataggagagaacttagatataagttgtgaagaaaaatcaatggtatattatatagctttttatgtaaagcatttaactttagataatccaaatacaagtttatatgatataggtaaaatcttgttagatgatagaaacagagttttcaactatataagtgagattatatatgaaataaatggatatgaaccaaaacctggtggaattactgtgtgtacttatcataaatcaaaaggaatggaatgggatgttgtatttttacttgatttaactgaatttaaatttccggcagatataaatcaaaaattccaaggtgaattatggtatttaaaagataagtataaaaatccagtagcgattgctaaatcagaagtagaagctattttaacaggggaaaaaccaaaagattttatgtataaacataaggtaaatataataaatgaaaaaataagattattatatgtgggtataactagagcaaaagagatgttaatgttatctggatacacttacaaggataacaatttaaataaaaagcaacaacaaaagccatctttttattttaataagttaggtagatttataaaagaaaaaaggggtgagttagttgaataaaaaactagataattttttatatagtcaaaattctataaatacatataagaattgccctttaaaatttaaatttaaatatatagataagctaaattggaagcaagatgatgaagatagcagagaatattatgaaaatctcaaattaggtacagattttcatctaatatgtgaacgatattttagcaatataccaactggaatagaatatgcagataataaagaatttaatatatggatggataaaataaaaagacttgtgcctataaagaagaataaaatgtatcttcctgaatatgaagtaagatatagattaggagatattaatatacaagcaaaatatgatttaatagttttggatgaaaataatatttgcatatgggactggaaaacagaaaatagaaaattggaatataaaagtgttgaggataggattcaaactttagtttatctatttttatgtggtgaagttgtgaataaaatacagaacttaaatttagagtatgagaatataagtataaactattatcaaccagaatattacaacgagccaataactattagatacagtgaagaaagacataacaaaattaaaaaacaaatagaagcttatatagataatataagaaatacaaattacgatgatgagtgtagtataaaaaatactaagcattgtaagttttgtgaatttaataagttatgcaacaatgaagatataaactatagcatattggaggatgaaatatatgagtcttaggtttatattcggaagaagtggtagcggtaaaacaacatattgtttaaatgagatatcaaaaaaggtaaatgatggagacaccgctcctataatattattagttccggaacaatatacatttgaaagtgaaaaaagattaagtaaacatatagaaaaggacccttatcttagagcaagggttcttagttttaaaacattaagtaacatagtattttctcaagttgggggacttacagatataaatataaatgctagtggtagatctatgatgatttataaagcattagatgaagttagtagtgacttacaaattttttctaaagcatctaatcaaccaggatttataggtactatatcagatatgatatctgaatttaagcagtatagcattacatcacaagctttagaaaatgtagcaggagaagttaatagtgaaacacttaagttgaaattacaagatataagtaaaatttatgataattatgaaaaaatattacatgaaaactatatagactcacaagatttattagcatcactagcagataaaatagaaatgtgtagctattttgacaacgcaaaaatatatatagatgaatttacaggatttacacctaatcagtatagagtaataagaagtttactattaaaggcatctgaagttaatataactttaactttagataataatttagtaaaaacctacaataaaaaagatgtgttttcccgtactaaatttacagaagaaaagctaagaaaattatgcttagagtctggaattaatataaaacctgatataagtttaaatgcaactaaaataaaaagatttaatgggaatgaagagttagaacacctagaaaaaaattatttctcgtatccttataaagtttatgaagatgaaactaaaagtatagctataaaggaatttagtaatttatattcagaagtagagcaaatagcaaaagaaatagtatttttagtaagagagaaaggtattagatatagagatataactgtagcaaccagagatttaaatagatatgactttttagtacagtcaatatttaaagaatatgaaataccaaattttatagataataaaacagaagctaaaagcaatcctattatagttttaataatatcagcactagaaatgcaaagtagaagatataattatgaaacaatgtttaggtatataaaaagtggtttgttaggaatagatattgaagatataagtttacttgaaaattatgttttggcaaatggtatacgaggaaagaaatggtttgaagagaagtggaattacagagtaaatcataggttaaatgacgaggaaaatgaatacgagatagaaattatagaaagagttaatgaaataagaaaattaataataaatcctatagttaaactacaagaaaaaataaaaggtaaaaataaagccaaagatatatgtaagtatatatatgaatttttaatagatattaatatgccagatactataaagaatatgatagataattttaaatcaaataatgagatagatttagctaatcaatattctcaggtttgggaaatagtagttgatatattagatcaaattgttgaaatcatgggagaagatacaataagtttagataaatttattaaagtaataagtatagggtttgatgaatatgagttggctacagttcctccaagcttagatcaagttttagtaagtagtgttgatagaatgaaaaatccaaatactaaacatttatatctaatgggaactacagatgggatatttccattaatatcaaaagatgatgggatattaaatgataaagatagagaaaatctagaaaacagtggtgtggaagtagatatagatagtaagacaaaaacgtttgaagaacaatttttagtgtataaagcattgacatcaacaacaaactctctaacaataacttatcctatagctgatcatgaaggaaaaactttaagaccatctgtaatagtttctagacttaaaaagattttcaaaaatattaagaatgaaagctatttaagtgatagaatttataacactagtgaagatatagttgaaaatataactacaaaagcaccagtttttaatgaacttataaaatctataaaagattttgaagaaaataaagatatagatcctgtatggctaggtttatataaatattatatacaaaatgaagattatcatattagagctaaaaacatagtggacggactaaattatactaatcaagttaagaaggtagaaagtgagaagataagagaattatataataataaattatttagtgtatcaagacttgaaaaatatgctcaatgcccatttgcatattttattcaatacggtcttaaagcaaaagaaagaaaagagtttgagtttactccacctgattttgggactttcgttcataatatattagacaagttttcaaaacaattatctaaagataatttagattggagagaaataactccagaatatatagttgataaagttacaattatagttgatgaattaatatcaaaaatacctggatatatactagaaagttcagcaagatataaatatctatcttatagattaagaaatatgcttatatttgcaatatctataatcagtgaacagataaaaaaaggatcttttgaccctacagattatgaagttgagtttggtgtaaaaggaaaatatcctccgattaaaatagttttagataatggagaagagataaacttaataggtcaaatagatagagtagatatgctagaagaaggacaggaaaaatacataaggatagtagattacaagtcaggtaataaaaatataagtcttacagatgtgtattatggattgcaacttcaattattggtatatttagatgcaatattagaaagttcaaaatataatgatggaaatttaaatcctgcagcaatactttattttaaaatagatgatcctataataaaaactaatgaagatatggaagatgatagtataagagaagagatattaaaacaacttaaaatgaaaggtttggtattaaaagatagcaatgtaattagaaaaatggataatacattgccagaaggggataaaggaacatctttagtagtacctgcctctataaataaagatggaacaatatcaaagactacttctggagtaaatcaagaggaatttaatgtacttagaaagtacgtaaaacatactataaaagaattaagcaaagatatgcttgatggaaatataggtataaatccatataaatctaaagaatcaacatcttgtgatttttgtagtttctcatcaatatgtcaatttgacagtacatttaaggataataactatagaattataaataaaaaaagtcaagatgaaataataaataaaatgagaggagaggttgagtagatgagttctcctaaatggacagatgaacaacaagctgttatagatagtagaaattgtaatttacttgtagcagcagctgcaggttcaggaaaaacagcagtactagttgaacgtataatacaaataataacagacattgaaaatccagtagatatagataaactgttagtagttacatttacaaatgcagcagcctcagagatgagagagcgtgtaggtgatgctatagctaaagcattagataaaaatcctgaaaatagtcatttacaaaatcaattggtacttttaaatagagcaagtattacaactatacattcattttgtttagatgtaataaaatcaaattttcataagataaacatagaccctaattttaggataggggaccaaacagaatgttctcttttaaaacaggaatcaattgaggaagtttttgaagagtattatgaagctaaagatataggatttttaaatttagtagaaagttatgctgaaaaaagaggagataaagaattacaagaaattattttatctatatataactttgctatggcttcaccttatcctaaaaaatggttatatgattctgttgagctatttaatatagatgataattttgatttttcaaactctatatgggcagagtctatattagataatgtgaagatagagataaaaggaatagaatctagcatgagaaaagctagagattatgtagatggaatagaagaattagaaagttataaagaaaaacttaatatagaatactctaagatattagaaatattaaatgcttgtaatgaaggatgggataaagcgtattactatatgagtaatatgcaatttgaaaacttttcaaagggagtaaaaagactttcaaaggatactccagaatatataaaacaagcaagagagagtgctaaatctataagagataaaaataaaaaatctttagaaagtataataggatctaccttttataagagtaatagtcaagtttgccatgagataaaatatttatatccagttgtaaagtctatttcagatttggcaatatcttttgaggaaaagtatcaagaaaagaaaaaagaaaaagggattatagattttagtgatatagagcattttgcgttagatattttaactgacaaagatgaagaaggaaatgttattccttcagatgtagctaaaatatatatagatagattttcagaaatatttatagatgaatatcaagacagtaatttagtacaagaagttttattaagtacaattgctaaagttgaaaatccaaatagatttatggttggggatgttaaacaaagtatatatagatttagacaagctaaacctgaaatatttcttgaaaagtatgctaactatgatactgaagaaggtagcaaaaatagaaaaataatgctttacaagaattttagaagtagaaaagaagtagtggattcagctaactatatatttgaaaatataatgagtagaaatataggagagattgaatataatgaaaatgaacgtttaaatttaggtgcaagctttaaagaatgtgaagaagaaaatgctatagttggtggggctacagaaatacatttaatgcaaaagtctagtaaagttgaagaaagttctgatgaagaagaagagagagaagaaatagataatatacaattagaagctaggatgataggaaagataataaaagacctggtaaagcctaatgaaaatggacaagtaatgaaagtgtatgataaaaaactagattcatatagagctgtagagtttaaggatatagtaattttattaagagcaacatcaagctgggcaccggtttttgttgatgaattaatgaatatggatataccgacatatgcagatacaggaatagggtattttgatacaatagagataaaaactattctttcattacttcaaataatagacaacccaatgcaagatatacctcttattgcagtactaaaatctcctatgtttggatttacaccagaggaacttatcgatataaggatagaagatagacagaaaagtttttatgaggtattaaaactaacttgtgaaaaggataatgaattaagtaataaagttaaatattttatagataagttagaagattttaaagaaaaatcgttatatatgagcactgatgaatttttatggtatttatatatagagactggatattatgcatatgtaggagctcttccagctggaactcaaagacaagcaaacctaaaggttttatttgaaagagctaagcaatttgaatcaacaagctttaaaggcttatttaactttataaactttataaaaaaattaaaacgctcaaattctgatatgggaagtgctaagacattaggagaaaatgctaatgtagttagaataatgagtatacacaagagtaaaggactagaatttcctgtagtcatatgtgcaggtatgggtaaaaatttcaatacacaagattttaaaaagaatattttatatcaccataaattaggatatggacctcaacttgtagattacaatagaaaaatatcttatccaagtatcgcaaaagaagcattaaaaactattataaatatggaaaatttatctgaagaaatgagagttttatatgttgcatttacaagaccaaaagaaaaattaattataactggttcaataaaggatatagattctagtataaaaaaatggggcgaagatatagaaaatattggtccagtttcagaatatcagattttaaaaggtaagagtttcttagattggataatgccagcagttttaaagcataaaaatttaagcaatataagagagttaataaatatagaatctaatgcttttaatgaacatgaatcaaaatgggaagtaagagtttgggataaaagtgatgtattgatagaaaaagaagatattgaggatgaggaaaccatagactctatactattaaatatggatttagataaagataacagtgattactttggcttaataagtaataaattagattataaatacccatttatagaatctgtaaatagagcagcaacaatatccgttaccgaaattaaaagattagaaagtcaattagaagaagattatatttctaaagagttaataagtaaaccaacagaaataaaaactccactttttatacaagaaagtgaaagtaaagataaaattacagcagcccaaaaaggtactataatgcatttatttatgcaaattgtagatttaagtaaggtaagtaatttaaatgatataaaagaagaaataaatttagcagttaaaaagaatattttaactcaaactcaagcagatactataaatccatataaagtattaaaatttttcaaatctaatttaggaaaaagaatgctaaaagctccatttttaaaaagagagcaagctttttatctacaaattggtattagagatatatttgaagcagaaggtgaatttaaacatatcgtcaatgatgatactttaatggtcagaggtataatagatgcttattttgaagaagatggtgaaatagttatagtagactataaaactgattttgtaaatgaagaaaacaaaaatgaagttataaatagatatacaaaacaacttgaaatatatagtaaagctttaaatcaactaacaggaaaaaatataaaggaagtatatatatatttatttgggttagaggaagaaatactttataaactgtaggaggaatattatgaggtttatacatacatcagattggcatctaggtaaaagtctagaaggtcattcaagattggctgagcaagaaaagttttgtaaagattttattgatttggttaatgaaaatgatatagatatggttattattgctggagatatatatgatacatctaaccctccggcacaggctgaaaagttattttataaaacagtaagtgaattatctcaaaatggaaaaagatgtgtgcttattatagctggaaatcatgataacccagagagattatcagcagcaagtccattagctcatgaacagggaataataattttaggtatgccaaatagttatacacaaccttataagtacaatggatttgagatagtttttagtgaagaaggagttgtggaattaaaaataaaggatgagagtgtagtcatatctacacttccttatccaagtgaaaaaagattaaatgaagttttagtaaaaagtacagatgataaagataaacaacaaacttatactgaaaaaattggtgaaatctttaaattaacaactaaaagatttaaagaagataccataaatatagcagtatcacatttatttgttttaggaggagagactacagattctgaaaggcctatagaattaggaggaagtcttattgtaaatactaaggatttacctcaaaatgctcagtatatagctctgggacatttacataaaccacaaaaagtatcagaaagacttaatgcatattattcaggatctcctcttcaatacagtaaagatgaaagaagttatagtaaaggagctaatatagttgatataaaagcaggtgaaaaaccaaaaataaatcaaatatattttaaaaattataaaccaatagaagtatttaagtgtagtggaatagaggaagctttaaaaatatgtgaagaaaataaagatagggatatatggtcttattttgaaataaagacagaagaagtattagctcaatcagatataaaaaagatgaaagatacattaaaagatattatagaaattagacctataattacatctaatgaacaagaagaagttattgatatgaaagaaaaatctatgggagaactttttaaagaattttattcttttagtagaggtgttgaacctaagggggaactaatggatttatttttagatatagtaagtgaagagggtgaggacataaatgaggccaattaaattaaaattaagtggattaaatagttatgtagataatcaagttatagattttgaaaaattaacagaaagaggtttatttggaatatttggaccaacaggtagtggtaaatcgacaatattagatgctataactatggctatgtatggtaatataccaagaaacactaaagagtatataaatagtgctagtgacaaagctaatatatcttatgaatttgaaataggaagtaaagattttaaaagaaggtatatagtggatagaactataaaaagaactaaaacagggggtatattgactagtcactgcagattagttgaaatacacaatgatgaacaaagtactgttttagctgataaagcaactgaagttaataaaaaaatttctgaagtagtgggacttacagctgacgattttacaagatcagttgttttgccacaaggaaaatttaatgattttttaaagttaacaggatctgaaagaagaaatatgcttgagagaatctttggactagaaaagtatggtcgaatgttaattgataaagtaagacaaagaaaaagtgaagaaaataaaaatttacttatcttaaatacaaaactaggtggatatgaaggaatatcggaagaagaatataaaaatgtattaaatgaattaaaagaattaaatttaagtgaaagtaaatataaagaagaattaaaagacatagaattaaaatttgaaaagtgtaaagatatatatgaaaagcaattagaacttgaaaaatatgaacttgaaaaaaaagaaatagatttaaaatcaaaggaaatagaagataaagaaaataaactagaagatgcatataaagcagaaaaaattaaaccttatatagaaaatataagttctttagaaaaaagcatagataaagataaatgtattgtaaaagatatagacaatatactaaatattgagaaacaagaacttatattaattcaaaaacaatatgaagaaataaaaaataaaaaagatacagaattacctagattaagtgaaaaaaaagtaaaacttgaaagagctatagaacttgaatctcaagtagaagaattagataaggaacttttaatattaagagctgattataaaaaattaataattgaaaaagaaagtttagacaaatctaaaacagaattaaactcaagcaaactatctattgaaagatatattaatgaattagaaacaaaaagtaaagatttacgaatttctgcagatttgaaacaaaaagtatttttagcttatgatactgaaaaagaatatgaagtattagatacccaaattaagaaaagcatagaaaaaagggatatattaaaaaaagaactttcagaaaaagaatttgattttagaaaatcaaaaaaacataaagatgatataaacaaagacttagaagaagcgataaaaaaacaagaaactataaataataaatgtccaggagataatgataatataataaaaaataatgagtctttagcaattcttagaaataaaatagaaattttaaaagattataaagatagaaaaaaaatagtaaaagatgaattaaatacaatagaagaacaaaaatttaaagtagaaagagaaataaactcaatagaagataaactagaaagaaaatctaaggaaatagaagacttagaaaaagagttaaacaatttaagatatattaacttagctaatgaattaagaaaagaattaaaagagaatactccttgtccagtttgtggatctactcatcatgtgaaatttgatttaactaatacatcaagtcaagttgagtatacaagttcaaaattagaaaactataaattagaagaaaaatcattaaaatctaatttagataaatataatataaaaaatagttctataaaatcagcatatcaaattaaagaaaaagagttaaaagaattaaattttaaaattggaaatgataatgtagatgaactatctaggaaatataatgaagagaaaagaaaattggatagtttaaaagttaatgtagaattatggagaaaagataaagaagatatagataaaaaagttgcaaggaagataatgacggtacttgagttcgtttctgatatcataaacatatttttctatagtttcttccaaatctataggtacttttaattccttatttaaatttaaattatgataattaatttttacagctttatatacatcttctacgttttcaatatccacatcattaaacatatttaatttttctaaaagtgattttctctcttctttagttannnnnnnnnncagtcctgtttttatatacttgaattactaattcttttaacacatcatcttctttgtccctttttaaattgtatataacctcgtatatttctttaatatatttccttaatgcttttaatacttctattgtcttcataattctccccatatttttaactaaaataaatatttgatatgaataaaaagattagatacactgtttgctatatcggcatttataaaaatctctttagtgtataataaataaaagcttatctaaaataatagttactttcaattaattattttagataagctttttaatatattttataatatcattgcacctattactccaaatattaacaacggtatattataatgtataaatgttggaacacaagtatcccaaatatgatcatgttgtttatcagcattaagccctgctgttggtcctagtgtactatcagatgctggagagcctgcatctccgagtgctcctgcaactcctatcaaaagtattattgcttttacactaaatcctaaactaacccctaatggacagtatatagcagctattataggtaatgttccaaaagaacttcctatgcccatagtaactaaaagtccaactaaaagcattaataaagcccctataagtttactattcccaactaaacctgaaacagatgctactaaactttcaacagctccagtttctcttaatacactaccataacctgcagctacgagcatgataaatcctataagacccatcatctttaccccaccatcaactaattcatctatttcatcaaatttgatagctccacttacaaataacactattatcgcacaaagacctccaagaggtaatgatcctgttaaaatttgtacaataaatgcagttacagctcctaaaagtgcaaaccaatgcttgctagtcattttttcttctatttcattttcttcaatctcttctatagttttatctttataatctcttggctttctataagttataaatacagctactaataaacctaaaatcattcctattgcagctatccacattacactagtcaccatgcctgtagttatttccattccattagctatcatttgatctcttataatattttgaaatattaatccaaatccaaccggaattgcaatatatggagtttttaatccgaaggttaatgcacaagctacacctcttctatctatttttaatttattcataagacctaaaagtgatggaattaatatcggtataaatgctatgtgtactggaataagattttgtgaaaaacatgacatgaacgctattaataagataagtgttaattttttgcccttaactattttagatatttttttcgctaaaattgatgcaagccctgttttgctaactgctacagctaaagctccaagtaatatataacttaatgctgtttcggcatttccccccattcccccaactaaaatgctcatagtatctcctattggcatacctgaacaaactcctgcaactattgctgatacaagtattgataaaaatacattgaatttaaataaacaaagaactatcattacagcaatagaaatcactactggattaaataaaaccatatataatcccccctttaaaattttaaaaactttatattcattatattctgaaaattaatatattattataataatatattaattaaaaataaaaaataattattatagaaattaaaaaagacccctaatcgggatcttattaaagacaatttataattataatatagttatgttttctgcttgaggacctctagcaccttcaactatattaaagcttactttttgaccttcttctaaagttttgaatccatctttttgtatagctgagaagtgagcaaatacatcatctccaccttctactgatatgaatccaaatcctttttcactgttaaaccattttactattccattagtcattgaaatgttctcctaaatacctacatgaaacttttgcttcatttatttaatatcagtaatctttttaactactgtaatacttattataacacttatttcaaatatgtatacgttttttagaaatatttttatgtttttatttttttgcatttaactctcagtaaattaaacataataaaaagctagtaaaaattactagctttttattatgtttaattagtctctactatttaataattttatacttacactatcagatatacattgatcttcagctatattatcaaaaaaatcttgtatatcttcatattctgtgtcttcatctatacttaatctatattcactatcatcttcaaatccaaatactatattatctgtatcttcacagtaccataaaaggtcttctgttatttgacaaagtcccataaaatcaacttctttagactctccctgctctataaattcaaatcttaaatctgctatatctatcatttttgcctcctgatgctaaaaccttgtgtctaaattctataatttaaatttttgctaatttatttacagtattataatataacaggaatctacaaattgttcaatcaaaatattagttataatatatttttcaattatttgttttttgttttaattacatctatcgcaaggatcacttttacctgattcagattgtgttccagaaagtatagttttacttttacttaatgcagaacattgtttagttgtatgatatgactttccgtttggtgtccaataaacaatttttcctttattttttacaggttcttgtgctaacttttgtaatatttttggctttgtagctgatatattatttttagggtgtttactatagttcttatcacttgaattatcattagaagtaactatatatcctttttcactgccactttcataacttccttttttacaatctacttttaagccatttccagtagatataaatattatatttccacactcatcacttctatgtacttcgatatttttactttttaaagtctccatagtttctttatgaggatgtccatatttattgttttcaccagctgttataacagcatattctggatttactttatttataaatgaaggagttgaactactatgagatccatgatgacctacttttaacaaatcaacatcttctacatttatcttagattctatttcagactctgcatcccccattaaaagtactttatcatttccatttgtatattcaagtactattgaattattattaggatcatcactatttgctacagataaaactttaaattttgatgttcctaatttaaattcactatttaataacggcacactaggatgtaatcctttatttgccatagcatttataaaatctgaatatgtttttgaatttgcacttccattactcacatatacattttttacaggtatttcttttactactgcatcaagtccacctatatgatctgcatgtggatgtgttgcaaatacatattctaattctttaacaccattatttttaagataatttacaactctttgttcatcatcattatctccaccatctattagtgctgcttgatttccttgttttataagtatagcatcactatttccagtatttataaagtgaagttgtgcttcttgattttctgtatttaataagttttcattattataagcttttacattagttttatttttaacttcagtaattttatcttttgaacaacctgatattgatataatcacaaatataattatcatcggcgttataactttacgaaatttttttaaaatgaccattatcttcctcctaatatgtttttagccgtatattattgtaacatattgtatataaatagcaataaaagaagtatgcagaaaattttctacatacttcttttattaatcaattttttatttaatttttttaactcataccttaatatattaaacatatccttaataattaaacatatagggataatcataaaaactatcataaaattataatctatagcttttaatattttaaatctagataaattaaaaaatgacctagtcattccacaaccaaaacattttttctcaagtaaattataccacaggcaaaaacttctgctttcgataaaactaataggtatagaatatatagttataattcctgttatatatacacacaacctaattcttttaccactgaagagcttcgccattttcatctgttatcttatctaatattattaatataaagtctacaatcacccatatacaactaattatagtagttattccacaagtaactattccagataaagtaagtgctagtataataaatccttgagaattatcacctacataaaatctatgaactcccattgttccaaatatcaaacatagtactatagctaataatttactcttactacctacagaaccaactttagaatttgatttatttatactatttataactgaaaacttgttatttaaattaactccacaattaacacatacatctgcatttttatcagtttcttttccgcattctggacaataagaatttccatttcctcttttaaccccacatttagtacaaacagatgcttgtgaactcatttcattagaacaatttttgcaatatatatttttattattatttgtattctttggtatatatggcttatttaattcatttccacaatttatacaaaattttgaatctttattagtttcattcccacaaaacttacaaaagctattgccatttcctacttttactccgcaattagtacaaacattagcattttcatttaacttacttccacaatttttacaatacaaaaactctcccccttaatagccttgctctaaactttttataagttcaacgttatacctttctatcgtatttaattcatttatactcccattaaaatttggatttgggatataccaactagtattgataaaataattgaaatattcatctttattaaagatatatccatatcttgcaaatatctcatttctaattaatgctaattcatgtttactgtatttatatagttccgatttagttagatatctaatatgactatcatatataatatattcattattattttcatgtaagttatttacttttatatgttcattaattttttgattttgaatttccattagcttattataatatttaaaattttcttgtttaaaattatattctttagcttttgatagatattttaaggtttggtcgtaatctccattctcaaaacgttcttctgctttttttacataattttcaatatacatactactcaaatctttactatttaaaatcttttctaatttaattagttcttcttcaaaacttctacattcacttacttcttttcttattttctccactaactcttctgtatatttaatatctatagctttaatataataatcaatagattttatattagaactttctatatctccttttttaatataataacttaataaaattgtatctttaagtgtgaaaaataatattacagatattatccctaaaagtaataaagccacaactacttttgataagttatttttctttttcataggttttttatataattctttagtagtatcataaccacatccatcacaaaaacgagcttcttgttctaagattttgccacagtttttgcatgttttcacaaactatcccccctataaatatattatataacctttatattatattaatgaatacatatacatattccatttgaaattattatatataagctttgattttatgatattttaataaaaaataaactacctaagttaatatactaacctatattttagttagaatactatcattaagtagtttatttaaagttattttaaacaatgcatatattctttagcttctcttccttttactatatatccttgtcccttagaacagaatatagaatttgaagtatactcactatcactgtctttatcataatttctattttctaaaatttcatccctattatgacattcatcatatccatcaaatataaaactgatgcttccagttcccttactaaagctaattaattccaattgatagtccataaatgtagatacaggtcccctaccttctataatacacgtttcttcacttataataggatctttaaaagtaccactcattttttgtatatcagataatactcttcctatataatcaatgcctatatcaattttaaatttataaaatggttctagtaataaattgtcaacttgttcaagaccctgccttaacgccctaagagtcgcttgcctaaaatctccaccactagtatgtttagtatgtgctcttcctgtaattagtgttatattaatatctgtaagaggatatccaccaagtattccattgtgttctttttcaaatatatgagttttaattagattttgatgccctatagttaaatcatccacatgagcattgcttttaaatataatcccactatttctagtagatggctctataagtaaatgaacttcagcataatgtcctaatggttcaaaatgtccatatcctatagtttttacttttaaagtctctttatataatatttcacatttcccaaaatctacatatatattaaatctattcttaactatctcttttaatatttctagctgtatctttcccataacatgaatatgtacttcttttaaattttcattccattttacatttaatgctggttcttcatcatttaatattttaaatacatttaacacttcttttatattaaggctttcatcaaatttaattttagacttaagtgttggtactatatcaatttctttatctatactgtaattttcgtaaaatttatttatatctaaatttttatctaatatatattcatttggcttaatattagttagtcctgtaaccgcaaatatttgacctgcaaaaacttcattgacattttcatatttatttgaattatacactcttatattatttattttttcagtaattacttcatcctttattatatatttaagttcgtctttaacttttaaattcccactaatagcttttatataagttaatctatttttattttcgtcatatctaactttgtataccttacctataaaattattatttccttggtaattggtatatgtcaaataatctaacttttttataaaatcttctatacctatatcttgcaatgctgaacctttaaaaaatgggtatatatcacaattttttatactttttattaatttatttatccaaagttctttatcatattctccatttaaatatttatcaagtaattcttcatctctttcagctataaattcgataatttcttcacttaaatttatttcattgtctatattcaaattagtgcttatatctattacatcttcacttaaatttaattttatatcttctattaacttctcaatatttgcaccttctctgtctattttattcccaaagaaaaatacaggaatattatgttttttaagcaacctaaaaactgttttagtgtgtggttgtattttttctacagcacttattattacaattgcataatccattatacttatagctctttccatatctggtgaaaagtctatatgtcctggagtgtctattaaattataatttgagttattatatataaattttccttgttctgaaaatatggttattcctctttgcctttctatttcatgattatctaaaaaggtatctttattgtctactctccctctgtttctaattgactttgtatgatatagtaactgttcacaaaacgtggtttttccagcatctacatgagctagtactcctatagttttattcatatattcctccagtattaagtattaaaataggttactattaattgttagtttcaacttcttcttttatagtaggattttgtatataaactttaacatcatctgccttaactcttgttttaaaccaatttttaatagtttctatatttctatttaaagaattatcttcactatatattataagtataggtatttctttatttttatcctgttctccaaatacatatcctacatatacgtcatttattctaggatatatagcttttagttcgctagatatagtttctacttctgttttattagatatttctttattgttttcttctttcttattagaaatattattatcttttataaaatcactatttttattttttatatcctttatatatttttctatatcattaaaattgttatcatcttgtttaataattaatttcttattgctaaatccataatgatgaaggctttgttgtaattcatctaattgactattagatattcttttacccataagagccaaagttattgtattatctttttcacttatatttttacttattacatattgtccatttaactctttattaataaaagtatttaagttactttcatctatggtttctcttatcatgttaaaagcagaaaacatactaggtattattactataatagatgctattattataaatttcttaacgtttttttgtttttcatcacatatgtttattctagttggtatatttaaagcttttgtaaccataagtgttgatattgttataaaaaaacaatttataaaaaataaatatcctgcacctaaaaatatatcatactgcttagtggcaagtccataacctgctgtacaaagaggaggcataagtgcagttgctatagcaactcctggtataacattactaggtttgttgcgagttatacctatcattccagcagtacctcccacaaatgctattataacgtcccatattgttggactagttcttgataatatttcactacctgctgttgttattggtgttaaagaaaagtaaagtgttgatgttactatacttattccaattgaaagcattaatattttaaatgcatcttttaataatttaacattgtatgttcctactccatatccaatccctattatagaacccatcaaaggagatattaacatagcacctataattactgctgttgcattcatattaagtcctactgatgctattattattgcacatattaatattataaaattcgcaccgtgaacattcataccttctaatatattttcatgtatttcttcatgagtagcttgatttctagtaaattcatatatgaatttatctttattaatcttcatagcttaatcctcctaagtagtatatattatgtcactcatttacgattttaatttactacaataggtaaatttatacaagataaagatttttactacgatataagttatataaatttatttgtatgtcaatactttaaattggaggtagttatatggatgaatttataaattttttaaataataatttatttcttaatggatttaaaatgattaaattaactagtaataaattacttatatttaaatcttttactaaatattctaaatgcatttatatagatattatagataatattatacaagttaaagtggataaaatatttgatgtatatggtttttataatggtatagaaagattgataattcctaaaaatgaatttaatgatatgaaaagctcattacgatatattcaaaaaaattgcaaataaaagccctctaaatttagagggcttttgtatttataaatatattatgattccttatttaaaacatccaattcctaaaacactaggtcctgagtgacaagcaacacaagctcctattctaaatggatatacatttcttggatttaattcttcttttactttttccataaactttttatgttcttctatgtcatctccatatccaacatatacatctttatcagaaaaattatctcctacttcagatcttaattgttctattaatgttgatattatctttttgcttcctctcacttgagttttttgcttaactaatccatcttctatttttaatataggttttatattaagaagagtacctattgcagctttagttccagatattcttccacctttttgtagataatctaatgaatcaactgaaaaatatacttgtactttctctttgtattcttctaatttactcattatgtagtccatatcatgaccttcacttgcaagctttgctgcttcacctattaaaaggccacctccaatagaaagtccatatgtatcaaatatatatacgtctccttctatatcgcttttagctaacatagctgattgataagttcctgatgctgcagaagaacctgctagatataaaacttttttaccttcgcttacgtacttttcaaaaatttccttaaacgtagcataagttacttgtgatgtcgatggtatactttgtgtgcttcttaataacttgtaaaattcatctccatctatatctactcctgctttatattcttttccttcaaatatgattgtagcaggaagtatttctatatcataattatccattatgttctttggcacatcattcattgtatcgcagattatttttatattactcatattataactccctttataaagcaacttaatttttctatttttttaattataccatgtttctcattttaatattatacattatttatttcatttgacaaactatttattattccctccttttatttaattttattataaaataattatacctgtatattcttttaatatcaatttttattaatattaatatttttatgtgtattattttacagtcataacttaagttttttgtggaaatctaagtttagaaaggatgtgtttatatgagtcatactttaaaaaaaggtgaatatgaaaaagctgttgaacatgtaaaaagaatgcttgaaagcaatatgggaatatcagatataatagctaaatcaaatttaagtgaagaagaagttaaaaatgtagtaaaaaaaagacaagatgaattaaacgataaaaaaccagatttttattaattttttttaatatgagtatatagttttaaatttaaactatatactcatattaattaatttatattaaataaatgtttattttctataaaatattatttaatgcatagctttataaactttttcttaccgatttgtattatcatagtatcagatatatttaatttattgatatcttctaatttttcattatttacttttataccaccctgtgttataagtcttctaacttcacttttactgcttactaaattatttttaactaattcttctattaaatcaaatttttcttttaaaatttctacagtttttatatcattaggtatttgacctttttggtaaacttctttaaatctattttcagcttcattagacttttcttctccatgatatagtctcactatttctttagctaaattcatttttatatctctaggatttactttattttcctctaagtttctttttatatcatctactatatcaggatgtatatctgttacaagttcatagtattttattattaaatcatctggtatagtcatcgctttttcatacattacactagcttcttcatctattccaatgtaattacctaaacttttactcattttattttttccatctaatccttctaataatggcataaatatagttacctgagaatcttgattaaatgctttttgtaaagatcttcccattaaaacattaaacctttgatctgttcctcctaattctatatcagcttttatttcaactgaatcaaacccttgcattaaagggtagaaaaactcatgcaaagatattggagtttgactctcgtatctatttttaaaatcttctctttcaagcattctagctactgtagtcgttgatgctaaccatataacttcttcaaaacttaatttagataaccatttactattaaaaactatctctgttttatctttgtctaaaattttaagtatttgctcttcgtatgttttagcattttctaatacttgctctgttgtaagtgcttttctagctttagattttccagttggatctcctatttttcctgtaaagtcccctataattattactactttatgacctaagtcttgtaattgcttcatttttcttaaaacaacagtatgacctaaatgtatatctggtgcactagggtctagtcctaacttaacagttaatggtttattttctttttgtgataattctaatttatttttaagatcttctagacctattatttcatctacacctttagatatgattcttatttgctcctgtatatctttcataattaatcctcctaaaatttaaatttaatatttaatctttaaggatagtaatttaattattatacggcgccaatacaataaaaaaactcccatccttatataaaaggacgagagtactactcacgtgttaccaccttaatttatcattacctcacgataacgacctcttcaagtacgccaattactttgggatactctagcactataacgtgtgcaaaatacggctactgcctactgattgttatctttcggagtgctgcttagagaggtattcaaattaacttgcctttgctcctctcaccaaccggaaactctctgtaagactacattaattttactttttctcatcaacgcattagtttatttacttaatttaataatatgattattatatttattttgtcaatacttttttaaatttattcattttttttatttttataattcattttcaattatatttgaaaatacttccactattttaggatcaaattgcttacctgaacatgctttaatttctttgatagctttatacttacttattcttctttcatgtatcctgtcatttgtcatagcatcaaatgagtctataacagaaactattcgagcaactaatggtatttcttctcctttaagtccaagtggataccctcttccatcccatctttcatgatgagttaatatatcccttgcgatatagcttaattctggaagtaataatgctaatctataacctttttcagcatgagttttcataatttcatactcatcatttgttagtttttcaggttttaataatatatgttctggtataccaatttttcctatatcatgaagctctccaaccaaagctaatttctccaagatttcatcgtttaatcctaaggcctttcctacctttacagaatacttagcaaccctttttgtatgttcttgtgtttctagattcttttcttctaaactttctcttaaagtatttaatatagatactctaacacttttgttatctaatattttttgtctatatactttatcttcagcttctcttaatgcatcatctaaatttgtatgttcattaatcatagaatgtccttgtgatatgcttaatttaaaattatcataaatttttttatcacaaaggttatttactttctctataaattctatacaatctttttctgttgaatttggaataagtgttataaattcatctccaccccacctaaataccaatccattgtcaccacatacttctttaagtacgctagacatttcttttaaaagcctatctccatctaagtgacctaatgtatcgttaactattttaagcccattaacatcccctattacaactcctataggaaattttttattttctataaactcacttactttttcatcaaaatatgctctattatataaatttgttaatctatctgtataacttaaatatctaagttttttttctaattttttttgttctgttatatctcttgcaactccaattaatcctaatacattaccatcttctcctattataggtgtttttacactgtttatagtgcaaaactcatcttttcccggtataaggaattcttcttctgaatataatgtttcttttgtttttaaaactatatcatcatgctctttacatgctctagtaaagttgctatctatcgaaaattctaaatctgttttacctattatatctttaacccctattttttcgtaaaattttttaaattctttgtttatactaacatatctaagtttatcatctttataaaaaatcaattcaggtatattatctattacactttttaacatatttacttgttgattattagattttaaagaaacatcagttatatctattaatattgctacttcattctttgatttatcatcacaaaaaagaattaatggtttatatattttatcttttatttcatatgtaaaagatgaattaaattcaggcataatcatcattttatataaactttttaattctttgctttcacttttgatctattatataatttaaattttttagtattttttttaaattaataattatatttttaagttcctgtcttataaaactttttatatctaatttattttttaactcaatatatttaagtggtgctttttgtctatttatttcccaagaatgatcatataagtcatttttaagagttttactacattcatacaatatattatttatactttttttaacaaaaaatattttttcttgaagtttttttcttatgtttatatctaactgcaattttcctgaaacacttatataaaacttatccattgtactaatatttttatagtttatatcatcgtgaggatataattcatctacgagtttttctaattgtatactattagattctaatgtaaaaaaatcataacttttttctattaaattatgaccttcatctattattaagtattctagctgtttttgttctttatatggccacttagcaagcaaggaatgattgataactgttatatgttcttttggaagttcttttatacgatttttataaaaacacttttctatacacttttctggataacatatatcagattcacatcttaaatcaattatcaaatcatttatatctttaaatacttcttttacatttttaggtatttcttctatatctccgtactcaccactttgtataagtctttcaatatatataaactgtaatagctcatttttagttttaaatattttatcttttttatattcatataaccttttattacataaataattatttttacctttcatacaaccatagtttattttatcatataaatttaaagattttaaaactgttggtatatctttatttataagttgcatctgaagatttttagtatctgttgatattactatttttttatcattataaaaagattccatgatagcaggtattaagtatccaacgctttttccaattcctgttggagcttctatacatcctattttaggtgagttattttcaccttgaaatacctcttttataaactttgtaaattcatattgtttcggtctaaatatataactaaagttattagatgatgtccataattcacttatttttaataaattttcatatgaatttttataatttgataaattaaaattatgtttgttagaattattgctatatttaatttcataatttacatattctccatattccttttcattatctatttcttttaaatacttactccattcccatttaggtaagtttgcagtttgaaagtattgatctaaattaaaatataatttgtctaatcttgattcttcatttttaaataaccttaaaagtaatgaatttattatattaatgtttaatatacaatcatataatgccctattttgtttgaccttgtttaacttagttatattttctaaaagatagtttatactataatctttatgatatggctctaaaatcatggctaattgcatagagtctaataattcatttttataattattgcctgtgaatatatatttttccataaaaattttttgaaaattcaaatcataaaaaattatagggtaatcttctataaattctatcaatttattttttatttgatatatagttggcgatttatctaactcttccatttttaagtttttgcacataccaaatacactagcagaaacttcttcaaatggctttattaaagtactaaattttgatattttaccatcagttacttttatagctgctatttctattatttcagaggaattgggattaaatccagttgttattaaatttaaataaattacatcttttaatatgcttttcatttacatcctcctgttttttagtaaactaattatatcactttaaatagtttactaaaagtatcctaaattttaaactaaaaaaatccacttttaactatcttgaattcaaaacagttgaaaatggatttttaactattataaattaatatatacttagtgcatcatacctatcatagcacctattatatatggtattaaccaaatacaccatacaaatatactgaatttatgaaatactttttgtttttctttgtcatctttataaagtacccatgtagcccatacagcatgaaataacataagtaaaatagcaattgttcctgttataccatgtattgtttgagcagttgatgaaatagctatagttcctgatttagctatttgtctcataagaaaagttcctgttgtatcacatattaaacctaaataaaatattattacatgatttttctttaatactttagcctttctttcactaaatacacctactgtataaaatactaaagctagtgttatagcagttatagctaatactaattttaaactcatgttgtctcctccttttagtttgtacgcaaactatttttatttaatcattatatacccacttcaataaattgtgaaacaattattttattttttcttttattaatattaaagacttaacaatatcttctttttcttcttcagttaaattatcaaataaattttcaaaggctgattctatttttagtctaaaatcttttgcaaactttaatcctttttctgaaaattctatatatgtatttctcttatcagattcatatttaattttttttatatatcctgcttgttcaagcctatttacaatccctgataccgttccttttgataaatacatttccttgcataattggcttatattaatttttttattgtgtgcaacaaactttaacactattatttgttgatgtgtaagtccacttcctaataaacttgattctattttattaatagattttgaatgtatctctcttattaacattaatattttaaatgaatctatcataactgcctccatatttatttttcttataaattatattaaatacctttagctatatattgtaaataatgttataataagttattaaaaataagtagaggattttaaatatggaaaattacattaagactcaaaaaactttaactgacaaaaaaagatttactttaactccaaatttatcttcaccgtttatttctcctgatactataatacatattggtgaaatagcaaaaaaatatggtggagttttaaaattaggatccaatcaaaaaatttcaattattaatttgaaagaagattgtttaaaagaaatctcaaaagaactacaacttgatttagttcctaagagtaaatctttattaactaatataacattatgtacttctaacttttgtagaatgtctaaatatccaactataggtatctatatgaaattagtaaaaaaattttataaaatggagctacctgcaaaaactaaaataggtatatctagttgtaaaaattcatgtaatagtgcttatactaaagatattggtatagtagtagataaagatggtaaattttttataactatgggtggacgtgctggtactaaccctaaagcaggatatactattgcttctggattaaatgaaaatcaaacaatcttaatacttaaaactgctattacatattataaaactaatgctaataacaaagaaaagttaagagattttatagatagaataggtttagattcatttatagaaacttgtgttagataataaaaatactgtattaattctaatttttataattagaatttgtatacagtatttttttaaaattttatctactttaaagagtttcttctaataatatctaattcttcttctgtaaaaatcttgtttgaaaaaagcattaaatattcttcgctaacactagaatcaaatactattaaatcatcagtatttatgcttatatttatccctttatcaaataatttttttataggatgattttttatatcatctatagcttttaagtatatattactagttggacatatattaagtcttatatttctatcttttatcatatctaatacatagtcatcttcaattgctctaaatccatgttgaagttcatctaaatttaaagtatttatagcatctttaacattactagatcctaaaaattcacctgcatgagcttttaacttaaggcccttgctttttccatattcataatactttttatatctttcaaatccaattagttcttcatctccatataaatccattgacttaaatatattactatctataagtgctggtattatattttctaaattttcatcagttatactctttgctattcctatttcaggtctaaaatctatattttctttatatttttcaactatattttttatactactaaaaaattctttactatcttcaaatctaagtacatcatgacaatctatactagcttctaacaaacttactccatcttcaatagcgttttttactgtttcttctatcgtccataaaaaatcatctttagtttttatatgatttatatactcattaaatataaagtcatctaatccttttattccatacatatctttagatggactttttattttcccattagtatatttatatatatttttaaatctcattcctaatccaccatgattatgtagttcacctttaggtatagtctttaatccatctatatctttattcattaggtattctttaaattttttgctgttttccatttatatcttcctctcatttacatatattttttcattataccatacaatatttctctagtaaaaaacatgttgatattaataaaaaatataaaaaacttagtggtacaaattctcgcaaattttaatattataaaatatgctagttaaatcatagggggtggcatcatgcaaccaatagtagatgtaaaaaatcttaccaaaaatttctacaataaagagggtgaggtagaagtcttaaaaaacattaatttttctttaaatgagggtgaaatattgacaatacttggaccatctggaagtggtaagtctactattttaaacatacttacaaaactattagaacctacttcaggtgaagtaaatataaaaggaaacattggatatatgtttcaaagggaccatttactagaatggagaaatattatggataatataactataggccttgaaattcaacatcaaaaaacacctcaagctatatctaaaattgaaaatttattaaaaacttatggtctatgggattttagaaatatgtatccaaaggagctttctggaggaatgagacaacgtgttgcattaattcgtactttggctgtaaatccagacatattacttcttgatgaacctttctctgcacttgattatcagacaagaattttagttagtgatgatatatataaaataattaaaaatgaaaataaatcaactattttagttacacatgatatatcagaagctatttcaatgtcagataaaattgccgtactttcaaaacgccctgcaactgttaaaaatatatatgacataaatttaaaaataacagaaaaaagaactcctatagtttctcgtagtgctgagaattttaaggactactttaacatcttatggaaggagattgattcaagtgaaacaaaataacatctccaaaggccacagcgaatatttaaattccataaaaaaagaaaaacaactaattttcttatctcaattactgttactagcagggtttatagctatatgggaaattcttgctagattaaatataatagatgtatttttatttagtaagccaagcgatatatataacttatttattaaatatattcaaaatggagaactatttaaacacgtactaatatctagttatgaaactatagtaggtttaataataggtacagtacttggaatactagtagccattttactttggtggtcagaaagactttctaaagtattagacccatttttagtagtattaaatgcacttcctaaaactgcattagctcctatcttaatagtatgggctggagctggagtaaatggcattatagttatagctattactatatctgtggttgtaactatattatctgcatataactactttataagcgtagatgaggaaaaagttaaaatgcttagaagcttcggcgctacaaaatttcaaatactaactaaattaatatttccttcaaatataggtaatttaataaatcttactaaaataaacataggtatggcttgggttggagttatagtaggagagtttttagtatctagatatggacttggatacttgatagtttatggtggtcaagtatttaaattagatttagtgatgatgggagtaatagttttagctttatgtgctctagttatgtatcaaatattaaatataatcgaaaaaatttatagaagcagaagataatatttaatatctatttgctttaatattcataatataactgagttctttatttattttctttagtttgacactaaatattattaataaatttgagctcagttatattatttttaattttataatctacaaaaaagtttattatatattacaataccctactatctcatagtcatttggtattttataatctttatttacatttccaagagtccattttaagtcaaacatagtagtgtcaattattactccaaaatataacataactataccaacatcaattttgccttcatattcatttgcaaactcatcttttctaactgcaagaattaccatccctccatcaattataaatctccatggttgtctatttaatgtagaaggtgccattctagcaaaactaaatgcatctaacaatcctctttcctctaatatttctatacttgcatcttttccccattcatcaagatatactattttatctacacctaatctatatgaatctgtattagatgatttagattttacagcttctccataacctaaagctataattgctgtaacatctttatccgatacaatttcaagtttttcttttatacaattactgtcttcaaatgtaacccaacatgagtctattcctaaatctctagcttttaatattaaattttcacctatgtatcctgagttttctatataacctctatttacttctgataaaataataatataatttggcgcttctatcatatgtccattatatcctgctatttttttaagtttttgatatactttatctttactaaatactttaatatcaatctttatttctggtaaaagcttcttagaattgtgtatatattctttcattattttaaaatcagattcttttatttcttggtttttaaattcccttacagatcttttatttgatataagatatttataattcataatatcaccccttaataaaatatacttacctttatcttataagttttatacccataaaaaatgtaagtaaacattttcataacatttatcttatttcttaaattctagttaatatttaaattgtaatacttatatcaccaattaactaaaattttaatattatgtagtatctttaaattttaaggggtggttttaatgtttaaaaaattaacagcttttatatccttagttactggcctctctttagctatggttggatgtactagcagtactacatcaaataataagtctaaagaattgactaaactaacagttgcagaagtaacccattcaatattttatgctccacaatatgcagctataactcaaggtttttttgaagatgaaggaatagaaatagaccttataaatactcaaggagctgataaaactatggcagctctactttctggtgaagctgatataggccttatgggccctgaagcttctatttatgtatacaataaaggtaattctaattatgctgtaaattttgctcaattaactcaaaaagatggaagttttttagttgctcgtgaaggtagtgataaattctcttttgaagatttaaaaggtaaagaaatcttaggcggtagaaaaggtggagttcctgaaatgacattggaatatgttctaaagaaaaatggtttagttttaggtactaacgctaaaaacggagaagtaaacgtaagaactgatgtacaatttaatgttttaagtggcgctttcgctggaggtgaaggagactatgttgcattgtttgaacctacagcactagaacttgaaaaacaaggtaaaggaagtgttgtagcttctataggtgaagaatctgggcttataccttatactgcttattctgcaccagtagattatataaaagataacaaagatttaatacaaagatttacaaatgcagtatataaaggtcaactttggattcaaaataattcttctcaagatatagctaatgctataaagccattttttacagactttaatgaagatgatttagtagcagtaattgaaagatataaatctatagatgcttggtctcatactccattgcttgaagaaagtagtttaaatcttttaatggatgttatggaagaagctaaggaacttgataaaagagctccttataataagatagtaaatactgattttgctaatgaaagtataaaatctttaaaataaattaatttttagtaacatatttagtatttaattaatataatttagtatatactaataatatagtatatattggattcgaccttactataataattactactccgatttattatatggcggatacctttaaaggaaaaagattatctattttagataaactttttccttttttaatttattttaagtataaatttattataatattaaaaaagggggaaattattatgaaaaggatagatgaaagggatattatattttcaagagttaattataaaaaaggcacatcatcatatgaagattactataataaaaatccagataaaaagctaatcgacgatagtataagatctagaccaaacctttgtagtgaaggctctatgacatataatgaaattaattcacctatggcatcttcggcatttgaatttttatctgatattaaacatctttgtgaaggagaaattaataaaactaaaataaatgttgataaaaatataataactaaaaggataaaaggttttgctcatcattatggtgccaatttagtaggtattacaaaacttaaggattatcatttttatactaatagaggtagacatgaggaaaattatggagaagaaatcaatctaaatcataaatatgctatagcatttgcagttcctatgaataaagacatgataaatagagggcctatgctttctgaagttattgaaactagtaaagcttatgtagatgcttctattataggtatgatacttagctactacataaggagtttaggatatgacgctagaaatcatatggattctaattatcttttaatgcctgttttaattgctaaagatgcaggacttgggagtattggaagaaatacaatacttactactaaagattatggatcgtgtattagattaggcgttgtaactactactttagaccttaaagaggacaatcctatagactttggtttagatgatttttgtagtgtatgtaaaaaatgtgcttataattgcccttctatgtctttatctaaagatatagaaaaaaaatctaatggaaactataattggactatagattcagaatcttgttatataaaatggagatatttaggtacagattgtggaatatgtatagcagtttgtcccttttctcaacaattagattctataaagaatgtagacacttttaaaaataatctacctttaataactgaagttcttaaagaatataataaaaaatttggcaaacgcccatttataccaggtaatccttcttggatgagataagcttagccgtctaaataatatattcaaatattatttgacggctatataaattaattcttttatatcttcaccactttgcaaaatgattttcacaccaccctattgtatttttaaaatctacttttttatttttatgctttatgtgtccattaatataccctataatttgttttaatttagatttaaaaattataatattgttaacttttgtatgatttaatatgggtttaaattctaaattaacttcatcactttttaaagattttatatttataacttgattttctttattataataaaatttaacatcactctttaatttataaattctatcatttatttttatagaattttcatttaatcctgttccatctgtatacttagctcctaaatttacagatatatagtcattattatcatctacaaatccactaattagccagtcccattcgcacgttcgcttccaaattcctcttccataatctataaagcaagtagatttatttaagtcatacatattactacctattctcaatattccatgagtctttagattcatatgttttgatgtataatgaaaataattataatcccatggaataagtacatttagtgattcataatctaaatatatgctagctgtaatatctatattatcccatttaaaatctatacttaaattattggagtttcttaaaacatttataaatttatgtttacctttataatatgcatatgaattaattctatcatctatcataatagatttattaaatagatatctacaaattatatttactctttttttcccatttatttcataaaaatctgaatatattatagctgcataacctacatcaactatagcaaagttaaatataaattcattattcatccacatatagtgattccaagatttctttttaaaaaaacttgtatttattgtacaatctttaaatggtatgttgttccatcctacagcatacccatttacaaatcctttattattacatatagccctgctatcttttacttgatccacaaaattccccctttatataaatataattattaaattaatatattattaatttatataatttgttacaaatttttaaataaaaaaagacctattataggtcttaataaactatgcatctttatacatatataaggcttcaattctagtagcatatacatcttttttatcacagccaatatattttgcatacttttctattttttccttttctaaatcaacttcataacttaaattttgtcctatatcatttacatacttatccattaaagattctttatatcttttaagatcatatcctaagaaattcgctaatctatctatttctttattaaaatctccatcttcttttataaaaaattcatatatatcctgtctatatgggtttaaagttattatttggtttataacatagcactcattagttttatctataaatccatctttataattattaaaaagtgcatttgctttaactacattttcttcttttatataacttgaaacgatatctactccattatctaaaagagcatctactactgcatagtgaatattaaagcaatttttataaatacaatctgctaattctattattctctttttattttcaatagatttttgagctaaactaatttttttatttttattttgatatgaatagtcttttgatagatttttaaatacctcagagtaatttaaatattttaggcaataattttgtgtgaaaagatgtacatcaattgttataatcccgtaatttactactatctcaacacctttttttatacaatttcttatatattcctttcctaaattaagtcctatttcatttatatcttttgatatgtagttttttgaaaattcttttttaaattgatttttatatatgtctgcttgagttaaaaattcctttctaatattattgtaccttacattttcctcaggaaatcttattatagctccatttatatcaaattcttcaaccaaagagacccctcctattttatatcattaaaactaagattatatatactttgataaactatactatttttccttcttaatatttaaacttatgctatttttttataaattttaaacattttttcatttgcacaacacactataattatcaactttagactttttattgatatttataaaataaagtacttaataaataaaagaataaaaaaaggatgtgctaatatctagatattagcacatccttttttatttaattattttacagcttctaatgctttttcataattaggctcattagttatttcgtctaagtattctacatatgtaaccttattattctcatctacaactataacagctcttgaaacaagacctaattcttttatatataatccataagatttagaaaattctctatctttataatcagatgcagttactacattttctatacctgcatttccacaccatctagcttgtgcaaatggtaaatccattgatatagtataaaccttaacatcatttaatttagatgcttcttgattaaattttctaacttccatatcacatactggtgtatctattgatggaactgcaactaatatttttttcccttttatatcactaaattttatagggtttaaatcatttcctactacagtaaaatctggtgctaaatctcctactttaacttgtgttccttctaatgttaatggtgctccttgaaatgtaactttcatatttatatcctcctaagtatttttcaactttattttttatctttatttaatattttatgcaaaataaaaagggcataaaatattatactatttttatacccatacatagtttcactaaactttaataattatctattactaacttatttttcaatataattaactatatttgcattctcatctataactccttctattaaagaagttttactaaccataatagtagtaactccaggtccatgacctaatgttacacaatcactgtgaactataatgcctatactaacagcaccttttaaatatcctcttccatatgtattatcacaatcttcaagtaatactatatctccaaatcttaacttatcaagaccgagccttttaatttcctcaaaatcagctgtcattatatcataatcaccagtatatgcattacttgatcctatacctgaacccattaaatatggtggtattttagcaacaactggaacttgtatcttaccatttttttcatatatacctattttctcaaataaattaggatctatactcattacatgtatatcatcatatccctctaattttaacccttgtccatatgcctttatcattatcttatcatctatagctaaattttctattgtttcatcatcaaaatgaacaagtacatgttctatacccccatgcattcctgtaacatatcccttagcacctttagcatctccactaacaacttttgcttcatttcctatacatgaaaaagtcatcaacgcattactctctctattatcctcatttcttatagatacccctggttctatatgatctccagctaatccatatacacaatctcctactttaacattatatgatatcccacctgttgatggaagtataactggctttccctcgtgagttactttataacttgatgctaatggatgatgtatcttgccttgtactgaccatttaacaaccttatctttattagtttgtatcatgtaaaatcccccttatgtttttcgtaatcaatatttttattatataaattaaagaccgtctaataatatattattaaacggtctttaatttatgctaattattatgtttagtttcaattttagagtttatttttcttcctactaaaaaagaagttaatactaataatgacacaaatataattttcataggactatggataaatcctattaaatcatttccaatataactagcaactaaaaacattactattcttccacttgtcattgcaggtacaaaacttgtagcatctttacctgatataccacaagctatagtgactaaacatcctggtataaatgggcaagaataagcaataaacaaagtagcaaatccttgttcttttacccattttataactttatcagttttattattttctatctttttaaacagtttaaaatgtccgcacttatttgataataagaaaagcagataagttcctccgcaagatcctatagtagatgctaaaagcccaaatccccatcctaacatcatgctatttgcaacaacaatccccataagaggaagagctggtataaagctttctagaaaacttgcaaaagtgcctattataaatactaatatgtaattgtctctagctaatgtaaataatgcttctatatgttccataccacaatctccttaagttgtaagcaaattttaaattttacttaagttaagttataagttaatatcattttactcctaatacttttttatatcaatatatattacataattgtaatgtaactatactaattaaatttatttaatatgtttaagcttatttgcttttttaaatatacttgaataaagttattataatgaatatgatataaattttattttaagtcaatcacataataaggagataaattgtatgaatattaaaatatataaaaaaatatttattgttttaactatatcattaggaattataggggtagtaggatgtgaatcattagataatgttaaaagtcaaaataagatatatacaaattcagatataaaaaaagagattaaaacttctttagaaaatattatgtcacaatcttttattactacaaaagagttatttagtaataaggatttagataagaacgatttatcatgtattaaaaatttatctgataaaattcaaagtgacgaaaaactatttgataaaatttcaaataatacaaattcaaatgaaagtaaaaatcttgcagagagtatatgcaattcatacaaaaaaattagggattctattaatgaatttataaaagagattaaagccgataaagcaaaagggtatacaaaagctactaatgatatattagttgaaattacaaagttatatagcatatatagttctataaagtaaatatataaataaaatagttatttaaaatataaaaaaggtgtagcccaaaatacttactacaccttttaatttattaataattataatataaccacaggtttaattaaatcttttggtttatctttcattaacattaaagcatcttctattttatcaaatccataaaaacgatgagtaattagttttgaagtatctaaacgatttgtttgtaaaagtttagctaatttttccatacgaagtcttccacctggcattaatccgcctgaaatagttttatgacccataccacatccccattcaacacgtgggattttaacatattcccctgaaccaaggtaatttacatttccgattattccaccaggttttactatagaaatagcttgagccatagtatctacatcaccaccggctacgataactttatcaacaccttttccatgagtttttgacataatctgttctacaatatctccttcacggtaatttataatatctgttgcaccatattctttcgcaatttctatacaatttggacgagaaccaactgcatataaatcagatgctccacgaagtgctgctccagcaacagccataagaccaacaggaccaataccaataacacatacactatcaccaaattgaacatctgctaattctacaccatgaaaacctgtaggaaccatgtcactaagcataactgcatctgctatatctattccttctggtaatactgctaagtttgcatcagcctcatttacatgaaaatattccccaaaaactccatctttgaaattactgaatttccagccagcaagcatgccaccagaatgcattgaatatcctgcttgtgcttctaatgatccccaatcaggtgttattgcaggaacaataactttatcgccaacttttatatcttttacaagtgaacctatctctactacctctccgacagcttcatgcccaagaatcatgttatgacgttcaccaattgcaccttcccatacagtgtgaatatctgatgtacaaggtgaaatagcgagaggacgaacaatagcatctaaaggaccacatagtggtctttctttttcaatccaacctgtttttcctataccaagcattgcaaaacctttcattttcagtacccccttagacaattatttaacactcttatcttagattgtagcacactttacatggaaataaagctttttcataaaaatataaatctttttttgtaataaggactagaaattgataatctaagtgtgaatatattatcagatacaaactgaatactatagtttgataaatatggagtagcgtaggcttaattattgaattttttaattgatagagtagtgaactataaattattttaaaaataatataattaaagccagactatattttaattttaaattttaaaaatatagtttggcttatgattttctataatttatatttaatttttttctgatggtaattttttatatgatctaaactctataactagcattataaatgctattacaattgatgttgcatcagatatagattgtgcataccaaattccatttaattgcataaatttaggtaaaattaatatcattggtattaaaactaaaacttgtcttaataaacttaaaaacattgcttgttttgcttttccaattgattgtagataatttgtacctaaaactattataggtaataaaggtagcattaagcagtattttcttaaaccattagatgttactgctactaatttaggatcactattaaacatgacaacgtaaaattctgggtacatccagatagatataaatccgaaagttaataaaattattccaaatattaaagataaggtaaaagcctttttagatctatcatattgtttttttccgtagttaaaacctattataggttgtgaaccttgatttataccatatagaggcattaagaatatcatagctattgatgctatagtagccatagctccaatacctatatctcctccatatacttttaaagcattattacttataacttgaactaaacttgcagctatttgcattgaaaatggtgaaataccaattccaaatattgcttttataatatctttatctaattttaaattttcttttttaaaagttaaattagatttaccttttatataatagtttaatcctaatatagctgttacaatttgagctattacagttgctaatgctgctccttgtattccaattttaagtacaaaaataaatatatagtcaagtactatatttactatacaacctataaccattatcattgcagaaagtctaggatttccatctcctcttatagttgcatttaatgaaaatgccattatattaaatacagaacctagtaagattatattacaaaatgattttgcataatataaagactgatcactagcaccaaatgctaaaaggattttatttgcaaataatataccaattaaagttaaaattaaacctataattgctgatagtgtaattgagtttgctaagattttatctgcatcatccttttttccttgacctaatttaatagatataactgttgtagagccgatacctataagcataccaaaagctaataaaattgttgttataggcatggttacacctacaccagctattgctagaggaccagctcctggcatgtttccgataaatattctatcaattacattgtataaggcatttactagcatacttataattgcagggatagagtattttaatagtagtttaccaattggttcactacctaataaattttgtgtttcattcatagttaaacctcctgatgtctttatgttactttaagtttttataagcctcatctgcatttaaagaaacttgctttaacacttttaaggctatttctttttcatgttcatctaagccttttgttagttttttttcccattcacttaataatgtataggcttctttttctaacgattttgctttatctgttaagaataggttatataatcttttgtcagattcatcttttctttttactatatagcctaattcttctaatttttttacacatcttgttacaccagctttatctaggcttaattcttctgataaaaagtcttgtgtctttccatctcctctatataaaactattaaacacagtaattgtgtattgttaatgccgtatttatttgttagcctgcttatatagatactagatcttctagatatctttgaggtgaattttccaatatgaccagtgttacttttaaccatagattacgctcctaatacatttgaaatagttgacttatcaactatattaatatatatataattaattgatttgtcaactaatgtcgtttttacccaataatactcgtattaaaagaattaatcgaataaatttagaataaaatttatttgattaatttttttatgatatatttttataattccatataaagaatatgagatacctagtaattggtgtaaattttaaaggttatatatatctacagtatttttaattaatgcaatatatagttaacattttgaaatgtatatcatacattatgtaatataaggaggtcattgatatatatgaaaaataaaaaaatgaaaatggctcgtattgagtgtgatatgaaacaagtggatttagcaaaagctgtaggtgtgacaaggcaaactattggattaattgaatcaggagattacaatcctacacttaatctttgtatagcaatatgtaaagtacttggaaaaacattaaatgatttattttgggaggaataaaaatgaaaaaaaagaaaattcaagatgaaagagttttatcacaaaaaagaaaaattggaaatgatgcatttcaaataatttctttaggcctgtttttatcagttttagttcaacaatatatttttgatgcaccattttcacaatatgcagttgagatgattctacttataactgtttctttgtatgttatagtacgtaatataatggtaggaaatgatatttttgactctaataaagtaaatcaaagggttgttattataaatagcattatttgcggaattataataaccattgtaaatactattcttaactatataaaatttagagatatatttataactgatattgttaattcagtagttgtttcattagtcacttttgtatgtgcatctgttgtatcatttgtagttcttcaaatattatatgttataaataaaagaaaacaacttcaaattgaaacacaactagaagatgacgatgaaaaaaattagtgtaatatagaaaagaaaataagcttatacttttgtataagacattggaagcaatttttatatattgttaattaaggaatatacaagggggatgttatgaaacataaaggaacaaaaagaatagaaactgaaaatttaattttgagaaagtttgaattgtcagatgcaaaggctatgtatgaaaattgggcaagtgattctgaagttacaaagtttttaacttggaaaccaattgatagcattgaagtttcaaagcatgttataaaaagctggatagatgaatatgaaaatgaaaatttttaccaatgggctattacattaaaatcaaataaagatgaccctattggatgtataagtattgtacgccaagatgaagaaataggaatggttcaggttggttattgtataggaaagaaatggtggaatcagggaattacttcagaagcgctaaaggcgttaattaaatattttataactgaagttaaagcagatcgtattgaagcaagacatgacccccttaatttaaactcaggaaaagtaatgttaaaatgtaaaatgaaatatgaaggtacaatgagaaaagcagatataaataatcaaggaatttgtgattattctatgtatgctttacttgctgaagattatattatagaagacttttaatttaattatattttataattgtatattaagagatataaaaagggggagttagtatgtatttaaaaaaactaataggaaataaaatctatttatctccgattgataaaaatgattatccaaagtatacaaagtggataaatgatatggaagttagtttggggatgacttttgcaaatatgttaattgatgaagaatctgaaaaaaatgcattagagagattagcaaaagaacaatttaattttgctataatacttaaagaaaatgatgaagttattggaaatgttggatttccaaaattagatcacattaaccgtactggagaagtaggaatatttataggagataaaaattattggggaaatggatatggtaaggaagcattagaattgttattagattttggatttaatttattaaatttaaataacatatatcttagagtatattcgtttaatacacaagcaataagatgttataaaaaaattggatttaaagaagctggtagattacgagaagctaaaattattggtggtaataaatatgatgaattatatatggatatattagctaaagaatttaactctccatatgtattatcaattttagaaaataaaattaattcatagaaaaaggcacattaatattaatgtgcctttaatatattttaaaataaaaattttatttaaaaataaatcttatcttttatatagcatgcctgtattccttaggagtcataccattatactttttaaatatagaagaataataagtatgattattataacctactgataatgcaacatctaaaatagaatcattattttcaagtaaatattccttacttttttcaaccctaattctatttaaaaaatcagaaaatgtataaccagtttcttttttaaatacatggcaaaaataacttttattcaagttaagatactcacaaactgtatctaattttatatctgtataatagttcctatgtataaagtctattgcatcttttacatatgtgctaaattttgattttttagaaagcttatcttttatcatattctctagcattgaagttatatattctacgcatgagtggggtttatatggaatatcaaattctttaaaagaatttacagttttaaatggacctattataaaatatccatttttcttaggattatttaatataggcattattataaaatgaatattatttatatacttaaggttaatattagatattaaatttggacttatatcatttaatacacctaagtttttacatagtttataaagattatcagagtaccccttactgtttattactttgaaattgttatctaaaagctgtataggtatttctacacaagcataaaaatcacataatatattttcaaaacacttcattaatcaatctccttttaatacgaatatatttataaaattcaataatatagttaaagaaataaatttcaatagattataaaatgtaattgtaaatgataattaatatcaaataaaacaaacataataatattatgaaagaaattgaggggaaagtcaatgagaaaaatagctatatacggaaaaggtggtataggaaaatcaactactacatcaaatttatccgcagctttatcgaatttaggatataaggtaatgcaaataggatgtgatcctaaagcagattctactaaaaatttaatgaaaggtgaatttatacctacagtattagatgtaatggataaaaaaggtgatgaagttaagttagaagatatagtatttgaaggatataatggagttctttgtgtagaggcaggaggaccaacaccaggagttgggtgtgcaggtagaggaataatagcagcttttgaaaagctagaagaattaaatgcatttgaaaattataagccagacatagttatatatgatgtacttggagatgttgtatgtggaggattttcaatgccaataagaaatggatatgctaaagaagtatatatagtaacatctggagaaatgatgtctatgtatgcagcaagcaacatttcaactgctgtaaatcaatttaaaaatagaggatatgcatctttaaaaggtcttatattaaatgctaaaaacgttgaaaatgaaatagatttagttgagaatttagcaaatgaaatagatagtgaagtatttcattatgtaccaagagaaaaaatggttcaaatatcagaaaatgatggaaagacagttatagaaaaagataaaaattgcgaaatggcaaatgtttacttagaattagctaaaaagatagtaggttaaaaacaaataaataaaacaaataaaataaaacaaagtaattacggaggggaaatattatgaaatttagaaagttagcatcagtttttatggtatcagcattatttttaacaggatgccaagcatcaagtacaggtcaagataaagaaagtagtaaagataataaaaaagttagtgttgtttcggcaacagtatcagcaactcaagttttagataaattagatgcaaatgttttaggtgttcctacaactaaaatggatttacctgaaaagcttaaagatttgccaaaggttgggcaagcaatgagtccagatttagaaatagtagcatcattagagccagatgtgttcgttatggataatatgtttaaggaaaaagttgaagaaagtatgaaaaagtatgatttaaatacgttcttctttgatacaagtacatatacaaactttgtaaatagtataaaaaaattaggagctgagattaatcaaacagaagaagctacaaaacttgtaaatgaattaaaagaggtagaaaaagaagcagttaaaaataaaaatggagaagctcctacagtagcgataatatttggtggaggagaaaacttcatgttagctactgaaacatcttacttaggggatttagctaagactgttggggctaaaaatataactagtaatttagatacaaatgtgaaatctccatatatacaatttagtttagagcaaatattagaacaaaatcctgattacatattaagatttgcacatggagaaatagagcaaactaagaaagcttttgatacagcttttgataaaaatccagcatataaagaattagatgctgttaaaaacaacaaagtaatagatttagatccaagtatatttaatgtatctgctaacttacaagttaaagaagctataaaaactcttggagaaacattctacggtaaataattatgaaacttaataaaaagtatttaacaataggaatatcattaatattgctacttatccttttagttttactaactactgttggtagtgttaacttaagttttggtgagattattagtgcacttattaatgatgataataaaatggtaactaccatagtttataaaatgagattaccaagaaacatactggctgtattagttggagctaatttagctgtaagtggagttttacttcagtcagttatgaaaaatccattggcagaccctgggataactggggtttccactggagctagtgttgcagcaattattatattactagttgcaccacaatttacaaacatattgccaatagcagctttcataggaggagctatagcttgtatgttggtatttttaatggcttataaaaatggattaaaaccaggtaggatagttttagcaggggtagctataaacactatattaggaggggtaatttcatatttatcaactatgtatagtgacagaatccaaagtgctatgctttggttaaatggtagtttggctactaaaacttgggcagatgttgaaatgttatttatatattcaatagtaggacttatagtatcactacttcttataagaagtgcaaatgtattacaactaggtgatgatgcagctacaaacctaggatttaatgttaacttaactagattattaatatcggtagttgcagtatttttagcagcaacttcaacagcagtagttggagtgataagctttgtagggcttatagtaccacacatatcaagaatgataatgggaagtgaccataaatttactataccttttagtattattttaggaagtatggtgcttttagttgcagatactctaggaagaactataggaggagcagtagaaataccagttggtgtaataatgtctatagttggaggaccattctttttatatttattaagaaagagaggtaacttttaatgattagctgtgaaaatttaaaagttggatatgaagaaagagtaataattgataacttaagtttaagcattaaaaaaggtgaagtagtgtctataataggacctaatggatgtggaaaatctacactacttaaaagtttatctaggatgataaaaccaataagtggtgatatatatatacaaaatgaaaatataaaaagtttaaaaagtaaaactatatctcagaaggtgtgtttattatctcagcataatgatgcacctggagatttaactgttgaagaattagtttactttggaagaatacctcataaaaaatggtatgaaagtaaaagtaaatcagatgaagaattagttaattgggcaatagaaaatacaggattaacaagatataaaaacactcctataagttcattatcaggaggagaaagacaaagggcatatattgctcaagctctttgccaaaaaccagatgttcttttattagatgagccaactacttatttggatatatcttatcaattagaacttatggaattagtaagagaaataaatgaaaagcttaatataacaatagttatggtgcttcatgaactaaaccaagcaagcaagtatagtgataggctagttattatgaaaagtggggagattgtttctgatgggtgcccaaaagagataataaataaagaaactattaaaaaggtatataacatagattgtgatatagataatgatccaatttctaataagccaagaatacatcctattcaaacaataaaaatagcttagggaaaggaataaatatgtatagtttagacgttttaaataaattagatgaaataaatgatgataaagatataaaatctttatcacatgcaatatttccagggacacactgtccattatttggggtagcgcttacagcaagttatataaaaaatatgccattagtagttgttggaactagcgaatgcacatattatactaaaaactttgcatatcataggcaaaaggggaatgatagtgtatattcaatagcacttaaagaaaaagatgtagtgtttggagctcaaaaaaaagttgaaaaagctataaaacaaattatagaaatagaaaatccagatgcgataatgatagttacaacttgtgttccagaacttataggagaagattattcatcaattgaatacagcttaagtgaagaagttgatataccaatatttgtagtaaatacagagcattttaaatgtaattctcatataccaggaatgactagagctttaaaatctttaggtagtgctatgagtaaatcagaaactcaagaaggtgtaaatatattaggtcatagacaagcagaagttgaaaaaactgaacttgtaaaaatacttaaagataacaacataaaaataaatactgttataccatctaagtgtgatatagaagatattaaaaatgcttcaagtgcaaagttaaatatagtaactgatatgatagcactagatttagctgagtatatgaaaaagaagtttgatatagattatatatactttgataagcacatgaacaaagaaataatatttaaaaactatgaaaaattaggtgaaatattagatataaatttaaatgaaaaattaaatgaagaaagaaaaatgtatgatgaacttttcttaagtttaagtgaaattttaaaagataaaaaattaatatatggaaatactccaatgatgtcttttgaaacagtggactttttaagtgatttaggagcaattcctttatttgttcaagttagagaattatatgaacaagataaagtctttaaagaaaacttaattaaaaaaggatacaatccatatataagtagaatagcaaatattgctccacttagacatttatatgacactataggagctgatttatatataggtcatgaaaatcctatgttacttaaagaaaaaggtcttatgcaaataactcttgattcacatgcacaaaaaattggatatgagttaccaataggtatgatgaaagatttaataaaattatttgaaatgaaaaacaacaataggggagggatgatgcatgcaagcgtataagtatttcccagtggcaaatgatagaatggggataatttggacattatcttctgtaaaagatgcttgcgttatagagtttggaccagcaggaacaactcactatgcagtagaaggtataggaagtttaaatggtgaagatgaagcaaaaatatattctactcatatggaccaaagtgatgttacttttggaaaatatgaaagacttgaaaaagcaatagtagaaattgatgaaaatatttcacctaaatacatatttgttatggcatcatcaatatcatcaattattggagctgatataataagtgtatgtgaaactttgaaaaattcaacaaatgcaaagttaataccaataactacaggtggattaaaagatgattacaatgtaggggtagagtatgcattagagatgttagttagtgaaattgtaaaggaaaattctaaggatataaataaatataatatattaggatctaatattgataagtataattatttatctgatacaaaagagatagaaagaattatgaaaggtttatttgataaagaattaaatacaacttttacagctaatacaagtatagaagaaattgaaaatgcatcaaaagcatcattaaatatagtaattagaaaagaagctttaaaagctgctgagtatatgaaagaaaagtataacattccttatgtttataagaatatatatggattaaaaaatactattaaatttatagaagctgttaaacaaatggatggatatgaattaaatgaagaaaagtacaatgaagaaataaattttgttaagaaaaatatgtttggaataaaaagaaagttttatttctatgaagaaactaaagactgtgctgtgtttggtgattatgacacagttataggaattagtgatatgttaagtgaattaggatttaatattgatagaaaagaaatcctttataaaactaattgtgaagatgaagaaattttaataagtacttcagagttagagagaatgaagtatttaaaagataaagaattattaatgcttttaggtgatggacctagtatagatatgaatcataattcaaagttagatttacaagttagtaatccgaatttagagaagataaatatatatccatatactccttttgttggctttagaggatgtttatatattatggaaaagattttaaatataaaagcttaggagagataatatgcaaaagttattaaatacacaaaagagtttaatgataagttcattaagtaaagataatcaaccagaaataagttatgctccttttgtaatgaaggataaagaaatatatatttatataagtaaagcagcaaatcattattacaatttaattgataataagaattgttcagttatggctatagaagatgaaagtgcatgtaaaactatatttgcaagacaaagagtaagttttaattgtgaagcaagtattttaaaggaagatgttgaaagtatttttgaagagttcgaaaacgttcacggatcttcgatgatgatggttttaaagaatttagattttgatgtttttaagttagatataaaaagaggaagacttgttaaaggttttgggcaagcttttgatattttagttaatgatggtgaatttgagctaaaccaagttatgggaatgggtcataagtagggctttgggtagtagtatgattacagcaccttccttcactataaagcctgatagggcataggctttaacgtttcgtcaggttgctataatcatacttacaactccttcgccagttggaataaaaaaagaggatatcgcgaaatgcgatatcctctttataattaataatgatttttttagaaaaatttaattatattcatttaaaaaatccataaatagtttcttcatgtcttcaagattttcactatctgtatttatgatatgacctgttttaccataagttaaattgtactcttgtttataataatcttgaatatcccaacctatatcttttgcatctttagtttttgtagttataatgtcatgaacagtttttatgtttttgctatcacttagataaatattatttattttttcatctttattaaatactacagtaatagattcataatcattaacttttatttcaaatgtagctctatccttatcgtatggattttctaatttcttaaaatctggattaaacttaattaaatctttacttgtaaaactatctttagattcaattgatttaagtaaatttatataaattttatatgcattaccattagattggtctaatttaagtattttagagattttgtctaagtcattaattgactcagtagcaatttctaatgaaacagcttttttattagaggaaatatttaagttagataatgtaattgagtttatactaggatttttaatattaattttgtattcaatattttgagcatcgtcccaagcgcgatttaattacaaaggttatacatataaatatagtaaatacaacaatatagtaaaaggtgaaactaaaaaaaatatagacatgacaatagatgagtctaatggaaatgtaactatagaaggaaaggtaaataggttagatttaatttataaatatcaaacaaaacaattagaagatcatataagaatagctactaaggtgtgtgataatttaagtgaggtttcttgtttaatatatatagataatactcaatgtaaagaatttttaaattcattggataatataaaagaaaatcaaattaaactaatggaaaatggagtacaacaatcgacaattaataaaaatgataaaatttaaaataaaatattgttttatcatggcaaaatagggtaatatataaatataaaaatacattacggggtgacaaatatgaacagactaaatgaagttttaaaattatttaaagatgaggtaaagggcatagtggatactatgctagtaagtgagagaattaactctcaaagatgtatagcaaaagatgtagataccacaaaaactataatagacaaaaaagaaagcaagaataaattaagtcaaagtgaaatgaacaaattatacaaagaactaagtaatttagtagaaaatttaaaaggcgtaggagaggaattgctagtaagtgaaagaataaatacacaaagatgtatagcaaaagatatagatactacaaaaactataatagatcaaaaagaacatgaaaatataggaattaaagaaatagaagaattagctgaagaagctaagggattagtaaatgcaatggtatctgaagaaaaattaaatacagaaactgattcaataaaagatgtggatactacagaaacaataatcgatagagaagaaaatttagaaaatacagaagaatttaataagctagtagaagaattaaaaactttaatgtctactattttagtaggagaaagaataaatacacaaagatgtatagcaaaagatatagatactacaaaaactataatagatcaaaaaaataaaaagtaaaatagctatgctattttactttttattttttgtaacaaaacaaatgtatttaacgtatattaatgatgataaaaattaaaaaatttgattaatatgatgtttattggacataaattaaaaagtataaagcgcttgcaaatgaaaaagaaaatcatttacgaatgaaatataaagtgttataatgtagaatatgagaattaaaggaggcatgcttatgaatatattaataaatagtgctgaagaaaccttcttgcatgtaggttcattagttagtatatctatattagtatttggatatataaactataaaacgagtggaaattttatagatataataagtaaaaataaaaaattacaaccaattgtaggagctttgttaggagcgctaccaggatgtggtggaagtatagtattaatgccattatatatgagtagtaaagttacttttggaactatagtagcaagtttaatatcgagcatgggagacagtgcatttttagttatgacaactgattttaaagcatacataaatttaactataataagttttttagtaggtattataacaggatacttagtagattatttaaaaatggaacaaagacttgatttacataaatgcaaaaaagatccaaaatgtaatcaaaaaggtttagaattaagatctgaaaataaaaaggcttgtgacataaaaaatcacaataaattctatcatatatctcataaaatagttcatggtattggttacaagatatacttgtttttattattaattggatttgcatttatggttttagctcattcaggattagagtttggatttatagaaaagctacattcttttgaggaagctatagctatattaggtataatatcttcatttatatatatgataatgactaaaaaagttatagaaaatgaaagttttgaagaaaatgaacataaattgatgtcattaaaagaaactattatacattctgtaagtgaaatatcatttgtaattgtttggatatttatagcttatataatttatgatgttgttatatttatagcaggtggagaggaagtattagttaacttaatattaggagcaggagttttaagtgtatttgcaggtgctttacttggaataataccaggttgtggtattcaaattgtagttatgtcattttacttaaaaggaagtttaccatttgcggcattagtttcaaatacaatatctcaggatggagatgcattatttccattacttgcactagataaaaaatcagctatgtgggcaactatagtaactactatacctgctgtattagttgggctaatagtatattttatttaacattaaaaattaagtgctaatatattaacatatatacatattctataatataaaatatattatggagggtatatatgaaaaataattctatgattgtaggaattgtaataggcttattggccggtatattatttacaaaaattaattttacaacgcttgttacattaggacttggaatatggattggacattatatatccaacaataaaaaataagagatatcttgacaataagagatatctcttatttttttaagtataatctaaagtaaagaaatattattataataattttattagatttttatgtatatatttaatttaactataataaaaaaattatataaaatagcttataaaatttgtgtgatcattgaaaatattaaatcctatcaatataagtataattccacctataaatttagccaactctcctatgaaagagcccattttatttcctaataaaacacctataaaacaaactaagaaagttataattccaatacaaattactattggaattataggtatatttaaaaatgaaaagctaattccaacagcaagtgcatctatactagtagctattgccaatattaatatatctagattagtgcatttaaaagaattatttttatcatctttagaaaatatcatttgaaatcctaaaaagcataataatataagtgctatccaatgatctatagattttatatattcagaaagtccaattcctaaactccatcctaaaagtggcattaacccctgaaataagccaaatgcgaaactaattttaagagctaatttaaaatttattttttttatattcattcctttagataatgaaactgtaaatgcatccatagataaagcaaaagaagtcattagtacaaatgttatactcataagaatcctcctctttaatgaagtaaaaatataaacaaatcaatattaatatatatataaatatatagataaatagtacaagttttatataaaaaaatagactatataaattattaaatttatatagtctatttttttatatattaattttataattatttttatttgctaaaactaaagtatttttaaataggttagagggacttgctatatttaatacagaaaatatagcaaatttatattggtaaatttatatcatatgattaagtttataataataaaaactttgtatattatttatttaattcttttaattcttttcttaatttttttaatgctcttttttctatcctagatacatatgatctagatatgtctaatttttgcgctatttctctttgagttttatacccaagaggcgttaatccatatcttaactgaactatttcgcgttctctaggagttaatatattctctaatttttcatatagtttacttatttgtactttaagctccacctgatctagaatatggtctatatcagtacctaatatatcaattagacttatctcattcccttccttatcagttccaattggatcttgtaaggaaacttgaactttgttctttttattagttcttatattcattagtatctcattttctatacatttagatgcataagttgctaatcttgtacctttttctacattgtaagtctctatagcttttataagacctatagttcctatagatataagatcatcttgatcttcatttgaattattatactttttagctatatgtgccactaatctcatgtttctttcaattaaaacttccttagctgattcatctttttcaaatttaaatttagttagataattatactcttcttcaggagttaagggtttttcaaaagattttaatatagtcaatcaggccacccctttcttccttccatgtcattttaaattatatgaaagtggcctgataaaattgcttgtataaaaaaattattttaatatgttctcacatatgtctttaaataaaggtattgctgatttacttgaatctttagttccttcaattataactgttattgcatacttagcactttcttgggggtaaaatcctgttatccatccatgagaaatattttgttttttaattgtcttatctgcattctctacattaattttagcttgagttgttcccgttttaaccccacttcttttttctaaagcagataattctttagccgttccttcttgagaaactgaattcatcatgtcttttatcttagtcataatatatggggatatcacttcttcttcctttatagttttaaaagtttttaatatatttttattattatcaataatgctatcataaatatgtaattgcttatatagtccaccattagcaataacttgagtcatttgattaacttgaagaggtgtaaacatcattttgccttgtcctatagataaattcactatatctatatcatcttgtatacttccacttttctctccatatatatcaattcctacttcttgatccaaatgtaacttctttgctgcttttaatatattttctttgcctacttttagagctatatctaaaaaagcagggttgcaagaattagcaaaagcttgtttaagtgttaagtgaccatgtccatttaaattattacaatttaatttcctaccatttacttcttttgatcctgtacatgtataagtatagttttcatcaattatattattttctaacgctgcatataaaactacaatcttaaatacagatcctggagcatacatatatctaatagctctattttgtaattctccattggacgcatttaaagaatcttcaattgaattctgattataattaggtcttgatgaaatagctaaaatttctccagtttttatatctgatataactactgcacttggattttcttctttatcaactaaagcctctaattttttttgtatattataatcaaccgtaagctttaaatgtctatcatctttatttttattggttttgacacttccatttaaaacaccaatttttttagatttaccagaatttccagaactcccagctttaaacacttctatatattctaagtttttatcttttaaaatattgtcctggcttttttctattccacttatagcttggttatcactatctatataccctatagtatgagctaagatattttcatctgaatatcgataagtttttttatctactaatatgttttcttcttctaacttagattttaaattttcatctatattttttatctttagttcaacaataggagatagtggattttcttgaattttttcatatatctccatgctacttaaacccgtaaccatttgtataagttccatgtatctatcatttatactaatttgatctttttgaattattattatattttctgattttatatcagttagctttttattatttctatcgtatataattcctcttccagaacttaaatttaaagttgaattactttgcttttttgcacattgttcataataattagcttttattatttgtatatctactaatctatatattaaaaaaacataaatcaatatacatattataaatacaaaatatagcctatttttactagtatactttatcacacttttttttctagacataaaatcaccccttagtaattgtaattcttgacaatttctaaggggttaatactatttattaatgtaattgtgtttttattcttgctattaccatatctatagcaacttcattttgtccaccttctggtataattatatctgcatactttttatatggctctataaattgatcatgtgcaggctttacagttgttaagtattgctctataacagaatcaactgttcttcctctttcttttatatctctttgtattcttcttaatattcttaaatcgtcttctgtatctacatatatctttatatctaatttatttcttaattcctcatcttctaatatcattataccttctacaataactatatcttttgcttctgtagttatagtctcttctaaatttctagtatgaagttcataatcatatattggtttttctatagtttctccattacataacatatctaagtgctttattaataatttattgtcaaaagctagaggatgatcataatttgtttttaatctttcttcaaatgataaatgagattgatctttataatatgcatcttgctctattatggctatattttcttctggtatactctcttttatagatttacatactgtactttttcctgatcctgttccacctgtaatacctattataagtgtctttttatcttttttcatatgtctctctccttaaaagtttttatttatatgatttattttgataattatttatagattattcataatcatctggcatagactcgcctgtataaaacccatttgttaatggtctatgactttttgattgtattttttctaaccatttagagtcaaattcatattcatttggatttttatagaacttatctaaagcttctctataaacttttataactgtttctaaatattcatcactttgtaatcttccatcaatttttaagctagttacacctgattttatgaattctggtataaattttagcatacataaatcttttgagttaaagaaaaatgttcctttttcatcttcatatactgggtaatattcaccttgtcttttttcttccaataaattatatctttttttatccttttcatactcgacattatcttttccatttaaataactacttataagacgtcttcctgaataagatatacatataggaccatgtacaaaggcttctatttctaaatctagcggagtattagctctaattgtgtttatctcatcaaaagataattcactagttacgattattctttttatcccttgattgtaccaaaagtttgcactattgtaattagtgacattagcttgctgccccatatgaactctaactttaggtatagtttcctttactatagcaagtactcctggatctgaaactatgatggcatctacttttaatttttcaagatttaataagtattcttgtaatttatcaaaatcttcattatgcggcataacatttacagctatataaactttttttcctttttcatgtgcaaaatttattccattttctaaatcttcttttgaaaagtttttagcaattgcatcgattccaaaagaatctccacctatatacacagcatctgctccactttctaatgctatttttaaattatttaaatctttagcagatgataaaagctcgattttatgcatctaaatcacctcttactttctttttataactaagtgtaactccatctcctataggaattattgatgtatctaaataatcacaattacatatataatctaagtaacttctcattctctttactatagttttttttcttcttataacgtaactatcatgagctaccatacctttataaagaatattatctgatataagtaaaccatctacttttaacttgtctattaccatatcataaaataatttatactgacctttagctgcatctaggaaaatcatatcaaattctccttcaacttcttttaaaagttcttcagcatcaccttctaatatagttatattatcttccatccctgctctttttatattttccttagctttttctatcattttttcatttctttcaacagttattatttcaacatttttatttaatactgttgcaaagaaaatagatgaatatcctattgcacatccaacttctaatattctctttggcttttgcatttttaataaaacttttaaaaaatctgacacttccttatgtattattggtacattgtgctcacttgcatactcttctaattcttttaataatccttctttatcttttaatgtatttcttatataatcttctactaaatcatcaactatattactcatattttcagctccttgattgccctaaaaaaggcaaaagtttcgctttaaatactatttaaaatttttagcgataatcctttgcctttgtggacaaatattttatttacttttctgatttttcttgatttaatttatctctatcttttttataattttcaacatgttttaaatgttcttcatatgttttactgtaattatttttaccatctatagttgctacaaaatataaataatcactatttgctggatttaatacagcttctatagatttaacacctggattagatataggtgtaggtggcaatcctttattaatgtaggagttatatggagattttatttttaaatctttatacataaccctatcttttctttcatcaaatatatattgtatagtagcatccgattgtagaggcatgtctacattcaatctattgtaaaatacactcgcaatcataggtctatcctcatctaaaacagcttctttttcaattatagatgccaaattaactacctgttgaagagttaaacctctttctttttgctcttttttaaacttatctgtatacattttttcaaatctttttaacatagcagataagacttcttcttcagtaacttttttatcaaagtaataagtatcaggatataaaaaaccttctagacttagaatatctttttcatctaaatatttaaatttactataaaattctttaggattatttattaatttttcataattttcctttttaccgattcctttagatgttaagtattttattacttctttataagttgaaccctctggtatagttacctttataccatcattataagttttaccactaaaaagtatatctagtatcttagaatttgaatagctttgacgtaataaatatttaccagctttaacaccgtgttcatttggcttaaatttgctaactactttaaataaaactttattttttataattttattttcttttaaaatatttgatacatctgttaaagttgatccattaggtatttctactatcatgtcctttttactatttttatcatatggacctacttgaatatatatatatccagctattaaacctagtataattatcgttataatacttataacttttaagtttaccttcctaaaattcatagggttatctactccttatgcatatttatatcctttatattataaatcttagtataaaaattttcaataagattgtcgaaacaaaataaaaagcctaacgttattttttacacgttaggctttttttaatcatctctttagaattttacaattttatctttagttacaactccgtaaactaatttaccttcatctactttttcatcagatattgtatatgcatttaaaaatctttctttagctacttctattttatctaatttattgtagtgcatataagctatagtttctccttcttcaacaaagtctgaaacttttttagttaaaactataccagcagataaatctagttcatcttctttagtttctctacctgctcctaaaatcatagctgaaactcctacttcttcagcttctattttctttatatatccttttttaggtgattttatttccattatctcttttgcttgaggaagtagtgaataatcatctactactttgctatttccaccttgattatctataaattctcttaatttatcaagtgctcttccactagatatagcttcttgtattttaactttaccttcatcaaaactttcaaccactttagctaataataacatatatgctcctaaagtttcacatagcattacaaaatctttaggtcctcttccttttaaagtctctattgcttctataacttctaaagaattacctactgcaaatcctaaaggctcatccatatcagttataagagctatagtttctctattcatattgtccccaatgtcaaccatttcttttgcaagtgcaaatgagtcatctatagttttcataaatgctccatctccagttttaacatctaaaactatagcatctgcacctgaagcaagttttttgcacattatactacttgcaattaatgatatattatcaactgtagctgtaacatctcttaatgcatacatttttttatctgcaactgctattgatgctgtttgtccacatactgctattttatgtttatttactgaatctataaatttgcttggttccatttcaattgaaaaaccaggtatagactctaacttgtctaatgttcctcctgtatgaccaagtcctcttcctgacattttagctactggagcattacatgcagctactaaaggtgctaatgctatagttgttttatctcctactccacctgtactatgcttgtccacttttattccatttatagcagataaatctataacttctccagaattcatcatagcttctgttaaataggcagtttcttctttgttcattttatttaaatatatagccattaaaagagctgatgcttgataatctggaatttctcctttagaatatttctctacaaaaaaattaatttcttctttacttaaaacttcattatctctttttttctttataatgtcataaattctcatagctaatctccttattattagttatatactttaacaatatttataatttatttattattgattttactaaacttaaaaattctgattttactttttgtgttgtttctataacttcttcatgatttaaaggttgatttaatattcctgctgccatatttgttatacaagatatgcctataacatctaggtttgaatgtctagcaactataacctctggcacagttgacatacctactgcatctgaccctaaaatttgagctaactttacttctgctggtgtttcatatgttggtccgctaaagaaagtatataccccttcttttacatctattcctaaatctttagcacattctttagccaattttatatactttggagtatatgctgttgacatatcaggaaatcttacgcctaatctactatcattaggtcctattaatggatgatgtccactaaagtttatatggtcttttattatcattaaatctcctggattgaaatctttgttagctcctccagctgcattagtaactataactgtttttacacctaattctttcataactctaactggaaatgttactgattccattgaatatccttcataaaaatgaaaacgcccttgcatagcaattacactctttccttgtaattgtcctataactaattgtccattatgcccttctactgttgaaactggaaaattaggtatctcatcatattttatttttactggattttcaatttcatcacctaaaactcctaaacctgaacctaatataagtcctatttctggagatttgtttatcttagattgtatatagtttttactctcttgtattttattatataaactgttcatgctaatcccctttatactaatttatttaataatttcatttttaaaactcttaccatttttaggactatccacatttaatatatctgctacagttgcacctatatctgcaaaactatttctagttcctaagttgtatccgttaactacatttttaccataaattagtataggtatatattctcttgtatggtctgtacctttgtatgttgggtcattaccatggtctgagtttatgattaatatatcatcgtctttcatattttctaaaatctcaggtattctagcatcaaattcttctaatgcatttttataaccccctacatctcttctgtgtccatatttagaatcaaagtctactaagttagtaaatattaatcctttattatcttttttcatataatttatagtttggtctactccatccatgttatccttggtatgtatagcctcagtgattccttgtttattgaatatatcttctatttttccaactcctataacatctaagttggcattttttatattatctaatacagtatcttcaaatggacttaaagaataatctcttctatttgcagttctttcaaatgatcctggagttcctataaatggtctagctattattctagccactgcattttcgcccatcattatttctctagcaatttcacacattctatacaattcatctaaaggtattatctcttcatgtgctgcgatttggaatacactatctgcagaagtataaactataacttctccagttttcatttgttgttcacctaactcatctaatatagctgttccagatgcaggtttattacctattacttttctatttgtttttctttcaaattcttctatgatttcttttgggaatccattttcataagttttaaaaggtgtttctactaaaactccagtcatttcccaatgtcctgttgttgtatctttacctttagacacttctttagctcgtccaaatgaacctttagggttatttatactttctagactttcaacaccttctatattgcttaatcctaagtttatcatattaggtatttttatatccttatatgttttaactatatttcctaaagtatttacatttacatctccaaatttttcagaatcaggaagagctcctattccaacactatcaattaccatccatataactctgctcataaaattgcctcctataatgtattattttctaggatgtttttcttttaattcctgtcttacatttttatctatacaatttaaataatattgcaaactagacaaattagaattacctaatattttactaactacagctatatttgcaccttcattaatcaaatgtatagcaaatgaatttcttaatatagttggatttatgcttttatttatattagctctttttgcatgtttttttataagtttccaaagaccttgtcttgtaaatcttgttccattagagcttatgaataaagccttttcctcatagttaaattttaaaatttcatttcttgatttatttaaatatttattaagatatttgcttgtaatttgtgataaaggtatcacccttgggtttttgcctgatttacagcaaatatagtcaaattctatatttacatcatctaagtctaattctattagctcagttaccttcatacctgttccatataatacttcaaatatagctttatctcttatatcttttatattatctaaattttgaaaattaagtaatgcttcaatttcatcttttgttaaaatatttatttcctttttttctatttttggtttttttatgtttttagatacattgattttaatatacctatttaaaaataaatattcataaaatgattttatagatgatatacttctagatacagtagatgtagataaatctaatttttctaattctattatatagcttattatatcattttctgtcgaatcaaataagtcaatatttttattttttatatatgttaagtacttttttatatctataaaataagagttaatagtattatcactaaattaaatttaaaacttaaagaatttaatgacatatatgaaattgatagaaataagtttgatgatttgaatatagagtatactaaattaaatcaaatttatgaaggtataattaaagatatagagagaattaataaagaaaaccaatatcaagtgagtttattggaatcagtaaaaatacaacttaaagacaataaagagagtaagattaagttgcaagagcaaataaagatagaaacatctgaaannnnnnnnnnnnnnnnnnnnnnnnnnnnnnnnnnnnnnnnnnnnnnnnnnnnnnnnnnnnnnnnnnnnnnataatttatctatagaattaaaaaatatagatagacaatttatgaaaattcaagaaagcttatttaaagtagaaaataagattgaaagattaaaaacatctcaagaaaactatatagaaaagttaatggaagaatatgagataactcttgaggaagcaattaaattaaaagatgaatctgtagttatagataaaaaagaattagaatctttaaaaagagagataaaaaatctaggaaatgtaaacattgattctataaaagagtatgaagaaataaaagaaagatatgacttttatagtgaacaaaagaaagatttagaagaatctatagatgtaatatataaacttataagagaacttgaagataatatgaaaaaagaatttaaggaaaaattcacattaataaatgagaattttaagtttgtatataaaaagctatttggtggaggtaatggtgaacttaaaatagtagataaagaaagtatactagaaagtgatatagaaatagttgcacaaccaccaggaaagaaaatgaaaaatctaaatcttttatcaggaggagaaaaggcacttacagcaataagtatattatttgcaatacttttagctaaaccaactccgttttgtatattagatgagatagaagctccattagatgatgctaatatatatagatttggagagttcttaaaagaattatctaaggacacacaatttatatcaataacacatagaagaggaactatggaggttgcagattatatatatggagttacaatgcaagaaaaagcaatatccaaggttataagtcttcaattaaaagaagctaaagaattaacaaaagatatagtataaggaggaaagctatgtttaaaaagctatttaaatttaacaagaaaaaagaggaagaaaacatagttgaagaaaataaaaaatctgaagaaacagtagaacttgaagaagataataaagaaagtataagtgaagctgtagaaaatgaagtagagtctgaagaagaaaaagttagtgaagcttcagaatttaacgtagaacctatagaaattaaggaagaaattatagaagttgaaaaaaatgttgaagataaagaagataaagaaaataattgtttagaagaagaagaagaagaagaagaagaagaagaagaagaagaagaagaagaagaaagtgttggattacttgctagattaaaacaaggtttaacaaaggcaaaacaaggaataactgataagattgatgctgttttaaattcgtatacaactatagatgaagatcttttagaagaacttgaagaaatactaattacagcggacgttggtgtaaatacaactatggaaatgatagataggttaagggatgctataaaatctaaaggtataacagatccactagctgttagagatgagctaaaagctataatttcagatatgttaggtgaagatgattcaaaattagatatggaaaaagggccaaatataatcttaatggtaggagtaaatggagttggaaaaactactactataggtaaattagctaatagatatactaagcaaggtaaaaaagtagtactagcagcaggtgatacattcagagcagcagccatagagcaattagaagtatgggccaatagaagcaatgttgatataataaaacatcaagaaggtgctgaccctggagctgtaatatttgatgctgtcaaagcagctaaagctagaaaagcagatatattaatatgtgatacagcaggaagacttcacaataaaactaacttaatgaatgaattaggaaaggtgtttaaaatagtagatagagaatatccagaagctaaaaaggaagttttgttagttgtggatgctactactggacaaaatgcagtttctcaagctaaaacatttaaagaagttgcagatattactggtatagttttaactaagttagatggtactgcaaaaggtggagtagttttagctgttaaatcagaagttgatgttcctgtaaaacttataggtgttggagaacaagtacaagacttacaagattttgattcaaaagcatttatagacgcattatttgggaactaattagctttttaaaataactgttgacaactttattagtatgatataaaatacaatgtgtaaaggaaatcacctttacagtatagtaagtgggaagtgtaataatgaatctagaaaaattggtagagattgggttattgtttgaacaatacaaaatgcttctaactgataaacaaagagaaattgtatccctttattataatgaagattattctcttggagaaatcagtgaaaatttaaatgtatctagacaaggagtttatgatacattaaagcgctcagaaaaaatattaaaagattatgaagacaaattaggcttagtaaaaaagtcaaaagagcgtgaaaagtttacacaagatatatataataaagttgttgacattaaacaagatttattgcaaaatagagattgtgctaatttaatccctaagttagaaaatttagaagatgtatgtagggagatgttaaaatgatatttgaaggattagcagataaactacagggagctttagataaattaaaatctaaaggaaagcttactgaaaaagatgttaaagatgctatgagagaagttaaattagctttattagaggctgatgttaactttaaggtagttaaagattttgtaaagaaagttcaagaaagagctgtaggtcaagaagttatggaaagcttgacaccagcgcaacatgtcataaaaatagttaatgaagaacttacaagtttaatgggtgatgttcaaagtaaaataatgatatcatcaaagccaccaacagttataatgatggtaggattacaaggtgcaggtaaaacaactacatctggtaaacttggaggatactttaaaaagcaaggtaaaaagcctttattagtggcttgtgatatatatagacctgcagctataaagcaattacaagttgtaggggaaaaattagaaataccagtatttagtatgggtgataaagaaagcccggtaaatattgctaaagctggatataatcatgcattaaaaaataatcacgatttagttataatagatacagctggtagacttcatatagatgaaactttaatggatgagttaaaaaatattaagtcagaaattaaaccgcatgaaatattattagttgtagactctatgacaggacaagatgcagtaaatgttgctgagagttttaatgatgctcttggagtagatggtgttattttaaccaaacttgatggtgataccagaggtggagcagcactttcaataagagccgtaacacaaaaacctataaaatttataggtatgggagaaaagctagatgacttagagcctttccatccagatagaatggcatctagaatattaggtatgggtgatatactaagcttaatagaaaaggctcaagaaaatatagatttagaaaaagctaaggaattagaaaataaaatcaaaaagcaagaacttgattttgaagatttcttagagcaaatggaacaaattcaaaagatgggtcctcttaataaggttttagaaatgataccaggaatgggacaagtaaaagaccaacttggggacatagatatgaataataaagaaattgttaggactaaggcaatagtacagtctatgacaatagaagaaagaagaaatcctagtatattaaatgcttctagaaagaaaagaatagcaagaggtagtggtactagtgttcaagatgtaaacagacttataaagcaatttggcgaaatgaaaaagatgatgaagatgtttacaggaactcaaaaaagcatgaagaaaaggggaggctttgccggtttacctttctttaaataatagaaaacaaaaagataaattttttcggaggtgtcgatatggcagttaaaataagattaaaaagaatgggatctaacaaaaaacctttctacagaatagtagtagcagattcaagatctccaagagatggaaagttcatagaagaaataggattctacaacccagtttctcaaccaaagcaagttaaaataaacgatgagaaagctgttaaatggttaggatgtggagctcaaccaactgatacagttaaaactttattagttaacaacggagtaatggaaaagttcgaagcttctaagcaagctaagtaatttttataggagcgaattgatatgaaagagctagtactagatatagcaaaagctcttgtcgataatccagaggcagttgaagtagaggaaacttttaatggagatgaaacaattctaaaattaaaagttgctcaagatgacatgggtaaggttatcggtaagcagggtagaatagctaaagctataagaactgttataaaatctgcttcaaatagagaccataaaaaggttactcttgaaataatataaaggattaggtattaacctaatcctttttgtatatactttgtatatattacacaaagataaagcataaattttgaagaaggtgagattatggaaaataaattaactcattttaaaataggacaaattgtaaagacacaaggattaaaaggtgaagtaagagtttactcaacaactgatgatatatatagatttgatgacttaaatactttttatataggaaaagactttaataccgaatataaagttgagagagttagatataaaggtaatttagttataatgaaaataaaaggtattgatacagttgaaatggctgaaaaattaagaaataaaaatgtatatgtatcaagagaagaatctagagaccttgaagaagatgaattctttatagctgatatgataggaattaaagtatatacagtaaatggtgaatatgtaggtacactagatgatgtattacaatactcagcaaatgatgtatatgttataaaaggtgaagatgataaagaatatcttataccagcagtcatgaaatttgtacctgaaatagatatagaagaaggaaaaatgataatagacccaataaagggaatgttagaataaatttaaggtgatattatgagatttcatataatgactttattcccagaaatattcaattcatatatgagtgaaagtataatgaaaagagcagtagaaaaaggaattatagaagtaaatatttacaatataagagacttttcaactaacaagcacaaaaaggtagatgattatccttttggtggaggagcaggtatggttatgactcctcaacctatatatgatacatataagcacatagtggataaattcaatataaaagaaccaaaggttatatatttaactcctaaaggtaaagtacacagtcaaaatatagctaatgaaatgtcaacttttgaagatatcatattgctatgtggtcactatgaaggtatagatcaaagaataatagattctatagtaacagatgaaatatctataggagattatgtattaacagggggagaacttcctgcacttatacttattgattctatatcaagacttatacctggagttttaaatcaaaatgaatcttttgaagaagaatcatttaaagataatttattagaataccctcattatactagacctagagaatttatgggaatggaagttccagaagttttactatctggaaatcataagaagatagatgaatggagacatgagaaatctattgaaataactaaagaaagacgtcctgatttatacaaaaaagcttgtaaataaataggacatatagtataataaaatctgttgaaaaaataaaacgggcgttcctctgtttacaaatggtcaagtaattaagagcgtctatgataccaggaggattaaaatgaacgaaatattaagatcattagagcaagaacaattaaaaaatgatgttcctaactttggacctggggacacagtaaaagtacacgttagaatagttgaaggaaaaagagaaagaatacaagtattcgaaggtgttgtattaaagagacaaggtggaggagctagagaaactttcactgtaagaaaaatatctttcaacgttggagtagaaagaacattccctgttcattctccaaagatagagaagatagaagtaactagaaaaggtaaagtaagaagagctaagttaacttacttaagaggtagagtaggaaaagctgctaagataaaagaagctagataataaaaactttactatacaggggactgaaatttcagtctcctttttaaatataaggattttattatgaatataaaatttaattaattttaaaatataaataaatataaattataaatttaatataaaaaataatttgtgtttttaatattataaaaaggagaaaaaatatgaaaatacaaagaatgacagatgaatatttaagggatgaaagtttacatataaactggtatccagggcatatgaaaaaaactaaagaattagttaaaaataacttaaaattagttgatgttgtcgtagaacttttagatgctagaattccatttagtagtagaaatccagatattgatagatttgttggagataaaccgagagttgtggtattaaacaaaagtgatatatctgatccaaataagttaaatcaatgggttgactattataaaaaaagaggcattaaagctatacctgtagatactttaaaaggcaagggtattaataaaataatagaagaatgtaaaaatgaaacaaaagaaaagatggaagccttagttaaaaaaggaagaatagaaagacctataagaattatgatagtaggtataccaaatgtaggaaaatcttctcttataaataagcttacaggaagaaaaagtactcaaacaggagataaaccaggggtaactaaaggtaaacagtgggttaagctaaaaggaaacttagagttattagatacaccaggtatattatggcctaaatttgaagatgaggaagttgcattaaaattagctttttgtagagcaataaaagatgaagttttagatgttgatacattagggcttagattaatcgaaaagttaatggaaatagaaccagaaaaattaaaagaaagatataaattaaatgaattaggagagacacctttagaaactatggaaatgataggagttaaaagaggtcttatactaagaagaaatgaattagattatactagaatagctactactgtattaaatgaatttagagatggaaagataggaagaataactttagaaatacctaaagatatgattgctgaataaaaatatattcaatataaaaaagagattgaaaaaattaaattgatttagtgattttagataaagttacttttgaaatttaatttttttaatctcttattttttataaaaaaatgcaaaaaattataaaattaaaaatagcatttttaatcaaaataagtttaaaaaaagttaaataatacgatttaaacaataatctgaaattttaagaatattgcatatatttctaatattattgacagttaggaatatttgttatataatattttcagaatatttaattaaaagaaactttagagggggatttaatatgaaagatacgaacaaagatataatagtagtaggctttgcgctatttgctatgttttttggagcaggaaatcttatattcccaccatttttaggacttatatcaggtgagagttggataacagggttctcaggctttatattagcagatgtaggtttagctttaattgctatagcggcagcagctaagtgtggaggagaagtaaataagatattatgtagatcgggaaaaacgttagcagtaataataggcgtagctataatggtatgcttaggacctttactagcaatacctagaacagcagctactacatttgagatgggaatacatccaataataggaaatgcagtatctccaataatattctctataatattctttgttgtagtattattacttacaataagaccatctaaggttgtggatataataggaaaaatattaacgccagcgcttcttatagcactagcagttttaataataaaaggaatagttactccattaggagaaataagaccagaaactatggttcaaaatgtattttcaaatggagtttcacaaggatatcaaactatggatgcattaggagcagttgcactttcaactatagtaattgcatctcttcataataaaggatatgagtcaaattcagaaaaagttagtttaacattaaaagctggtatagtagctggagtagcattatgttttgtatatggtggacttacattcttaggggcaacaatatctaaagcttatgtaggtcaagatataagtactatatctcaaacttcactaatagttggaataacagaacaattacttggatatccaggaaaagttatattaggtgttatagtagcattagcatgtttaacaactgctataggattaacttcagcaacaggacagtattttactaaacttactaaaaataagttaaagtatgaagtagtagttacaatagtatgtgtatttagtgcaattgtatcaaactttggagttggaactataataaaggtatcagcacctatattagatatagtttatcctgtaactatattattagtagttatgactttattctcagataaaataaaaaatgacaatatatttaaaggggcagcttatgtgactttaatagttagtatattaggtgtagtaaactcattagctaaaacatatggattacctataaatataccatatttatcttcacttccatttgcacctttaggatttaactggatagtacctgcgatagtaggaggaattataggaagttttataaagccaagtgaatgtttaagtatagatgcaaattgcgaataaagtaagttaatataaggaaacctaaagtcgttgatagaaatatcaacggctttttttatttatattgaataattagctaaattttaaaaaatttattatgtttaatatcatattcaaaaagtgtatctatataaatagcggaaaaagggtataacttggaggtttaatatgaaaaaaattataaaacgagatggaagtattgaaaaatttagtaaaactaaaattgcagatgctgtttataaatctactataaatagtgaaaaaggaatagatgaaaaattaggaatagctatatctaataaagtagaagaaatatttaaaaatagagataaatcattgactgtagaagaaatacaagacttagtagaagtattacttatggaatcaaatagaaaagatgtagctaagcattatattctttacagagaaaagagagctaatataagaaagaaaccttgggatatggatgaacttcaaaaatctatatggaaaaataaatatagacataatgatgaaaagtttgatgattggataagtagagtatctgctaaaaatactagaattgcaaaattaataagacagaagaaatttttatttgcaggtaggattttagcaaataggggcttatataaagaaaatttaaaagttacatattcaaattgctatgtattagaaccaccaaaagataatttagaagatatattcgatacagctaaaaaacttgctagaacttttagttatggaggtggagtaggaattgatatttcaaaattaagacctaaaggagcgaaagttaataactctgcaaaaaatacaactgggtcagtttcttttatggagttatatagtatgactacaggattaataggtcaaagaggtagaagaggtgctcttatgatatctatggatattagacaccctgatatagaagattttatagatataaaaactgatttaaataaaataactaaagcaaatatctctgtaagaataaatgatgaatttatgaaagctgttgaaaataatgaaaaatataaatgtgaatttacagttgatataaataaagaacatataataaaagaagtagatgcaagaaaactgtttatgaaattatgtaaaaataattgggactatgcagagcctggtatattattttgggataatataaaaaaacatcatcttatgagtgaagataataccttttctcatgctggagtcaatccctgtgcagaagaaccacttccaagtggaggaagttgtttacttggctctataaatttatcagagtttgttatacaacctttttatgaaggtgctacttttgatattaataagtttaaagcgtgtgttagagaagctgttatagctttaaatgaagtgttagatgaaggattggatttacatcctttagatgagcaaaaaataagtgtttctaaatatagacaaataggattaggggttatgggtataggagatatgcttattaagatgaatataagatatggatcagataaatctataaacttatgtagtttaactgccaaaacaatgttaaatgaagcagttaaacaatcagcacttcttgcaaaagaacatggtccatttaaagaatataaagaagaatgtatatttaaatcagaattttttaaaagaaatatagatgaagacgtaaaagaattagttaagttatatggacttagaaattctcaattacttacaataccacctacaggttctatatctacgatgttgggaataagtggaggcatcgagccaatatttaatttatcttatataagaaaaactgaaagcttacatgatgaagatgtatattataaagtttatactcccatagtaaaagaatatatggatttaaaaaacataacagatgaaaaagatttgccagatatatttgtaacagcaatgaatttaaattataatgatagaataaaaatgcaacaagcctggcaacaatatatagatgcatcaatttcgtctacaattaatttacaacatgaagctactgttgaagatgtatataaaatttatatgagtgcatggaaagctaaacttaaaggtataacaatatttagggatggttgtaaaagaagtggtgtacttataaatgaaaaacctaaaaaagaaaaagaagatattgctgaaaaggaattatcgataacaaaagaagaaaatgaaaaatttatatgcccagaatgtggaaacgagcaaatggcaaatacgggaggatgcagtatttgcttaaaatgtggatatagtggttgtaattaaattgattttaattaaagtgcttaaatttatattaagcactttaattttttgataaaatataaagataggataaaattaaaggagatattaaaatgaaagataaaagtgtcaaggaaataaatgcaattatagaatctattagccccaatgaatatttaaaatatatagacattttaaaagatgatgaaagaaagtcagttaaaaatatagctattaaattagctaaaaaactagataaaattagagctgaaaatgaaagattagagatgataaatactttcgaaaatgaaggttatcaaaaaggttatacatatataggaggtatagatgaagctggaagagggccactagctggacctgtagttgctgctgtagtagtttttaagcctggaactaaaattgaaggtataaatgattctaaaaagctaagtgaagctaaaagagatgaattattcgatataataaaagaacaagccttagattatggtatagggattgttcaaaaggatgaaatagatgaatataatatattaaatgcaacttatatggctatgaaaaaagctattaattgcttaaagaaaactccagattatttattggttgatgcagctcatgtgcctgatgttaatatagatcaaaaatctataataaaaggagactcaaagtctatatctatagcagcggctagtatattagcaaaagttacaagagatagtttaatgtatgaatatgataaaatgtatcctgagtatggatttgcttctcataaaggatatggaactgatcagcattataaagctattagagaacatgggataacgcctatacatagaaagagttttttaaagaacatattataaaaataaattgaagtggtataattaatttgtcaatcaaattgaagggagagatttaaatgcaatacaatgatatgctaaaaagtgcaagggaaaatttaaatgggagctgtagggtatgtaaagtttgtaatggaatagtttgtgcaggtgaagttcctggaatgggtggtaaaggaagcggaagtgcatttatagaaaactataaaagtttagattcagttaaactaaatatgagagtaatacataatgtaaaaaatcctgatacagctatagagatgtttggaaagaaaatgaaagctcctatatttgcagctcctgtaactggaactactttaaatatgggtggaaaattgactgaaagagagtatataaaaagtgttgtagatgggtgtgtaaaaaatgatatatatcctatggtaggagatactgctgtagatgaatttctaatagaaaatttaagagttttaaaagaatttgatggtaatgggatagtatttataaaaccatgggaaaactcagatataaaaagaaaaataaaactggctgaagaagctggagcatttgctgtaggtgtagatatagatgcttgtggattagtaacattatctatgcacggcaaaacagttgaacctaaatcaattgatgctataaaggatttaaaggcatctacaaacttacctttcatattaaagggaataatgactaaagaagatgctttaatggctgtagaagctggagtggatgctatagtagtatcaaatcatggaggtagagtactagatcatactccaggagtttgtgatgtattagaggatatagcaaatgctgttaagggaaaagttataatacttgcagatggtggtgttagaacaggagtagatgtagttaaaatgctaggccttggagcagatggagttctaataggaagaccatttgtaacagcttcatttggcggacttagtgaaggtgtagatatgtatgttaaaaagattataaatgaattagaatctactatgattttaacaggatgtcaaagtataaaagatatagataagaaagttatatttaaaagagcatagaaagatattataaataaaaaataacaaaggataatgtaagtttacattatcctttgttattttttatttaattttgataaattaaaaaaaattacattttaaatttgtatacaaagataaagtaatgacaatacttaagaaaaaaattataatgaggaaagtttttatgaataatatacaaaaaggagatttaggtgaaagtttagcaactaaatacttacaatctaaaggtgcttatacaatctagctataattctaacttacattattaacatatatgttatcttcattcatattttttaatgaaattatataaaaaagagcctcacggctcttttttatatagtacctaatattttgtttaattatatgtcaaaattttacttattaataaatctttcaatttatttacctcattgaaattcatataaggtatataatattgttctaatttatcatgttgctcttttgctttctttatgtttaataatccataattaattaattcatctaacatcttattgctaaattctaattcctctttatatttttcatgcttattactatccataaattcgtttaaatttattgttttaagattactatccttaaataacttactagttgttatagctatatctaagtcttttataactattgtttctattttttctggcaacaacggtgcatgaaaaatttctacttctattccattttcagtagcttcacttgcaactttatttaataaacttgattttccagtacctaaatctccttctaaataataaacttttcttatatcttttaataaagtatctgtatactctacatgtcctataggagataaagcacttccaaataaatgtattggagatttgtattcaccattagcttctacatctttaaatatttctttgattaaatttgaagtaactaagttaacttttccaaattccatacaatctaaatttttagattctatttcataagctataggtgcagctgctttaaaatatttaaatcctatttgaaaaaatctacttacttctttattgcacgctaaaatatctttcttatttttctctatttcttttctatcccaaaatcttcctagatctaatatctcatctactgctcctggatttttaggatctactatatgaggtgctgttgcatccaacataactgctcctaatttttttacaactatagcatctagtgaatctggatcagatgaacatggatataaatctacatcataacctttagatatcatttcttgcgctacttttttcattaaagatgattttcctactccaggaccacctttcatacaaaatactatatttacatttttaggtattacataatcaaaaaacgacttaaatccattagatgtatttccacctggaaacatctttcttgttttaccatccataaactaattccctccaaacatcttttatcgcctgtattaaattattaaactattatagtatttgtgtttgtccaataattattaataaagttttttactttatttatatacttctatatgttggaacttctgtattttttatataattttgagcttaaatatattttctttataataaaaaagtagctaaactttaaaagtttagctactttttattaatcaactcttatttcatatcctttttcagtgtattgtgaaattaactcagcccataattcatcaacacctgttttctttaatgatgatatagggtaaattttctcttcttttgataatcctaatttttttctaatcatgctaaagtgtttttgatattgccctctagatattttatctgccttagtagcaacaacaacacaatcataaccataatgctttatccaatcatacatcattttatcatcatttgaaggttcatgtcttatatctacaagtaagcaaatagcacataactcatctctttcttgtaaatatctttccattataactccccatttttccttttcagatttagataattttgcgtatccataacctggtaaatcaacgaaataaaattcttgatttattaaatagaaatttatagttctagtctttcctggagtctgacttgttcttgcaaaatttcttctatttaataaagtattcactgttgatgattttccaacatttgatcttccaactaaagctatttctggtataccttctgctggatattgacttttatttactgcactcattgtaatttcagcacttctaattttcatttatttcaccgttccttaataatgcatgttctaatacttcgtccatatggctaactaaaacgaattccatttcatccttaaccttttgtggtatatcatctaaatctgcttcacattccttaggaagtaaaactttagttatacctgctctatgagctgcaagaagcttctctttaactcctccaactgcaagtactctacctcttaaagttatttctcctgtcatagcaacattatttctaactggtatattagttaatgctgatataacacctagcgccatagttatacctgcagatggtccatctttaggtactgctccttctggtaaatgtatgtgtatatcattttccttatagaaattcggatttatatcgaatttatctgctatagatcttatataagatatacctgtttgagcagattctttcattacatctcctagttttcctgttaatacaatttgacctttcccttttaaaacattaacctctgtagttaaagtttctcctccaactgcagtccaagcaagtcctgtaacaacaccaacctctggttcttttcctgcaacttgatgtcttactttttgctttcctaaataatcttctaaatcttttttagttacaactatttcttctatactttcatcttcaacatactttctcgctgcttttctgcatatagttccaatagttctttctaaccctctgactccagcttcccttgtataactatttattatttcaagcatagtttcatcatctatcttaacaaacccttctttaagagcatgttcttttatttgtttaggtaaaagatattttttagctatatttagcttttcttcttctatatatccagatatctctattatttccattctatcaagtaaaggtctaggtatagtacttaatgtatttgctgttgtaacaaataaaattttagataaatcaaaaggaacctctaaatagtgatccacaaagtctttattttgctccggatctaaaacttctagcatagctgcagaagggtctcctttaaaatcagatgccatcttatctatttcatctaataaaaatacaggatttttacttttagcctctttaagaccatttacaattctacctggtatagatcctacataagttcttctatgtcctcttatttcagcttcatctctaactccacctagtgatattcttacaaattttctatctaaagaatttgctatagatttagctatagatgttttacctacacctggaggtccaactaaacataatattggcccttttaaacttttagataattttcttatagctaaatattctattattctttcttttactttatcaagtccgtaatgctcagcatttaatatttcttctgctctttttatatctagcttgtccttagtttctttattccaaggtagtgagaaaatagtatctaaatagtttctgcttacagataaatctggagccataggagatattttagagaatttatctatttcttttgatattttttctttagtttctttaggagcttttaatttcttaagttgttttctatatgtatcaacctctgaatctatatcttcatcttctcctaattctttttgtatagctttaagttgttctctaagataatattctttttgaactttgttcatacttttctttacttttaaagctatttttttctctatctttaataattcaatttcttctaataatgtttttaatattaattctagtcttgcttgaatatcaaactcatctaaaattgcttgtttttgttctggttttaagaacatattagctgctatagtatctacaaatctatcttcattatccatctcagctaaatttataagtatttctggtgataccctgttacttatatttatatattcctcaaaagcatcaaacacgtttctaactgtagcttgtacttctttatcatcatttatactttcaatatcataaacaacttcttctactgatactcttatacaaggttcatcttgattaaattcagttattacccctcttgatattccttcaactaatacccttaccccttctccaggtaatttcactaactgttttattttacatatagtacctgtatgataataatcatcttgagtaggcatatctattgctgaatctttttgagctgttaaaaatatcatttcatcatcagccatagcttcatctattgcctttaaagatttctctctccctacatcaaagcttaatatcatatatgggaatatagctaatcctctaagaggaactagtggtaattcacgttcaattttagtataatttttatccatgctaacatcactccttccaaatgctagattgcgtcactttatttattatatatttacataattgaattttcaataatattagatatttattaatcattaatatccatttattactattatgttataatgatattacttatatactaaattttaaatatggaggtttctatgcttaaactttttctaacctttttaaaaataggtgcctttacatttggtggtggctatgccatggttccactcatagaagatgagttagttcataaacaacaacttttaactcagcaagaatttatcgactacctatctattgcacaaagttatccaggtgttttagctgtaaatatatctattcttttagggtataaaacatataaaatccccggtgtattaatttgtacattaggttctatacttccatcattttgtatagtattagtgttatcatacttttattttcataaccaaagctccaatatcttaaatggtttctttaaaggtgtaagcccagtagttatagctttaatactttattcatttgtaagtatgtttaataaattacccaaatctaagaaaaatatatcatttttaattatatcattcttttgtgttggtgtactcaatataagtccaatatatttaatagtattaggaggtgtttatgctttatgccaaaaatcttaatgctcttcctaacattctttaaaattggaagttttagttttggtggtggctatgcaatgcttccttttattcaacaagagtttatacataagcataattttatatccaaccaacaatttttagatttattagcactttctcaatctactcctggtcctatagctataaatagtgccacttttgtaggttataaaatttctggattttggggatctttgactgcaagtataggtgttataatattttcattaataggacttacaataatctcaaaattatttgataagttcaaagaaaatgaaaaagtagaaaaagtcctttctagtttacgccctataacattaggatttatactagctgcggtatattcttcagctactgatattcactggggtatatatgagttaatagcgtttatatctgcattttatttattatatacaaaaagacttggatccatatctatagtattcatatacggatgcattggaatattattatctttgatttaaatatatttaaattaaaaaggagcttaatagctcctttttaattacgcactttcttcttcaccttttaatactattactggctgtgcttcttcttttacagattcttctgtaagtattatcttcttaacatcatctctagatggtatttcatacattatatccatcattatattttcgacaatacttcttagccctctagcaccagtatttctttcgatagctttttttgctattgctctaagtgctgaatcttcaaactcaagttcaactccatctaactctaaaagtttttggaattgttttactaaagaattcttaggttcttttaatatgcttattaaagcatcttcatctaataattctaaagtagcaactactggtattctacctataaattctggaattataccaaatttaagtaagtcctcagtttgaacttgcgcatatattttaccaagatccatatctttcttgctttcaattttagctccaaatcctagagttttttctccacctcttctttggattattctttctattccatcaaaggctccacctaatataaataatatattagtagtgtctaattttaaaaactcttgatgtggatgttttcttccaccttgaggtggaacattagctacagttccttctagtatctttagtagagcttgttgaacaccttctccactaacatctcttgttatagatgggttttctgattttctagctattttatctatctcatctatatatattattcctctttcagccttttctatatcaaaatcagctgcttgaataagttttaataatatattttcaacatcttccccaacatatccagcttcagttaaagatgtagcatccgccattgcaaatggtacatttaacgttttagctaatgtttgagcaagaagagtctttccagatccagtaggtcctaataaaagtatattactcttttgtatttcaacatctttattagatcctttatttttaccatatattctcttatagtgattgtacactgccactgataaagcttttttagctttctcttgacctattacataatcattaagagtctccattatttcttttggtttaggtaaatttacagcttcttcttcagttatttcttctacttcttcttgaattatttcatcacataattcaacacattcatcacatatatatacatttggccctgcaataagtcttctaacttgttcttgatttttaccgcagaatgaacattttaattgtcttttatcttcatactttgacatattaacacctctcttatctacggccttttagtaattacttcatctactaagccatatttcatagcttcatcagcgctcataaagttatcacgttcagtatccacttgaattttttctataggctgacctgttctttcagctaatatagaatttaacttatttttcatacttattattctttttgcatgtatctctatatctgttgcttgccctctagtacctcctagtggttgatgtatcattatctcactatttggaagtgccaatctttttccttttgctcctgctgctaataaaaatgctcccatagatgctgccattcctatacatattgtagaaacatctggcttaatgtattgcatagtatcatatattgccattccagcagttatacttcctcctggagaatttatatataaatgtatatctttatctgggtcctctgattctaggaataataattgagctactacaagtcctgctgtagcatcatttacttcatctcctaaaaatattattctatctttaagaagttttgaatatatatcgtaagatctttctcctcttcctgtttgttctactactacaggtactaatgccatggattataccccctatcataattatctatatatacaatatacagtagctgaaacagctactgtatgaatatacttaaatgattaaactaatttagcactatcaactaataaatctattgtttttcttatttttaattgaccttttatatcttctaaatctgttggtctcattgctgattttattttttcaagttccatgttgtacattttagccattttagcaacttcagcatcaacttcttcttctgaaacttctacattttcagccttagctatagcttctaatattaaagatgatttaactaatttagtagcttcttctcttttttcatttcttaattcttctattgatcttccagtcatttgtaataattgctctaattgtaatccttgatattgtaattggtagttaagttccattaacatgttgtctatttgagtttcaaccattgcagttggaacttctaattcagtaccttcagatattttctcaactaaagaatttctcatttcagcatctgctctatgtttagcttcttcttctactttagcttttaaatctttctttaattcttctaatgtattgaattcagttgtgtcagctgcgaactcatcatttaattctggtaactctttcttttgaacatttttcacagtaactttaaaagttgctggctttcctgctaagttttcagcatgatattcagctgggaactctacattaacttcaacttcttcacctttatttttacctattaattgctcttcaaatcctggtatgaatgtatttgatcctataactaagctatagtcttctccttttccaccttcaaaagcaactccgtctacaaatccttcaaagtctataacagcagtatctccactttctatagctcttccttcaacatctactaatctagaagctttatttctcatttcttctaatcttaattttacttcatcttcatttacagtatagtcaggttttgctatttctatacctttgtattctccaagattaacatcaggcttaacttctacattaacaaccataactaatccgttgtctttgcttatttcttctatatctaagtcaggtctatctattggatctatgcttaattcatctaaagctgttgggtatatttctgggaataacatatctatagcatcgttatagaatacgccttttccgtattgagattctattatttgtttaggtgctttaccttttctaaatcctggtatattgaatttacctttgtttttgttataagcttttgttactgcaccttcaaatttatcattatcaactgttattttaaaagtaactttgttaccatctctcttaagtaattctgctttcattattataatcctcctattggttatgtattcttttttatatatagtataatagatatcgttactataattttactattttattataacacattcttttttttatttacaagtgttccatttatatgaaataatgatgctaaatcacttatttcatagcatttctaccaaaatatccacctctgacattctttatttcagttactgccacgaatgctctagaatcatagtcatttatagttttttggaagttttgtaagtgctttctgtctaatactacttgtagtatatatttgataccctctcttcctttaccttctataactgtaactccaaaaccatggcttcttagataatctgcaaagtcatctacatcttcacctgtaaaaacttgagctgttataatccctatagcaagtttttcctccaaagtaattcctactacatttcctgttgcaaagccaagtgcatatgaaaccacttttacaaggtcgcccatatctcctaatactttatccatagcaaataaatatattaagatttcaagaaaccccacacaaaatgcaagttttttcttcccctttactacaaaaatagttctgactgtagctaatgtaacatctgcacatttagctagaaatatgagtaaataccccaagacaaattccatttaaataatcccccaaaaatttttttatattcttatttccttaacactcatattgtcatcacttatgtctattataacaaaactcctataatctacacctcttggcagagatacactgccaggatttatatagattatattatccttttcttttattaaaggtgtatgcgtatgaccaaatatcacaatatctgcatctacttctttagctttcttttgtaattgctcaagcccatatttaacaccatatctgtccccatgacatacaaaaatatttttattttctacttcaaattctaattcttcttctacattttcaaaatcacagtttcccctaactgccatcattccaacattagtcattttatgaatatattttgaatctacaaaattatctccagcatgtataattaaatcacattcctttaaataaggtatcactttatcgataaaacgattcattctatgagtatcacttattacccctattttcattatctcactatccttttgttaaattcatctctcataagttttaatgagttagctctatgacttatagaattttttattgaactaggtaactctccaaaagttttgttgtaattatctactataaataacgaatcatatccaaatccattatttcctttttcttcaaaaccaatcataccttcacaagtacctcttactacgaactcttttccactagggaatactaccgctatagctgatacaaatcttcctgttctttgactcataggtacatttttcatagcttttacaagcttttctctgttttgttcatctgtagcattttctccagcatatctagctgaataaacaccaggttttttacctaaagcatcaacctcaagacctgaatcatctgctatagttaccatattagtagcttttgctatagttcttgcttttattagtgcattatgttcaaatgtgtgaccatcttctactatttctattccatctaagttaacatctttaagagagtatatgttacaatcaaaatcttctaatatagctgatatttcttctaatttgtgtgcattatttgtagctataacaatttcatttggctcttcctctccaagaacttcactagaaatttttcctaatgcttttctttgagcttttataagctccttatttcctttttcaccaagctcaagtagtgcatttaaatcctttctactaaatggagattcttctcctgttccttgaacttctacaaactcacccttatcagtcattattatattcatatcaacatgagcattagaatcttcttcataacataaatctagaacatgctctccatttactatcccaacacttatagctgatacaaaatttcttataggtaaagtttttatttgttttttttcatataatgagtatatcgcatctgctacagctacgaatgctcccgttatagatgctgttcttgttcccccatcagcttgaattacatcacaatctacccatatagttctttcacctattttagataaatctattactgatcttatagctctacctattaatctttgtatttcttgtgttcttccatctactttacctctagatgattctcttacttttctttgatgagttgctcttggtaacatagaatattctgcatttatccatcctgttccactatttcttaaaaaaggaggtactttgtcttctatagatgctgtacatataactttagtttctcccatttcaattaatacagatccttctgcatatctagtaaaatttctagttattttaactgatcttatttcatcattttttctgccatcaattcttgtcatatatcttacctcacttaaacattttttatatcaaatcaatattatctaacttaactaaactcttaatataacagtacgttcactctaatatattagcaccatttaatactaattagtagtaatttattaagataattttcccattatttcttactttatcatcatctcaacagcttctttagaagttagctctatcatttctaaaaacttagcttcatcaataactggtattcctaattcattagcttttgtaagctttgatccagcttcttctcccgctaaaataaatgttgtagatttgcttacacttgatgtagcttttccacctcttgcttctatcatttcctttgcatcatttctttttagagtaggcaaagttccagttaaaacaatcttcataccttcaaagatatttactaaacctttatcttcagaaacaatagattttgtattcactccagcatcttctaatttttttataacacctatatttttttcttctttgaaaaattgtataacactattagccattatatctccaaattcttctaaattgattaactcactcatatctgcatttattatttcatctagactcttgaagtttttagctaataccttagctcccttaacacctatatatttaattcctaatccatttatcagtctatataaatcattttgcttagatttttcaattgcatttactaaattgctagctgatttttctcccattctttctaggttaattagatcttctttatttatataatataaatcagctatatcttttattattttattatctaacaataatgttactatagattctcctaatccttctatattcattgcatccctagatgcaaaatgaattattcctcttcttatttgggctgggcaacttatatttatgcatttaactgcagcttcgccttctaatcttaccgttggttctgaacatacaggacatttttcaggtaatttgaatataatctcatctccagtacgttcatctttcacaacctctacaacttgaggtattatatctcctgctttttgtactattacagtatctcctatacgaatgtctttctcatttatataatcttcattatgtaaagttgcacgagaaactgtagtcccagccagtctaacaggctctagtatagctgttggagttatagtacctgttcttcctacctctacaataatatctataagtttagttttcttctgttctgctgggaacttatatgcaatagcccatctaggactcttagcagtataacccattttttccctttgagataagttgtttacttttataaccattccatctatttcaaaaggaaggttagatctgttaaccgtccaataatctatatgtttaataatttcatccatatcactaaatactttataattaggactcactttaaaccctagtttatttaggtattctagtgattcactgtgagttttcagttcagtgttttctatgtactctaaattaaatataaatatatctaaaggtctcttagctgttaacttagaatctaattgtcttaaagttcctgctgctaagtttcttggatttgcaaataattgtaatccttcttcctcttgaattttatttatagtctcaaagttttcctttgatatatatacctctccccttacaacaatttcttcattatcttctacttttaatggtatagttttaacagtctttaaattttgagttatatcttcacctataattccatttcctctagtagcacctttttcaaaaataccattattatatgttaatcctactgataatccatctattttaaattcaactacatattctactccttcatttatagaatctctaactcttttatcaaaatctctaaggtcttgcgctgaatatgcatttgataaactaagcattgggattttatgagttacttgattaaatttatcaagtggctttccacctactctactgctaggagaatctgctctttttaatttaggattttcttcttctaattttataagttctttcattaatttatcatattcaaaatctgatatttcaggagaatcctcattataatatctattgttatgataatttattaaatctattaattcactaattctatttttagcatccatatatatcacctcttataaaaatacatataaaatattattaccatttttgtatatattaacttaatatgtaacactatctacctatattaaatcatttttaatatagatatatgagtacaaaagtattacaaaattatacttagttattttaatatgccttcggcataaaacaaaaagaacctaaaagtaggttcaataaaattatctattatatttttctaaaccatcaataaaaaattgagttactatatcttgttgtttcaatttaaaatgttttttttgtaaattttaaaagcatttctaaaacattagaatttattttaaaatatttaaacctaacgtctactttaaatttatatcatctatatttatcattctatcctccctattaaaattaaataaatagttttaatttattttagctaattttcttttagctcttatcaatgtcgatttgcttataccagttaattcctctacctgtctataagtatgattctctaacaagtttaaagcatgctctatttgtttagatccatatactttgggccttccttctttaaaatttggatctttcttagccaattcttttccagcttgagtacgttcaattattatatttcgttccatctccgctactgctaataatgttgttaaaaagaatttccccattgtagtgttttctaataatccaacatttaaaacatgaactgacactcctttagagaataaattttctataatattaatgccttcaattgtatttcttgctaatctatctaatttagttacaactaatgtatctccttctttaatattttctaataaattatttaatataggcctgtctaatctaatccccgtaaattgttcttctagtatttgagaattttcatattttgataaaatttcttgtttttgagcttgtaatccatgtccatccaattgagctctagtgcttactcttgtatatccatatatcatttattcatatccacctttttctatatttaaagaatgacttttgatgctaggttatgacaccattcaatgtattgatactactaaataaaaaagtaggtgtcaatactgttaagttatgatactattttataaataaaaaagtagatgcataatttacatctacttttcaaatattattatgattcttctttaatatttgtatatttatttaaaggctaatctgaaagtctttattacatcagaccaatttttatctttgtctatatgttgcatattaccaaaataatctttacataagtgattatactcattgtaatccaattctatcatcttttgtttaatccattttaatatatactttcttattaaatatttattattattcaatatatagacttcattatgaactctatctatattccctatttcatttatatttgcatctatgtggtaatctatatatttatctattccaattataaatttattttgaaaagttccatttgaacctgccacagaatctaaacactttaactcatttattattcttttcttatctttattagcaacgtttaacttattcagtttattagcaaccatataccaagtttctattctatttccaatctctaattgataatattgaaagcttctcccaaaaaaattatcttcttgattttttatatcaaagtaaatattttcatattcttctaggtaatcaactaattttttattacttaatttatttacatctcctagagtacctttagttatttctttaaatatgctatatttgtcactaactaaattctttaattgattttcttgccatttatagagttcatggccttttaaagattctcttccatgctctagatttttaaactgaatatctttccctttatttgatttcatgctcaaattatcttgatgtgttctatactttttatatcccctaatcatttttttataattagaattttcagctaaacctgtatcactaccatcaaataaagatgctattgagtttgtcgatgatttatttatatagttttcataatatatctcaaaaactatctgttttataaaaacatcataatctaataaataatattttttgaaaatttttttaaattcatcttctgaactaatagtatacatttctagtagactttctataactttattttttatgatgtccaatgacattgaaattcacctctccagtaataaaattttatctagtgttgtattataatttaagatctaacttcattacattatttacatcatttattatatcaccatcctcaaattcaaaatatactcttttaccagagttaagttcgtttaatttattaatcatcttatttgtaatcctaactcttgaattaattctaagaacattttcttttatatctaagtaacaatattttcctaattcacaaatatatattttggctttaagctctgatgggtaattttcaaatcctgtgcaataagtaccaaaaccacctttatatattccttcatatttccattgatcattttgttttattccagtcgttatgtttaccaaagatattccttcattgtaaataatcttatttattatgcacttatagtttttcttcatagtatataaacatctccttctaaataatatttgataattaaattatatacttatcaaattaactatacactggacaaaatttaagataaattaatatatttacttttttataaaatcgctatacctattgtaaatccataaaaaaataacacttcccctagtagtaggttattatatatttataaatcattaatttaatgaaagggaaaatttatgtattttaattttgataacgaaaaaaaaatttgtgagatatatttggatatgtgttggtctacaagtagaaatttcaaatatatagaaaaagatttatataatgtaaatggtttaatagaagaacctaaaatagtggattacttaaatggtaaattcaagttgtatagattttcatataataaagaaaatactaaaaaaaatagtgaaaaagattcatttgaaaatttctttatagataaaaaaaatattatacgtagacatttttcttttaatgaaaatgaatataatgaatttagagaaaatatcatatctaactgtaataaatattgtaatactagtaaacacaaaaatacctattatacaatagaaggaaaaactctatacaaacatcaacaagatgtttttgatttagttgaaaatacagatgataatggttttgcactatttatggaaatgggtacaggaaagacatttgtctcaatctctataataataaataagtttttaaaagaaaaagatgaaaaagaaaatttaaactttaaagtacttgtagttggtcctaaagatgctttaacatcatgggcaactgaaatggataatatattcaatttagcagaaatggataataaacattgtagatgctactcaacaaaaaataattataatgtttatctgtataatttagagggaaatcctaaaaagagaaaaaatattttgaaacaaaacaataaaggagtaaacatatatcttttaagttgtgatagtgcaaataaaactttatacggagaagataatataattaaagattttgatatatgtatagctgatgaaagtcaatttatgaagaatccaactagtcaacgttctgaaattatgcattatataggagataagttagataataaattaaagcttatactaagtggaactcctattgctaataatttaaatgatttatggagtcagtttagatttcttaggccaaagcatttaaaagaaagtaactactctaaatctttaatggattttaatatatttaaatctgagcattcctatactttatatcaaatgacagtatatagtggattgggtaaatacatagattttttatctaatataagctattttatagataaagaatctgtaatgaaggaagtaccttctcctgtagatttgatagaagaaatcgatcttgaagaagaaaaatctgattacaatgaactttcaaacatgagtagagaaactattataaatacaatagacatgaaagactatcttaagtataaaaatatacatgatgataagcttagaaaagaattagaggatatcagtgaggatgaaaatatacatgaagatggtacctataatatatattcagaatctaacgaaagtcaaacttcaaatcatagaaaagatttaaatggaaaaattaaggtatctatacgtaatatattgggacagtatattaaactacaacaatttacaggtggaattataaagacatcagaaggaactaagttggtatcaaccaaaaagaaaaataaattaatcgaaattattaataaaattttgaatgaagatataagtgaaaaaatagttattttcgctcattatactcatgaagtaaatatgatagaaaaagaaattaaaaatttaaatataaattatgaaaaatttaatgctcaagataatagcgaaaaaagaaaagataaagtaaaaaactttcaaacaaataaaaattgtagaatatttttatctcaaataagatgtggaagtagaggtattacactaactagctcaagaaatattatatattatagcatgaatttctcatatatagattatgcccaaagtagagcacgtatatttagaataggtcagaaaaaaaaatgtagatattatcatttaatatgtaaagatactattgatgaatatatacttcagtcacttagatacaaaagtgaaatgtctaagtaccttgctgaaaaatggaaagttattcttgataatccagatggtaaagatactacaaagcagttctaaattaaaagtagattcaagatctaagttcttttattttataatttaataattttatctatataatcatttttttattaactttttaatatacattacagaatactacaattgtagtttataataaaactgaggtgatattgtgaataaagaagaatttaataaattaaattttttagataaaatagattatataaatactaaattaaaagaaggacaaaccgtaattggaataagaaaagatattggagttggtgagaaagcattacaaaaagagataaaatcaaatggctataaatataataataaagaaaggcaatatatacccactacaaaagatattacaaagtgcactacagaaaaaacgcctacaattgtaggtgataaaactacaattgtaggcgatgaaactacaattgtagttcctaaacaccagcaacaaattttaggttatttagaaagtaattttgaaattttacaagagcttatagagaaatatacagccactacaaaagccactacggaaaccactacaaattatatttcaataaatttaatagatgataagcatctatatccaaagcctaaaagcataagaataaatgagtttgtatatcaagattggcaaaaattctgtaaaactaaacattatagcaaacaagatttaatttcaatggctcttaaggaatatatagaaaaatataaataaattacatttatattaactttgaaaaattacttttgcaatatagaggtagaatcttattttgtgtaatctgtgcgttaagagttatttttagtttttaattttaataaagtaaatctgattgatacattaatttgattcagtaaaatcaattctttgaggtatatcaataaacttgtatcaaaatcattgtccaatatagtaaactcattacatacggattatgtatttttctgacgacacccattatagtaaaaagagactaggtttccctagcctcttttttaaaggaataatcattccaataaaatcattagtattaagttataatatctttctttaatatctaagtattttgtgaaaaacatataatttgtatatctaattctattctaaaaactcatcacatatacaatctttgaaatcattaaaaaataagtgaaaattactatatctccctaaagaattcaaatcttgttttataaaattccaagtttctgtaaaattaccttctactgcaaattcactttcctttataaattttaaaaattctttttctttttcaaaaaatctatcttggaactcttctgcataagaaacttttaaatctttatctaaatttctttcattatgaaatacgtgatctaaattacaacaaaaataataagctttataactagttcccgatatctcatttaatccagacaatttattcataagatttgatttttgttgatttctagaaattatacgactttttttagatgaataaattttattgctagtatataaaaaaccattaccaaggcttggatcttcctccataaattcttcatcttgtatataagctccatcaatatcaatcaaatgaataatttgagaaatatcacttcttttaacttttgctattttcataaattcaataacttttttatttatactcgggataatattttggttgttagcaccttttctagaggttaaatctccacttgttatctgaaaactaactacatcatctcgtataatatccgataatatagcagataaagcttcttcatcagatataccttctacaagaaatagtataattttctttttaattttcatagaattattccttccaagcctttctaaaagcacgagaaattttagctttattagttcctatataaatttcttcactttggcctcctaatagaattcctcttagataaaaatctcttaaattattagtatttttcacattagttagagttatatatctattttccggatttgttgttgtgaaaattatagaatccttgtctaatttttctagcgctctaaggttatgagatgtaaaaataaattgaccctttcctttttcgctaactacctctaatatttctcccaataaatattcaaaaatacctgcatcaagttcatccactgcaagtagaattttttcattattatacatagcaattaaagcacttaatatagaaattatcttttttacaccatcagattcataccttaaaggtatttcaatttcatctctataagatactaattctactttaaatccttcagatccattttttaaaagttctgtcccataatttttaagtcctatatttaaagttggaataattgttccaattacaacattaatttgatttataatcttacttagtacctctaatttatgtttctctacaactgaaatatcaaataattttacagccattgttcctgttgatattatttcatcatcttcaattctaaaactaaaaggcattaattcatatgtatttattgctccaagttcatcattttttattacaaataaattccactctgcaaaatactttagacttttaattatatctattaactcgggttcatcaattaaccctttttcaaatatatctatactttcttttctgaatatgtaagaagtacaaagacgttttgcaaattctttctcaatattaagacttaattcattttttttatctttactcactatatttaagtatctttttttaggtttaaatgcagtcttgcttaactcatattcataatttaggatatctgatttagtagtccacttacctccatctagtttactataacttaatctttccttgtttattttagcaacggggctattagcagagtcattattattcttttcaatgctaatatttacatctgtattttctatattttttattttccccaaattaacttggtaaaatattttaaatagattttcttttgaattcattaaaaactcaaattctaaagaagtattttctttacctactgaaattaaattaggaaactcagaaaataattctttacctgaaactaaatatttaaatacatataaagcatctacaatagatgtttttccagaaccattttgaccatatattccaaccacatgttttaaactattcatgtcattttttttattatatgtaatagatccatttgctacatttttaaaatccttaatatgcattttttttaaatttataacaacgtctctcataaaaaatcctccattataatatatatatcattatgtttttattttttcaatattttttctaaaatcggaataaaatattccattttttaaaaatatgttcaaattatatataaatagatcaaaaacttatattttaaaaataaatataagttaaattagatccacttaataattttattgacgttaatataattactattattcataaaaaagattgtttattcttaaatatataaggttaaataattgtaaaccttatggattagaagttttttataatatgtgaaaatagatgtttactagtctttacttagtatttatatagtatttatagtatttatagtatttaagaagtctacatatattggtgttactactttataaagattaaaggtaagcattttggaactcaaaggtaagcattttggaactcaaaggtaagcattttggaactcaaaggtaagcattttggaactagttaaggtaagttattaataaaaagtacttaccttaatatgatatttgtgatatcttttagtaaaatatattatattaaggtgataaattaatgaaaaataagaaagaaattttactacaaccaaataatttgataaaaagtaaatataattttacaagcattgaaaataaactttttcataaaattttatacaatgcacaaaaacagtctagtaacaaacctatatatcatgcagtgattaaaaaagatgaattaaagcaatttattaaacataaaagtgatactactgacgaaaatataaaaatgatgttaaatttatttcaacaaagtatattggaatttgattatattgatacaaatggtcatttaaaaacatttggtagtggacttataaatacatatgattttaaccatgttactaatgaatatgaaataacaatgcacgaaattttatataaccacataacagattttatatctatgcaaggtagaggatatactgctttaaatatgtcgttattatttacatttaaaggtgcatatacccaaagactttatacactaatgaggttatggagtagggagaataaagaagttgaagttaaatacagtttagaagaaataagaagttatttaaaaatgaaaccagaattttaccctgaatataaacacttcaagcaaaatgttttcaagagggctttgaaagaaattaatgaaaaaggaaatatgaaagttgaaataaaacgagagattagaaaaggtcgtaaggttaatgaaatagtattttcagttgtagactatgaacctagaaaatactttgataagaaaaataatgagtcatttgaaatagtagaatgtaaagaaattaaggaagataaattgacaataaaagatgagagaataattgatgtttctaacattgaggatattggtaaaaaagtaaagaataaagatgtttttgttcctgatgaaagagtatttactaaggggacattgagaaggtttaagatagattttaatgagatcgattttaaaaatgattatatggaaagagcttttgaagatgcagtgatgattactcttgatagggatgacgttgagaaaattaagtcatgttcatataagttttttaaggggtgcttggacaataagattgaggagtataagcaagaagagcaaaaagatttaaaacataaagaagaaatggatatgaattggtaaaagttcgaggattaattctcgaacttttattttaaatttgtaaaatatttttattcaaaacatgcatgaggatcattacctaccacacattctccacaatctatgcatactccatagcctctttcaccattttcatcttcaggagtccaattaccttcatcatcgtgtccatgaacaaaatcaattgtacaatcagtatatactagacacttatatgtttctggtgtattttttgactgagtatcttttgtagaggtgttattaaaaagtttgaaaatttctccattaggagccatttcaaatacttcaaatgtatttttatcaactaacgtatatgtatcccaaggcgtttcatcagaaatatttactcctgaaaatatataatatttatttttcatatcatcagtaaaaatagttccaagattagatggcttattgtagttcaacttaactgaactagaagatgtacctgttgccttatatatagcattttttgcttttttaataagatcatcattattatttttagaagatggtggattttctttatttttcgatgcctgtttgtcttgttcttttttttgactatcaagtacagtcttatctttttcaatatctttttttagtttaataacatcattttttattaaatcatttataaatccttctttttctagttcagtacatagatctaatgctttgtcgtaatttttatccttttgatattgtttaatcaacacaatcttactggtttgatcattaagtttaaatatctctggatcatttttcttagatagcgccaacctaaaattagactctgctttgacatattctttatttgctaaagcaatattgccttcatttacagcgttatcaaattctttattggaacaaccagttaataaaattaaaaaacacatggccaagataataaatatttgtttcataaggaactcctttcaactaataaaaatttctatataagcaaaaaaatatataaattttcttaagggtgtagctatattaattatttaaaacttttccgtttcatgcccaaccccctttgaataaaagccaatttaaagctgttaattatctgcgtaacgtattcatcattaatgagtatgcagacgctttaaaatggatttaaatggataatttggacaggtgtgcgtaagtacacaatattattacacaaaaaaataatagccacttttaaattacaaatagtgactatacttttgagtgtattttatttatagctgcaatatatccatagagctatatgttaagctatatgcttaccataagctatgatatttatataaaaaaagttacaagttttgattattttaatatatctttcttagatataaatatccttaataatattaataaagtttatgatatttatatacttgatattataaataatataccaatttattaatatactatattttttaataaattggcattctgtagataatattttaagttgattttctttaaaatatagtgttttcaatgattatatgtgttttcaaaagggtggtttcatgtgaaataagttattgtctcaacctatatagctacctattatataggaattctataaaattgtaacgtttgatatcataagcactgttatatgtgtaagttatactgttgttttaatattttaatgggactctcaagataatctatattccatttgctaggaataaaatgtgggtggatattcaattttaataataaatttttataagttctttcttttgtctcagagaactttttatttgactgatgtttatcttttatgtattttaataatttgactttctctttgttagataaaagttcacttaattctattattttttttgcaccagtgtaggagtaaaaatctgcattctcattattacatataaactgtttatatttttctacaataatatttaagcaagtattaatatctaaataagatttaaaacgtctatctcttttactcaattctttactgtaggcttgaacttctaatcttaaaacattcttagccatctctaaatcatagtcatgaatacgtaccttattatctaatttatctttataatgctttaattgattatatttatcgtagaaattaatggtatagttagtatttatatttttttcatatgtggatttagtctttatataaaatgaagtttcgtcagaaaggttatattcttttatatgactcttatgtcttttatgatttgcatcattaaatattttattgaataacttaatatataaattaacatttttaatgttaaatatattaaatgatgtttctattaagtaggttttaaaattcaaaatgtctagtttaatacctataagctcatataacttatcatttactttagatactattaaagagtatgtatctatatatgaataagtattatcataaaagcctactggatttactatagggacaagctgattagttgctttattaagataataatctgtcatattacagactaggtttctgttatttaatatattaactaatctgccttcaataattaacttgttagatattagtgaataagaaatttcaagtccattatgactatacatatatttgttaactgtataactatcagagattatttctcctgtttcataatctattttagatggtacttctttaaatatatacttaaatttacttgagaacatagatgtatctaattctccttcgtaacatagtttaactttatctatcataaattccccttattaatatatagagtcaatttgatgtgtatgtattgatagaacttaggttgatctataaaaaaagttatgaaattcatacaaattaaggaattatgatagggtagccaaaaatatgtatacaaatagactatatcttttctaaaattattgcaattactatactttaattttatatatttgaattttttaactatataattcaaacataaatatacgtgataatcttttttatataataaatacattatcttaactcatcaatttaggttttacacaatatatggttctattgcggttaatatattttttatatataacaatatattaattctacaaaatcataaaaatccttcttgaaatttaaaaattctgtttctttcaatgttaataccgtctattacatttttacgatttttttaatatatttctattgattttttatagattcctaaatataattatttttaataaagaacgaattttaaaacaaggagattaaattagtatgattaatataaacttaactaattctttacaagttaataacttttatttttattggctattatagttaagtttgtatttatggtatatataaataatcatagatacaaacacaaaattgtttgtatctatgatggctaattttagcttgtacttaaggccacatagataatgctatgtggcttttttatcctaggcaaataaggtcacatagtgtacactatgtggcctttttgcatataaaattataattaattagaaaagaggtcaaattatgaataaaaataaagatatattaataataggattcgccttattttctatgttctttggagctggtaatttaatatttcctccatacataggattaacatctggtaacaactggttaataagtttcttaggatttatattagcagatgttgggataatattaatgtctattatagctgttgcaaaagctggctcattacaaaatgttataggaagagctggtaagaaatttggaattgtattagaagttttgatgatgctttgtcttggtcccatattagttataccaagaactggtgcaacaacttttgaaatgagtattttaccattgtttaacaatatcaatccatatatattttcaataatattttttgcattaactctcatacttactataaaaccaactaaagttatggatataataggtaaatttttaactccagtattattatcagctttattatttttaataataaaaggtattttataccctattggtgatttaaataaagttaactctaatgatttatttataactggtgttactcaaggatatcaaactatggatgctttaggtataggtggtgttgtagcacttgttatgacatcatttattaataaaggctataaagagaaaaatgaaaatataaaccttactataaaagcttctttaatagcatgtactggccttactatagtttattgtggattaacatacttaggggccactgcttcaactttatacgatagtaatatatctcaaactactttgctcataaatataacaagtgctattttaggtaattttggaactgtacttttagctataattgtaggatttgcatgccttactacatctataggtctaacatcagttacaagtaaatactttgaggacttaactaataaaaagttaaaatatgaatatatagtaatctgtatctgtacttttagtgccctagtttcaaaccttggtgttgataaaataatacaaatagctattcctatattaagtttaatttatcctgtttctatagttttagttgttatgaatatatttaaaaatattttcactaaggatataactttaaaaggcgctgcttattctactctaataattagcttacttacaattatagatagttttggtattaatataaatataattcataaactacctttttctagtttaggatttaattgggttattcctgctatattaggtggattactagctactttattatttgatgataaaaaagcaaataattaaattactttgatttttaaaattaaaaatggctgtacattaatacagccattttactaaaaatcttttatacttttcatttcatatttatctaattgttctcttaatatagacttatctatgtttaattttaaatcatctaaagttatatctaaatctatatctgtttttatagtagctaactttttagacataaaagcattttctttttctgaaattaatttcttcataggatttctaatacctaactcatttttccactctgtagcaagtatctttaaccctttatcatctagtccatctatagacttatagatatcttctaaagtgtcatatttctgaagtagaggtatacttgttgtatctccaagaccctttattccaggtatgttatctgatgtatctcctgatatagccttataatctataatttgtgacggttttagattctttaccttttttaaaaggtctacactatattcaaaagtgttattaggaagattaaaatgttttaaatctatattacatatatctgctaatgaacttgcttttgatgtattcatccacactgtagtgttatagtctaccaattgtaaataatcttcatctttagtgtataaagctactggtatattttcttgaaattttttagccaaggtaccagcaaaatcatcagcttcaaatacattttcataattatcactaggctcagatataaataccttaactcctatagtttcaagtatttctcttaataaatcatattgctcttttagtggaacttctataggttttcttgtacctttataatcatcatatattaattttctaaaagtcatacgagtagaatctagacatacagctatgtgagtaggtttttgctgttttatcatagataacataacttgcataaatccgtatactccatttgtatatattccatctttagtttgaagtattttatcatagtgaagttctttttcttctatagttttagcaaacattatttgtctaggaagtctagcaaagtaattagtgcttaaaagtgatgaaccatctattataagtaatttttctttacttttatcactatctaaatttaaatatttttctttagttatcttaactatatcctctgatatagatttttcttttttattatcttttattgtttctttattttttattctaaaatctgtattcattctagatccaacataactattaagtcttatatattcacctctagttaattcagattctttgattttatctttattggcttggttttgttctagtaaatcaaataaatccatatttgtctcctctttgtgtaagtttaattaattataataaattaattatatcatactaagttaatatttttaatgggagtaattatccccctaaacttacaatgttcatctaaataaaaaaattttattcatttggttaattaacttaattgcctaaatttatatattttaaataaaaaagttctaagatttattttcttagaactctttatttattatttattctgcatcaaaatctacatgtacttttcccattggagtgtttatatctatataagataaattgaagttttcatccataacatctatcttatattcaaagaatatatcatcttctttctttgacataaatatataacttccattttctttttcttctatttcgtcacatatttcttcatatatttcttctccacttacaggtccattgtaaccagcattttttattttatcttctattaatctgtatatttcttccattttgttaccttctttctattcatctataaaatacagtctacattctatttttatatattgtcaactatattacttgaattttattcgtaatactcttattttaacttataaatctcatccttatattatcttgtttgtactcaaacttggcatctgatttagtcttattaaactttttatctaaaagttcttgataagtccctgtataagatactactttacactttcatctttaacttgtatttttactatttttattaaaaacttctccaatgaaactatatacaataatacctctttttattacttacattattatatttatagtatatattgtcaacctaataaaaagtcttttactaaaagattatttaaagcaaatataattaatttaatatttcctataaacaaagataggagatgtttcaaagtagatatctaatgataactcttttgaaacatccccttaaatttattgattattacttaaatttaaagctttattaaatctattaagaggtaatatagaaattattatagttgacaataatccttctacccctaaacttgacacattgtataagaatgaataaacaaatacattcataccttctggagcataatctccaaagaatacgcatccagatattatattcatagatacactaagtgctaaagcaaataaacatcctaatataacttttgattttttttcttttccaaatgttcccgctagtccaagtaacattgttggtagtatataatctagtaaaaattgtgctggatgaattatataagcaccatttaataactttaataaaccatatactagaccacctgttattcctatagtgtttccacataatactgataataacattgttggtaacattgaaaataatgaaattcctccaccttgtggatattttataaattctatcatactaagtatatatgatatagcactaaacatacctattgtaactattattttagcattaattttagcattttttaaacctttaagatagtatagaaaaaacgctatactccctattattataattgcattaatcattttttcccctccattttaaacactcattatatatatcatagctttttaatatagctgatactattgcatatccatctacatttatatctttaaatgtatctatattgtctaaagttattccacctattaaaactttaggtatatctacatttttatctatttcttctaattcttttaacgttactaatgttgcatcatttttagtagaagtattaaacattgcacctacacctatataatcagctccattatttttagcttctctggcttcttttatgttatgtgctgatactcctattatcttattatctccaactagttttctaacttcttttaaaggaatatcactttgccctacatgtactccatctgcatcacaaagcatagcaatatcaactctatcatttattacaaatagtgcattatattttctagtaagttgtcttagtttgtatgctttttctagaaactctttgccattagcttgcttttctcttaattgtacagtggttactcctccttttaaagcatcttctatacacttataaaagtctcttccttttaatatatctgagtcagtaactaagtataattttaatttttctttcattattatatctccctacaatttttaaatatatttaatacttttaattaaacatcatccttatttacttcttcatatcccatattccaaaaatctaattcatataagctagactttacaaatatttctgtaagtttttttatttcctcttcacttaaatttttacatatatgatttgtatattctaaccactcttttaatatctcatcaaattcattatctgcatacatttttatccaatctttgtagtagtttccttctaaattgtctttgtatgtttcatataaataatgaccaatatagttataactccagttacaaggcagagttgccattactatttcttttactccacctgttaaagatactgcttgcatataacttatatagctacttgaaaccatttcaagtttgcacttttctgctactattggtgctacacctaatcttttcatgtactcaatatgtatcgcagcttcatcttctatagatccatttgctgccttattgaaaaacttcatttctttgatagtatctgcttttaccattcccattgcaaatactcttgaaaactcttttaaatataaataatcttgtataaggtatcttttaaatttttcttttggtaatgttccttcacctatttcatttacaaaaggatgatttagataacttttccatatgtctttaacttcattaaataaataatctgtaaatctcactaaaatacctccaccctagaaaatttatttagtgtttcttcatttaggttatatatattatccattaaactaactttgaaacttccaattcctatgtttcctttatcagctaattctccgcataaactcattgtaagaattcccatactagccgcttctaatttattttcactagctcctaaataacttcctattaaactagcactcatacatcctgttcctgttatactttttaacttagaagatccgttataaacttttatagtttttactccatcagttataacatcaacttttcctgttgcaactactacacattctaattttttagatactttttttatgatgtcatctatattttcatcttcttcaaaagaatctacaccttttccattaacatcaaatccacctatgtattttatctctgaagcattcccttttattacatcaaacttaacttcatttattaacttttctactaataaagctcttgacttagttgcaaatgcacctactggatctaatactactggcttattaaatttattagcaatttttcctgcctttaaaaataagtcaatatgtgatgagttcattgttcctatatttataacaactgaacttgcaagtggaattatctcttcaagttcttcataagaataactcataagcggacttgcacctaacgctaatgtaatatttgcacaatcgtttatagttacttcatttgtataatgaagtaccaatggattaatatctcttactttacttaataaatcaaacatattttatctctctcccgtttaccttagtttattatttatttaaatcaaatttatagaaatgatgtacaggacctactcctttacctatgtcaaaactatattttattgcatttgttatatattccttggcttttgaaatcgcttctttaacatctaatcctagtgctaagtatgcagttatagcagaagataatgtgcaccctgtcccatgagtatttttcatatctaatctttcacttttataaatttcaaaagtatctttttcaattaaaacatctactgcatctccatctagatggccgcctttcataagaacataatcaggacctaatgataagattttttccccaactaatttcatatcatctaggttatttattttcatatctgctatctcttgggcttctagtgtatttggtgttactatgtacgctttaggtataagatatttaattaaattttctttagcttctggttttaaaagtgaatatccacttttagaaatcataactggatctactactaaatttttaggattatacttatctagagtatcaactataacctttattatttctggacttgataccatacctatttttacagctttaggaggtatatcatcaaatacaacctctatttgctttttaattatttccttgcttaactcttctactaaaaatactccttgtgtactttgagctgtaatagcagttataacgctcattccataagttcctatagcactgaaagtttttaaatcagcttgaatcccagctcctcctgaggagtcagaacctgctattgtaagagttggtattttgtacttttccattttgtagtcccccttatagttcttataagttttatttaataacaaaaaagaccatatccctaagtaggaatatggccttaaatttctatgcaaataaattacatttgtatattaagtaaagctttcctacgctggcattatccagatcaggtttgagggttaatgaataaaaattcatctctcagccataaggcacccctagctattcattttagattacaattttattatagcttagtttatacatatgtcaacaaaaatttatataaaaaaataccaccctaatattttattaaggtggtgtttttttattaagctacttctacctcttctatagaagcttcttcaaattccttttcactacttgcaacaactaatgtacaagtattatctcccattacgtttactgttgttctaaacatatctattattctttcaactcccattataagtccgattccttcaagtggaagtcctactgattgaagaaccatagatagcattatcattccgactcctggaacacctgctgttccaactgatgctaatgttgctgttaaaactattgttaacatatcatttaatcctaagttaataccataaacttgtgctataaataatgctgcaacaccttgcattatagcagttccgtccatatttatagtagctcccataggtatagtaaatgaacgtatacttttacttactcccatttcttccattaattctaaacttactggtacagatgcattacttgatgctgttgaaaaagtaactgctgctactttagtaaatttacgcgcaaaatttataaaaccaaatttagtaaatatcttaagtgaacctccatatactacaacaacatgtattaaaagtccaagtaaaactactaatatatatttaactaatgatcctatagcttgtgttcctacagttgcaaaagtatttgttataagggcaaatactccataaggagcaaatgtcattataacactaaccattttcatacaaacttcatttgcactttcaaagaacttctttaaaggtttagctttttctccaactaaactcatagatattcctgtaagcattgcaaagaatattatctgtaacatctctcctttagcaaaagattctattggatttgatggtattatatttaatactatctctgataaagattgattttgtccaactgttgtagtttgagatgctactgaacctaaatcaagtcctgctccaggttttagtaatacccctaatgctagagatatacatatagctatagctgttgtcattaagtaaaatcccattgttttaaatccaattcttcctagctttttaatatcttccatagctgatacaccacatactaaagaaacaaacactagaggtactaccatcatctttatagctttagtaaatccgcttccaactacatttataaatcctccaagtaaaaatgtatctttaaaatagcttcctggcattttactaagtactataccaaataccataccaagaaatagccctattaaaatcttgctcgttagtccaagttttttcatgtatttatcctccgtttttttatttatgtttatattatacattaaaaacacatttttgtatacttttttaaagttttcgacatttttaagttcattttgcttaataaaataaataattatttcaaattactttattttatataatataattaatatattgctttatatattagctaatatcttcttaaaaaacttatatatcaaactattacatatatttccttaaaatatgttcacaattgtacgattatttttttaattgaataaaaaaagactgtaaataagtctttatagaacttacttacagtcttttttatctttatactagtttaatatttgtatttcaatattttgtcttccaaagtttacacaatctgattcactattcatgaatatatctatcttatttccttttatagctcctccacagtcttctgctgtaaataccatgtcaaacttaggtatataaactctagttccgtatggtattactgaagggtctacagctatagttccccacttaggagtagttcctgtagctgttatattatgtcctgaatatgcacttgcatttacagtcattaaacgtccatttttattagtagacactgctacttcttcttttttaggttcttctttcttaacttcatttttttcagttgtagctgaagcattattttgagtagcatttgatactactgttttattttcttttttaacttcattactttgttgtactaaagtagtactattatcttctttaactgattgattattatcagcttgagattctgttaatacataatctccacttatccaccctgtgttaccatctgataattgtactttgtaccaattgttttcttcttctagtagttcaacaactgttccctcagttaatgaacctattttttcattttctatagatggtccttttcttacatttaacttatcagctgttactgtagctttttctttagcagtataatctccatttacccaaccttcttctccgtctgaaagttttactttattccatccattactagtctctaatatctcaacaaccattcctctgtctaaagatgctattctttcatcatttatagatggtccttttcttacatttaatttttctgcttttactacttctttttctgctgcatatatattatttgctgaagcatacattcccccaattactaatcctaatgttaacaccaatgattttttagctcttttattcatactcataaaattcctccattcaataaataaaattatatattattaactatcttgtatttttaaattcgcaacttacgcttttgttacttttttgtaacttttaattaatcttaatatactttttaggttttgtaaacagttttcagtaaaaaaatcaaaattggttacaaaacagttacaattcgtaaccagcctaacacgttgaaatttcaacatttgacgtataactttaacctttttaatttttacataaaaaaattttataaattatctattttttcatactaatcttatatttgtaacttatttctaagcttttattttcattttaatgttgctttataagcttgtatattaattagtaactaattttatatcttatatatagtaaatttaaattcaattcacttaaaatctattttttaaaatttaaaacagtttttaataacatatatatagtatataaactaaagtttttatattaataatataaattaagaaaagtttattttataattaaaaaaataaaaaatgagtgaagattacttcactcatttatatacttatcctaattttttttagatagttcttcattactattagttatcttagatataacaggtaatattaatcctattcccattaacactaacggtgttaaaacatttaatgaaactctaaatatccattctgggctaaaagctgctacatctgttgggaacattcccattatacatgcaaatgcagtaaacccgaaacaccaaagtcctactaaaaaccctaacttatcatttttaataaacttatattcagttttaaacttattacttagctttttaagccccatataagctaggaatacccataagtatctcattggcattacaactgaatttaactttaataaccagttaaataattcattagtgttacctattcctaacgcaggtactactattaaagtagaaactaatatagctgtcattatatacccattaactaaaactccatttttatttgttttagataaagctttaggtataaatttggcatctgcatcacctaataatactttaagcggtgcatctattgaaaatactaatgcagataactgagccgcagtattagctaaagcataaactataacaaataagctacctaatccgtaatgatctccaagtaattggaatgcataatattgaccattcatcattaaatcctctggtatagcatttgcattaaacatcatacccatagctattgaacctaaaagtgcacaaacagctaccattcctgctaatactaacattcctttagggaagttcttagatggattttttgtattatttacatatggagatattttttcacatcctccaactgcaaatactaacattgataaagtagttaagtatgcaaagtcaaacttaggaacaaatgacttaacagttatatcaggtgttgcaacgtgtcctgttatagctggagctgctagccctaatactatatatagtaaagacataacaaacattgacataccagctatattacctataacttttaatacttttactccttttgttgatacatataaaaatactaaaaatactactaataccatcgattgtaatattaaaggatttaattcttttaatactcctgctaattgtccagatggactaattgcccatgaaagtgcaattaataaagcttgtggcttttgagctaaataaggaacatgtacaacccagtatgtccatcctgccataaatgcaagcattggtgttgtagttgatcttatccaagctgaaaccccaccttgagagtctttaaatgcagatcctaactctcctaccattaaagcatatggcacaaagtatagagcaatcataaatatccatgaaaatactactgtaagcccttgatttgcaaagttatttacaacattcccaaatccccataccataacaaatcccattaaagcgatattttgccacgttaaatttctgttttgatcagtcactaactttttcctcctgaaaattttgtatgatttcgttttccattatatattataatatcattttgtcaatatttagaatttaaaataatattcataaaatctatataatcattgtaatattctgtaaattagatgaagctatatatttttatctcaaatttatatatacatatattaaaaatatagttataaatacattaaaaccaagctacacttaatttaaataatatcttgatttcaaggcaattttgaagttaagtttaatttcactttcactttttataatgtaattattatttactaattcaaaaattttttaatatttttctaacatttatattagttttaacaataagtttattttcaactaatatatttggagacaataaagatttagctatttttattaaattaacacagttatctatttatttattacagctagttaattttgtacctatagtcatatcaaatacaattatatctatatttaatataggggatgtaagtttgtatgttcatgaaagtatgaaattatttatatatgctataatactattaacgttagtaatacttatagtatctggatatgatattaaaaataaatttaaaaataaaggtgttataaaatattttagtttagtatattccattgttataggatgcacgatttacttaagtaaaatagatacaagtggtagtttatctttattagaagttcaaaattatggaggatattcatatataggttctagtgtcgttgtggggattgttatatcttttttatacagctacgcaatattatatttaggatataagcttaataaagaataaaagctttaaatgggagagttagcatgaacaatataaaaaatgcaataaataaaagtaaagaaaaagttgaaaatataagagaaataaataaattaaataaaattataaacaaagctcaaaatgataaacttaaaatttttataaatgcaggaatgtatatttatgaaaaagtaaggaaagatgaaatagttgaaaaagatttagttgaattatttaaaaatatacctgaaatagataaaactatatatgaatctactaaggaagttagcaatatagaatctaaaaaagaaaaaatttgtgaatgtgggaatgtattagatgttgatagtaatttttgttgcaagtgtggcaaaaaaatagaagaaaataaagatataataaaatgtgaattctgcttaagtgatatagactatgattcaaacttttgtggatgttgtggtaaaaaaattataaaaaatgtataataaaggggatgctttatgcatcccttattataatttaaagctctatataaaagaaagaaggaaacagtatatgtcaaaggctaaaaaatcagcagtaatattaatgattataacattgatatcaaaagtaacaggatttcttagagatataatattggcaaaaagctttggagcaagtattataactgatgcttatataactgcacttaatataccagttgtactatttacaggaataagtgcatcattagggacaacttatattccgatgttttttaaaataaaaacagaaaagggacaggacgaagtaaataaatttacaagtaatgttttaaatatagtaataattttaagtatacttacaataattataggaagtatatttacaccgtatatagtgaaaatttttgctatgggatttaagggtgaagaattagaaattacaactagattttctaaaatacttataatctctataatttttatagcaactaatggattagtatcatcttatttattagcaaatggaaggttttatatatcaggattagttacaattccatttaatataatatgtatactggctataataataggaagttttacgaattcatatgtaatggtatggataactttacttgcgtatgtagctcaacttttatttcaaataccatttcttaaaaaaagtggttataagcataaattaaacgttgatataaaagatgaaaatgtaaaaaatataatttatttaattttacctgtgtttttaggatcatatgtaaatcaaataaatagtgttataaatagaacactagcttctacattagatacagggagtataacagctcttaattatgctaataaattgaatatatttgctgtaggagtacttgttatatctatttctactgttatgtatcctatgctttctaaatttgctagtcaaaataatataaaggcttttaagtggagtttaataagatgtataaatatagttataattgtaatggtacctgttatgataggaatgattatattttcaacacctacagttagttttttatttgaaggtggatcatttgatgcaaaagatacatatttaacatcaacttcattaatgttttattcttttggtatggtggcttttggaataagagatatagtttcaagaggattttattctttacaagatacaaagacacctgtaaaaaatgccatggcagcagtatttattgatataattttttcaattatactaattaaaaaaatgggaataggtgggcttgcattatcatcctctatatctgttatatttggggctattttacttataatatctttaagacgtaaagtaggcagactgggtattaaaagtagtataaatacatttttaaaaactttaatagcatctataattatgggtgtaattgtaaaatatttatacgattttatttttataataggagagaattttatacataaggaaaaatatttaatattaataggattaattgtatgtagtttagtaggagcagttatttatttaatattaagtattttattaaatattactgaaattaaagaaggtatagaacaaataaaaaatagatttgttaattttataaaaaaagcgagataaaaaatcttgctttttagttttatataactaaacaagtgtatggtataattaaatacataataaatagttaagatttaggggtgaaaaaatgagcgtggaaatatcagaaaaaatatgcagagataacataaagtatttaaatttactttctaaacagtatcctactatatctcaggcatcaacagaaataattaagttagaatcaatattaaatctacctaagggtacagaacattttctatcagatatacatggagaaagtgagccgtttgttcatgtattaaaaaatggttcaggcgtagttaaaagaaaaatagaagaattatttggggattcacttatggaaagtgagaaaaaaactttagcaactttagtttattacccagaacagaaattagatatagtattaaaggaagagaagaatataaatgattggtatagagttactcttcatagaatagtagatttatgcagatatgcatctactaaatatactaaggataaagttagaaagtatcttcctaaagagtttgcatatataatagaagaacttttaaacacagattgtaatattggtcataagaaaaaatactaccaacaaattataaatactataatagaaatcgatagatctaaagaatttataatagctatatcaaaattgattcaaagattagttatagatagattacatataattggagatatttatgatagaggaccaagacctgatataataatagacactcttatggattatcatagtgtggatattcaatggggaaatcatgatattttatggatgggggcagcagctggacaaaaggtatgtatagcaaatgctcttagaatatcagctaggtatgctaatttagatatagttgaagatatatatggaataaatattttaccgcttgctacatttgctttaaatgtatataaagatgatccatgtaaagcttttttacctaaaatatcagagggtgagtataacaaaaatgaaatatctttaatagcaaaaatgcataaagctatatctataattcagtttaaattggaaaatgaagtaataaaaagaagacctgaatttgaaatggatcatagatgtttattaaacaaaataaattatgaaacatctactataaatataaatggaaaagaatataaacttaaagatagtaatttcccaactatagatcctaaagatccttgtaagttgactaaagaagaagaaattgttatagaaaaattaaaatcatctttcgtaaatagtgaaaaacttcaaaaacatacttcattcttattctcaaaaggaagtatatatcttaaatgtaattctaatttattattccatggatgtattcctttaaatgaagatggaagctttaaaaagtttgtaatagataatgttgaatatagtggtaaatctttaatggataaatttgattcactagctagagaaggatatctttatagagaaggtaataaacaaaaagagtatggaatggatataatgtggtatttatggacaggctgtgcctctcctttatttggaaaagatgatatgactacatttgaacgctattttattaatgaaaaagagactcataaagaaaataaaaatacatattttaagctaagagatactgaaaatatgtgcaatatgatatttgaagaatttgaattagataaaaaagaatcacatataataaatggacatgtacctgttgaatgcaaaaaaggtgaaaatccaataaaagcaaatggaaaattaatagctattgatggtggattttcaagagcttatcaacaaaaaactggtatctctggatatacattaatatataactcatatagtcttcaattagtatcacatcaacattttacaactacagagcaagtaatacttgaagaaagagatatattatctacaacatctattgtagaaagaaatataaatagaaaatatataagagatacagatataggtaaggatattcttgaaagcataaatgatttaaaattacttcttttagcatatcgaaaaggtttggtaaaagaatctttaaattaagttaaataaaaaaggattaacactgatatattagtgttaatccttttttagattcatttataattaaattctaatcttcccagcactcagtaccagataatccatctatagatgatgatttaaatacaggttctttaatacctgattttttttgattagtataatcttttaaagctaagaaagcaaatttgctaagtctagctatagcataaagatttataattgccataaatcccataaataaatctccaaggttccaaactatatcaactgcagttaaagaaccaaatataaccatagctacaactaatactctatatgctgttaatatagttttatttgtacttataaactctatatttgattgaccgtagtaatagttacctactatagaactaaatgcaaataagaatgtacaaatagctataaagtaatttcctataactcctatttgagaagatagggcaaattgagttaattgaattccagataaattagcagatgcataatcactacataatattataaatgccgtacaactgcatataactagagtatctgtaaatactccaagggcttgaacaagaccttgcttaactgggtgagatgttgttgcagcagcagctgcgttaggtgcactacccataccagcttcattagagaataaacctctttttacacccataattatagttgtaccgataccaccaccagctatagcttttaatccaaaggcattttctataataagtttaaaaatatcaggtaatttatctatattaatagctattacaaataatgaaactaatatataacctactgcaaatataggaactataacttcagatattttagcaactctatgtacccctccgaatattacaagagttgttaatactgcaagtattacacctataagtattttatcaacaccaaaggcagctctaaaagcttctgtgactgtatttgactgtattgcattaaaaacaaatccaaagcttattgttataagtatagaaaaagcaatacttaaaaatttattattaagtcctttatctatatagtaagcaggtccacctctgaacccttcttcatccttaactttgtatatttgagcaagtgtagactcaacaaagcttgaggctccacctattaaagctactaaccacatccaaaatacagaaccaggaccacctaatgtaatcgcaattgcaatgcctgcaatgtttcctgtaccaactctagacgctgtacttatacaaaaggcttggaaagaagatacctgacctttttcattatcagaagctgaaggtgcacctaaaagccttatcatttccttaaagtatctaaattgaacaaatttacttttaaatgtaaaataaatacctaatgttaataataagacaattaaaacataggaccataaaaaattatttaatgataaaactatgttgttaaaaatattcaaattaatccctcctaagtaaatataatttattaaattcttaaaaaagaaattatgatataaataaaattcatttttaaaaattatataataaaaaagaaaataaatcaacacataaaacaatatctaaagtttaggaaaatgttatctattgttaaaaaaatgaataattaaaaaaataaattgcaataaagtaagaaaactaattaaaaaagtcaagtattttatatattttcattaaaaaataaaagaatatatattcaattaattactaaaaataagttgagaaaaagttatcatatattaattaaaattacttgattctacaaaaaaataattatataataatatatgtaattaaatttaattttattttgttcatgaaaacgtaatctaatactaaggagtgtacattatgggcatatttgatatatttaaaaagtcaaaacaagaagaatctaaagggatagtatcacctacaaatggagaattattagaaataactaaagttccagatgaggtattttcaactaagatgatgggtgatggttttgctataaaatcaactgatggtattatagtatctcctgtagacggtaaagtgggagtaatttttgaaacaaagcatgctgtaataatagaatctaaagaggggaaagaagtacttatacatttaggtatagatactgtaaatttaaaaggagaaggatttgaagtatttgtaaatgtaggtgatgaagttaaggctggagataaattggttaaaatggatttaacatttatagaagctaatgctaaatcatcaataagtccagttatatttacaaatttagaatctaatgaatctataaaagttgtagaaggacctgttaaggcttttgaaagtggtagagtagaaatagttaagtaatattaaagagtctgtaaaaccagactctttttattttaataaatttagtcataaaatttttcacaagtacatatatattaataaaagatttatatttaactaagggggaaaattttatgaaaagccaattaataagagatttacattctgtaaacgtaaggagacatccaataactagaaaaaaattagagagtttaaaaacttcagaaatagttaatatatggtttgaatattttaaaaaagaagaaaaataaattagatatatataaataaaaaaagtcacaatttgtgacttttttattttttgtattttataggctcattataagttatacctttagtatcaacttttatagaatttattataaatgtttcccctttagagcctaaatcttctattttatgtactaaatcaaggttttttattacttttccaaaaccagcatatttaccattaaggtggggtgatgatttagttacaataaaaaattggctaccagcactatttttatactgacttctagccattgataaaaccccttctgcatgttttaaatcatttttaaatttatttttagtaaactcaccttctattgtatatccaggcccacccatacctgatccttcaggacatccaccttgtataacaaagtttttaacaactctatgaaatgttaagccattataaaaattactattagctagatgaataaaattgtttactgtatttggggctatatgaggataaagttcagcctctataatacctacatttaaaacatctatataagctataggtaattctttaggtgctactctaatctcatcagatatttgatttttagatattccaagtagatttaacactttagataacaaattattttttttattcataaaaatcacccttcaaagttttgtatattttagattatatcatataaatattgtattaaaaaatatttgtataagtgaactaatgactgtctataattaaatttatataatataaaggaggtaatgtattgaatagtattattttagtgggaagattaactaaagacccagagataaaatatataggagaaaaaggaattccagttgctaattttatactagcagttgatagaaagataaaaaaggatagtaaatatcaaaaaacagattttataaaaattgaagcgtggaaagaagctgttgaaatttgtataaataaattaaaaaaagggagtttaatttctcttacaggagaacttagaatagatgaatataaagataaagaaggtaaaaataaatacatagctaaagttattacttataatataaacttattaaaacagggtaagaatcagtttaatggaatagatatatttaaaaatgatgataaagttgcattaaatgaatcagcattacctttttaattaaaatattcctattttattatttaagataagtatattataaatttatgaaatacctataaatgtataataaattaagaaacatattaaggttttaataaataatactagatgatataataaataagatagattgttaatatagaattaataagaaaattaataatataaaattagacaaaattaaggagaagcaagatgagtaggaatttagagatatcatattcgtttgggtatgtatacgataaaagcaaacttatagtactatgtccagttggttcaaatactataaatgaagaagaatatgaaatggaagttgaagtagcttttcttgaagatggtatagaatgtgcatttgaacaagaagatataaatgaagctaatgaaattataaaacctcttgaaacgtttttaatgaaaccaaataagattataccattagtaactagtataaaaaatgttgaaactaaagaagagttaaataaacttttaaatgattttgatgaagaatatggtgtaaaatcaagttatataaaaagaggatatgaaatatgtgatatatacgatgtatttcaaaatgtagtaaaatatataccaaaggaaaatatagaaaatttaaatatattaaaaatagaagctgaaaagtttgatttaaaatcatttatagaaacaactagagaaaatttagatgatgaattagattctagtttaattcctttagttatgagaaaaagtacacttacagatagactttttgtaaaagaagataatcaaactttaaataattgtgatctaaatgaaaaaactttattaaatgtgttagagaaaaatagcttatatactgtatttggattagaagcaagttcacctactgaagaaattttatgtgcaaataaagaagtagttaaagatataaacatagatatgggagatttagaaatttctcaggtaagggattttggatatattattgaaaaaaataatgaatatttatgttttaagatagctaattttaatcatgaagcagctaataatcaaaaaatagcacaagtagttgattatagtggaatatttaaattaatgatgataaattttataaatcaatttgtaaaataaagataaggccagttaaagggccttattttattgtaagaaatacgctaaacttgcactaatattacatatatgataaaattcaaatgttaatttaatactataagaaacaggtgataaaatgcttaatgaaactaaagatttactaaaaaatttctatgaattagatgatgaaatatttaatctgtctaatgaagttatggatgatataaaagacagatttgaagaaataaaagaagtaagagaatataatcaatacaaagttttaaaggctatgcaagaagccaatttaagtgataatcattttaactggactacagggtatgggtacaatgatataggccgtgaaaaaatagaagaaatatactcaaaagtatttaatacagaagatgctatagtaagacctataatagttaatggaactcatgctctaacactttgtttacaaggtatagtaagacctggagatgaaattttatcagttacaggtaaaccgtatgatacattagaaggtgttatagggataagagaagaaaaaggatctttaaaagagtttggagttacatataatcaagttgacttcttagaaaatggagaagttgatttaaaaggaataaaagaaaaaataaatgataaaactaaattagttatgatacaaagatctaaaggttactcttggagaaaatctttaacaatagctgatataaaagaaattatagatactgtaaaaaatataaaaccagaagttatagtaatggttgataattgttatggtgagtttatagaaactaaagaaccaacagatgtaggtgctgatataatggcaggttcattaataaaaaatccaggtggaggacttgctttaactggtggatatatagttgggaaaaaagaaatagtagaacttatatcatatagacttacatctccaggaatagggaaagaatgtggacttacatttggaactagtagaacagttttacaaggatttttcctagcaccatatatagtttctcaagctttaatgggtgcaatattctgtgctagaatgtttgagaaattaggatatgatgttcttcctaaatatgatgatttaagaagtgatataatacaatgtgtaagattaaataatgcagaagaagttatagcattttgtcagggagtacaagcagctgcaccagttgactcatatgtaaaaccagagccatgggctatgcctggatatgatagtgaagttataatggcagcaggtgcatttatacaaggttcatctatagagttaagtgcagatgcaccaataaaacctccatataatgtttatttccaaggtggacttacatttgaacactctaaaatgggaactttaaaagcatatcaacatatgaagaagaatagataataaaaaaaccctcaataaagagggtttttattttttaaagtctattaacttaccttcaaataagtctttgtgttttatatttatattaaattcttttgataaaaatcttatggcgcctaattctttatgagtaactatagatattgcatctcctttgttatttcccctagcagttcttccacatctatgaatatactcattactaataactgggaaatctagattaaatatatgagttacatctttaatatcaagtcctctagctgataagtctgacgaaactaaaactttagctttacctgttttaaatttatataaagcattttttctatcttctttagtcattcttccatatatacaaactgagtttctattatggaagtttagtttttcatttatagtttctatactttcttcattgtttacaaatactatggcttttttaggatttacagcagctaatgactttctaagaagtttgaatttatctcttttatcacctaataaatacatatgatttatatttttattaactattgtattaggtgtagtatttaatactttaggatctttcattatttcttttaatgtatcaatgcatttagaattagtactagcagaaaatgctaacaattgtctatctcttagagtacatttaatgatatctttaacggtatttgtatttttaccaataactaaattatcagcctcatctaaaactatagttttcacattatgtacctttaattttctctgttttattaaatcaagtattctaccagtagtaccaactactatatgaggttttacatcttttatattctttatttgcttttgtatattaacttcacccattaaaggtaatgtagtaacatttatactagaattttgagaaagtaacttaatttgatttactatttgcataacaagttcatgtgttggagctaaaaccataacttgagtttctcttttagtagtatctattttttcaaataaaggaagtaaataagctagagttttaccgcttcctgtttgagattgtactattaaatctttatgattttttatatcttcaaaaacaagggattgaactttatttaaattgtttataccttgtttttgtaatgctttaactaagtttgaatctaaatttatgtctttaagtttgttcattttttactccttttttatatattattactaaattagatttatagtataacactaaattagatataattcaaaagtattaataaagagtaaataaatttgaattattatacaatgttgtactataatatactttatgaaatttaaaaaggagcataagcgtatgggcaacaaaggtgatgaaattttattaaaattaattttatggagagagagaaaataactctaatacaataccatttcacataaaatcagaaattcaaaaaatagaagactatgtagaacaagtattgtattattcaagaagtaatgatgttaataaagattatataattaaaagcttcaatttagaaaatatagtaagaaaagttataagaaaaaatgctagagattgtataagtaaaaaaattgctataaacattggaaatattaacaatataatatatagtgatcctaagtgggttgaatttataataaatcagataataataaattctataaaatattctaaaagtaaaaatgctgtaatagatataaattctattgtaaataaaaataatatagtattgaccataactgataatggagtaggtatagacgagaaagatgtatttagagtttttgaaaaaggatttacaggagaaaatggaagaaaatattcaaagtcaacaggtataggtttatacttatgtaaaaaactatgtgataaattaggtcttaatataaatctaacttcgaaaaaagatgaaggaactagtgtaagtatagtatttccagtaaataatgaagtatttaaataaaaattataaaatatttttaaaaataggtatgtataaaaatacatacctattttttattaagttaatattattattgatagtgaggtaatatgtgttatacaatatatataacaaagtaaataaatattttagataataagagaggtgataaatttgatattaaacttagactttaatagtgataagcctatatatatacaaataagagaagaaataataaaatcaatagctaaaggtgatttagaggtaaatgaatcactaccatcagttagagcattagcagatgaaataggtatcaacttacatacagtaagtaaagcatacaatttactcaaagatgaagggtatataaatatagatagaagaaaaggagccatagtaaataatctacctataaaaaaagaagaatccaactttaataatattaaagaacaaatagagcttctagtagcagaaagctatttaaaagggatagagaaagatgaatttattgatttatgtgaaaattattttaaaatgtatggggtgaaaaaataatgaaaaatatggtaggtcttatcatattagctccaatattaatatttacacacttacttatggtatatatacagatgataagtggtaaaaactatttttatggagtatacgttaaaaatgtagatttaaatgaggatgacaaaaagcgtatagataaaagttataaaagaagaatgaattatacattaatacttacaataattttaagtattttactaattaaaacctttggaagtgaaactattgtaattccaatagcattaactatttatgtaggacttagttattggtatttaagagatagttatatagaggtaaagcatataaagagtcaattaatatcttattctaacggggaatctattaaaaaacaaggtaagcaaagtgttactatagatactaaatttataaatgaaaaagaaaagcttaaaaaaaagtttaaaatattatttggtatatgtatatctatatctataatgtcatttttatatgtagctataaactacaataatttgccacaaacaataccaatacactgggaaatagatggtaaagcagatgcttatgcaccaaaaaatcttaaaaatgtattcttcataaatatattagatataggtatggtgttaatgcttagttatatgggagtaggaacgataggatatagaagttatatagatactcaaaataaagaagaaaatagaaagaaagctttaaaatatttaaataatataggctattcattgtttattataactataagtatgcaattggcaacttctataaaccctatgcttacagttaacaatatgagtatcccaatggcattagtttttataactatatttataccgataatagtaagtatatttttaatttatagttttataatgttatcaacattaaaaacaaaaaataagaatacttatatgatagaaagtgatgatgaaaaatggatatatggatttatatattacaacaaagaagacccctcacttatggtagagaaaagattaggggctggatggacatttaatatggctcataaatcagctaaaatcataactatatttttaattttaataactatatttagtttaacagcgttttaaaaataaaagagctatatcaatataagcttaattatttaacttatatttagatatagctctttttatatattataaatttaattattaaaatccttaggcaaatgaactttaacaagttccttatctttaactaaataagtctgatcagactcagctgcaatatccttattatgagtaaccataataacagtcttattttcatttttaacaatatctttaaacaaatctataatctctttagaagtattttcatctaagttaccagtaggctcgtctgcaattattaattcacactcacaacaaagtgctctagctatagcaactctttgttgttgaccaccacttaaggttaaagtcttttgcataccttgagtttcacttataccaactctttttaacatatttatagcaacttgtttattatcttttgtttttatgccttttatgctcatagcagatgttatattttctattgcattcatgtagttaagaagattataaccttgaaatattattgaaacatatttatttctgtatttttcaagggaaatgctttttaaactccttcctttatagctaatatttccactagatggagaatctagtccacaagcaagagatataagtgtagttttaccagagccagattgtcctataattgtataaaactttccagcttcaaactctatatcaatatcttttaaaactttcgcatttgaattatacgaataagataccttttcaaaacttaatatattttccatgataacctcctagctatgtttacttaatatatttttagggtttaacctcattataaatgctgctggtataatggttgcaactacagatataactagtgaacataaagacatttttaaaatgtctgtaccatttgcttttatatctaaatcatttataggatcaacgtcttctaatggtttgttagtattcataaaattaccttttccaccacccatattttctctatcaaatccaaggtgttttgatgatgattcttgtgattgaatagatatttcattttgtataagtttatctccaactatattgcttatagattttccatatagagtagatattcctatagcaagtactaaaactaatactacttcggttaataactgacctataatcttaatctttttttcacctagagccatcaatataccaatttcatggattctatctttcatagataacattataataagtgataatataatacctccaaatatagcaatcacaactaaagtagttttagaaaatgacgctacgttatctattggacccatcatagcttcataagctctatctcctgcatctagtttgaattgctcaaaatctatattagtttttttagcttcagctatgaacttatctacatttacagggtcatttaatgaaaatgtcatagaatctactgaattttcataattagaaccttttaatttattagctaatgtataaggtacatacatagtattatatggtagcatagatgtaaatctataagcatgatcatctatttcactatcatctttaaaaatccctattatttcagactctatagaagtattttcatcttcagtggaagctaattttattttatctcctacctttagttcattctcatctgcaaaagtttcttcaactaatactacatttttatctaaatcattttcagtaaaagctctaccttcttttagagttatagtttgagagtttactttttcttccatattaaaatcatttaatccacatatagtaacatcaccattatttttcatatccataggaggcataggtcccgactcttgttcagattcttcatcagctccaactgctgtcaaattatctaagttggcagatgtgttactttttaaagaatattcagttacatattttgaattttttaattcatttaaatattcaattggtattggtacttttattggttcaaacttaggtttttcgccattattaatgtctttagcatcttcttgattttttttcattaacttatccatatctaaagataaagtaacttcagaaccaagtttttgtctagccattacagaagctaattctgtagctgattggatactaaagcttgttagtattactaagcatacggttagcattatagctaaaattattaatgtttttcctttcctttcttttaaagatttaattgatctaaatacaaaattcatacatttcatcctttcttttcctgtttgataaataatttatattccttaccttaaaaaaatcttaaataaggaaattaaaaatgtgaaaatttaagtttagctaaaggtatgatgtttatacttagattattgagttaacagtttcaggaggaaaatttatgagaattttagtggttgaggataatatcgttttagcagaaactataaaagaagagttatgtagtaacagtaatttagacgtttctgttttaaataatggagaggatgctctttatgatatagaaaggagtatatacgacattataatactagatataatgttacctgggttaagtggaatagatgtattaaaagatataagaaataaaggtataaaaacaccagttctaatgcttactgccaaagaagcattagatgataaagttggtgctttttcaattggagctaatgattatattactaagcctttttatatggaagagttaattgctagagtttatgcagttcttagaactacaggatatatatctaatgaaaatatgttagaatttaaagacttaaaaattaatctagatgctagaaaggtttatataaatgacactgaggtagagttatataaaaaacagtttgatatacttgaatattttttaataaataagggacaagttctattaaaagaacaaatatatgataggatctggggcatagatagtgatattccacttgaaatagttgaagtacatattagcggtcttagaaaaaatttattagctagtggatacaataaatatataaaaactaaaagagggatagggtatatatttgatgatgaataaaaatatattaaagaaaacaagaaaaaaactaataacactaaatacactagttgttggagttatatttatagtatttactttatttatatatagctatttttataatttaacttataaaggtgtagataaagaactatatatgcagtatgaaaaaactgtacataatataaataaagggagtctagaatttaaaagtaatgttcctccagatattatgttaagaggaactatggtttatatatcaaaagataataagcttttaaaagcttatcctgaaaatatacaaaattatataaggccctttaatttgagtaaaaatttaaaagaaggaataactcattataaatatgatgaacacagttttagacaagttaaaatagactacaattcatataccatagaagtaataaaaatagtagatactgaggagatgcttttaagtcaacttaaatttgtacttattacatcaataatgctcgcattaatagctgtttattttataagtggttttttaacaaataaatcattggaacctatagaagagtcttggaagaatcaagaactatttgtacaagatgcatctcatgaacttagaacaccacttactataatattttctaaggtagaaagtattataaaaaggcctaaaaataaagtagaagatgaaatgaataatttagtgatagtcatgaaagaagtaagaagacttagtaagttagtatctgatttattaaagttaactaaggaagatgcaataataaatataaacaaatctaagtttgatattgtagaaatgataaatgatatattaaagcaatatgaagatatatttgaattacaaaataaaaagttaaaagttaattatactttaaaagataataatatttactcagacaaggaaaaactaaagcaaatatttataattattatagataatgctatgaaatatacgaaggaaaatgattatatacaggtatgcttatctgaagaaggttcaaatgtgaaaatagaagtaaaagatagtgggataggtataaaggaagaagagctttctttaatatttaatagattttatagggcaagttctcatagagaaacaaataaagaaggttcaggtataggtttatctatagctaagttattagtaagtaatttaaaaggagaaatatgtgtaaattctaaatataaaaaagggagtacttttagtatatatattcctaaaaaataattttataatttaagtttaaccattttaaatgcaaattctaagttctttatttattttattatacttactaaattgtaagattagttaaacttttatgtaaggctttttttctaaaaaaggtgtaaaattaatttataataataagccaggaggaaaaaaatgaaaaatatattaaaagtagaaaatatagaaaaatactacggaaataaagataatataagtaaagcaatagataatataagctttaatgtacttgaaggagaatttgttggaataatgggacctagtggtagtggtaaaactactttacttaattgtatatcaacaatagataatgtttctagtggaaagataataataaatgaccaagatataacaaaacttaaatcaaagaaattagataagtttagacaaaatgaattaggatttatatttcaagactttaatttattagatacattaactgcatatgaaaatatagcattagcacttactattaaaggagaaaaaagttctttaatagattcaaaaataaaagaagtagcaaagtatcttgaaatagaaaaagtacttaataagtatccgtatcaaatgtctggaggacaaaaacaaagagtagcttcagctagagctatagttactaacccatctttagtattggcagatgaaccgacaggagcacttgactccaaatctgcaagattattacttgaaaggtttgaaagtttaaataaagatttaaagacaactatacttatggtgacacatgattctttcactgcaagttatgctcacagaatactctttataaaagatggtaagatatttaatgaattagttagaggaaatgatagtagaaaagaatttttcaatagaataatggatgtaataaccttacttggaggtgatgagaatgtattctaaaattgcctttggtaatgtaaaaaaaagttttaaagattatagtatatactttctaactttaacacttgcagttagtatattttatagttttaactctatagaatctcaaaaagctatacttgaaatgaatcaatctacgtctaatactatagacatactatccgatttaataggaggtttatcagtatttgtttctattattttaggaggtttaatattatatgctaataactttttaataaaaaagcgtaaaaaagaattaggaatatatatgacattaggtatgggaaaatttaaaatatctaagatattagtatttgaaacaattatagtaggtatagcatcattaattagtggtttattaattggatttgtctttagtcaaggattatcagttttaacatctaaattatttgaagctaatatgagtgaatataaatttataatttcgcaaagtgcaattataaaaactattatttactttggtataatgtttttattagtaatgatatttaatagtatagtaatatctaaatataaaataatagatttattaacagctggtagaaaaaatgaaaatataaagtttaaaaatccactaatgtatttaataacttttatattatgtattttatttttaggatttgcttataaatttattattgatgtaggcttagatgttaaaaatcctaaatttatgatatcaatagtttttggagttttaggtacattattgtttttctatagtttagcgggagcactactttttatagttaaaaagaataaaaaaatatactttaaaaatttaaatatatttatagttaaacaattaaacagtaaaattaatacaaactttttatcaatatcagtaatatgcttaatgttatttttaactataggtatattatcaactgggatgagtttaaaaaatgctttagaaagtagcttgaaaaatactacaccttttgacgcaagtgcttatatgtatgtagataaaaatgataaaataaaaagtgtaaaagaatctttagatgctcttgattttaaatttgatagttctgaacctcatgtatattttaatacttacacttcaaaagttacaattgctgatgttttaggaaaaaatgcaattaagtcaggagataagatgttaggccaattggatggtcagtatgtagagtttataaagatttcagattacaatgatataagaaatttaactggtaaaaaagccgttaacttaggaagtaatcaagttttattaatgtcgaataataatacaatactaaatatgattaataattcatcagaaaaaaatagtactgtaaaaatagacggaaaagattatattatacaaaataaagaaccaataaaagatgctcttcgctctacaggttttacagacaatttattaactttggtagttaatgataatttgactaataatttaccaattcaaacatctaatttagatgtcaatttcaaagaaaattataataagtcagaagaaaagttctcaaagttatttaaagactttatggatggaaagataaattatgataagttcggttttgttcatggttatactaaaaaaactatatatgaaaataataaaggatcagttactgtagtactatttacaggaatatacctaggtatagtatttttaatatctagtatggcagttttagctcttcaacaattatcagaagctagtgatagtataaacagatataaagctcttaaaaagttaggtgcaaatgataagatgataaataaaagtatatttgctcaaacgttaatatactttagtttgccagtatctctggctttcatccattcaattgtaggtataaaagtagttaatgaatttatagctttatatgataaaccagatataggaggttcttcattatttacagctatagtatttatagtaatatatgctgggtacttctatgcaacatatacaggatacaaaaatatagttaaaaattcataataagcattatgtaaaagcactttaaattattttaaagtgcctttttattataaattttcatcagtaaaagtgatataattatataatagataaattaataagggggtaataatatgtttgaatcaaatcgtaaaaatttagtaaaaaatatgaaagaaaactcacttcttataatgtttgcaggggatgctccatatagaagtgctgatcaacaatataaatttacgccaaatagaaacttttattatttaacaggtatagatgatactaaagtcatattaactatattaaaaactgaaaatgaagtaattgaaacagtttttgttcaaagagaagacgaacttatggcaaaatggataggaagatctataagtaaaaaagaagcaagtgaagtaagtaaagtaaaaactattaaatatttagatgaatttgaagatgtgatttcatcttatataaatagattaggtatagataaaatatatcttgatcttgaaagacagtctatagatatacaatcaacacaatctcaagacatggcaaataaattaagaattaagtatccgtatttaaaaattaaaaatatatatcctaaaatagttaaacttagaatggttaagtgtgataaggaagtagaaataattaaaaaagctataaatataactaaagaaggaataatatctatggctaaaaatattaagcctaatatgaaagagtacgaagttgaagcatactttgactttgaaataaaaaggttaggtgcatctagtcatgcatttaatacaatttgtgcttcaggtaaaaatgctacagtacttcattatgaagataataatcaagttgcaaaagatggagatttaatattgtttgatttaggagcagagtttgagtactattgttccgatatatcaagaactattcctgttaatggaaaatttacaaaaagacaaaaacaaatatattcaatagtattatcagctatgaaggaagtagaaaaagaagctagacctggtttgaaattaaaagatttaaatgatatagctaaaaaagtattagctaagggatgtatagatataggacttattgaaaaagaagaagaaatatctaaatactatttccattcagtgagtcattcactaggacttgatactcatgatgtatggaattttgatagcaaattagaatgtggagctgttataactaatgagcctgggctttatatcgaagaagaaggtataggtatacgtcttgaaaatgatttattaatagtaaaagagggttgcgtaaatttatctaaagatatacctgttgaaatagaagatatagaaaatttaatgaaataaaatatataattactttaaataaatttttttaatagtgttatagaaattcctttttttgaaactataagtttatgaaaggaaggagatatacttatgaaaaaatttataaaagaatttaaagaatttgctgttaaaggaaatataatagaccttgcagtaggggttgttataggaggtgcattttctaagatagttacttctttagttaatgatattataatgcctgtagttggaatattaactggaggtataaatttctcagaatataaaataactttaaaagaagctattggaaacctacctgccgttaccttaaatctaggtaattttatacaaacaacagttaatttctttataattgcattttgtattttcttatttataaaagctataaataatatgaagctttctaataataaagtagaagcttctgtaactaaggaaaaagaggcatcagaagaagttttattgcttagagatataaaagaactattaaagaaaaagtaatttataaaataagggtatatagtttagctatacactcttatttttatttataagtatttataaatttaaatttattttttgcataatatatggtatgatataaatactattttaatatgaaacattttaaaatattaaaggggtgccataacatgaagaaaagtaattcaatcaaaagaacaatgtcctttatgcttatattcagcattgtatatacagtttttgaggggaatttgttatttttaactccaatattaacggtattaataccatttagatttatgaaaaataaagaaaatacagataaagatttttttgataatcaaaaaactttaactaggttattattatttaattttatttgtattgaattagtaagtttagtaactcaaaatggaaactatgaaacatttaatataagtgtaatgatgctaatttatttactttattttaagatgttgtcatttaatgagaaaaaggttttgacactaaaaaataatcctcaagctgtatacgaaaaaatgaagctaaaaatagatactttagaaagtgtatacaataaaggtttggaagaactagaaaatacagaggatgaaaaagttaagatgtcaatgaaatctaaattagataagctaaatgtaaaaattaatacatcaaaaaaacaacttgctatgatagaatctataataaattctgataaaaatagtaaataaaaaggtgaactcatatgagttcaccttttatagtttatttattaaacttgaaatcctaagtataactcaaatatacaagatattataaaatatatacctattatatatggagttgctaatagagttactattggatttgataatattaataaaccaagtattataagtactacattatataaagtattagtattaaagcctatattttttctcttaattgacattattaataagtatatacctcttattaatgcccatacaccatagaataatattaatgtttctgtagttgatataggtgtaaaccaaactataatatttaagatgtttaggtattgcatatacatattttatattttttataggttttaagttataattactgtctacatcataatcaaataagttattttctgaacttatacttaactgatgctctatcttatttttattaactccatatatatcctcaatcttcatatttcctttatcgtcaaaatctaatatcatataaaagctatatttattctttaatttttcttttaaactattgcttttatccccatctaatgaatttaatgctaaattcatattctgttttactaacttattttctttatctaatacgcaatattctaagtttcttaaatttgaatttatatattcattattttgatctatatcctcatcaaaactatctctagctgccattttatcttcggtataagtactatctactcctggctttaattctaacataagttctgatggccttattttgttattattattttcatcgtataacttatagtaaaaactatatatagacttttcaatactctctatcaaattataatcttcttcataaacattataggaaaatttatcactgtctttttttatcttaggatatactaataccattccaattgaagctataagtattgtcataattattattatacttatagcagttttattgcttttcaattttgtatccaacgccccacaccaccttcaaatattttggatttttagggttcacttctattttttctcttatatttcttacatgaaccataattgtatctgtgtttactgctctttctttccataccttttcatatatttcatctgctgaaaatactcttcctggatttttcataagtaaagttaatattttaaactcaataggagttgtttttacaaaattaccatcaacacttacttctttagtgtttatatctagttctagtcctcctattgtatacaaattttcatcatttacacttttttgaacaacatttaaaaattttttatatcttctaagctgagaattaactctggctaaaagttcaagcggtctaaatggttttgtgacataatcatcagcacctatattaagacctgttattttatctatttcttcagattttgctgataacattattattggaaaatcataatgttctcttaatttcatagtaaattctataccatccattttaggcatcattatatctacaatacctaaatgtatagtttctttttctagtatctctaaaccttctaccccattgtttccaataaatactttatatccttgattatttaaataagcttttatagcataagctatgtctttttcatcttctacaactaaaatattaaaattcattatctttaccccactatattattttctctagtatataatatcataaggcattcattgtttttaacattttgttttgacctcctttaaaagattttctatacctttatgttagtatcaattttttaagataagttgtatataaatctaaagattttctaaagattctttatagaattttttattaattagcaaaaaattttatatattagctttacttatttttaatttctaattaaaaataagtaaagctgtatcattttcttatgatacagcttttatatttatttaaaatataaatctataaatatttctaattatttatctagttctttaaaacttattccaacagttttatttaaatcatattcatctaccatatttccatcttgtttatatggatgcatgtaccttacttcaaacttagaatctccacatttatatattacttctgttacaccaacttctttttcaaatttactttcaatttcttcaattcctttaggtaaaacactttttacatattttaaagattcttccatagtaagttctttaggatttgactcactactataagatttttcttttaatttttgttttaaatcttttttatcattttcttctttttttatgttgttttcaacataattttcatttgagtgtttttgattagaaacatttaaattttcatttttatttccatcactattacatccaaccattaatgctaatacactagttaatactattaaacttattaatctcatattctccatccccttattacctttttatatcatttctagttaatcatttttacactcgcatttttctttccacttattaagttttttgttataaacattttttatactttctatatctacattattatcataactttggcttattattgagctagcaactattataacatctaaacattcttcaactatatcttcttttgatttatttttatatccacatccacaagcattagaatgacttaatactgcttgtgatgcttctcccacttcttctgctaatttcaatgttctttctactaatgtctttgtatctattgaagttaatttttgtatttcttcaaaatttactaatgtcttatttcccatctttttacctcatttttacatttttataaattgaatttaatattctcttattattttaacatatttataaatttttccaaaatcatataaaaaaatccattatataaatttatataatggatttttattatcttaaattattgatttataatcatttttaaacattaaaataaattaataaagttatctccatattgaattaatccatggaaaccagtttcatctaattttaaacctaatgcaaatatatggtaaattataatagctactattatccctataattaattttttcttattcataaaattcatctccttaaattttaaaatttaaaatatatattctctttatttttatatacttaactttttaagttaaattttagatataatttaattttacattaatagttagaaaattaatagtaagttttccaatttttaactttattgtaaacaattttaaaataaaaaagctagtcaaaattgactagctcctacattttagcttacattcactacaatttcctagacatctatcgatatcttttatacaagtactaaatgctaccttactactatttttaacctttataacaggtatttttttctttcttgcatctcttattgccatctctgccatgctatgagatattgttgacataaataatactatagcatcagggtttccaattctttttttaagtcctgaaggcatcttcgtatatattttagtattatatcccttttcatttagcatctttttataatctttctccatacattcgtgaccacctaaaatcaatacgcacataaaatcaccatctttacttaattatataactgtttctaattttgcttttaaatttaattctttatttaaatttaatttttgtaatttcttataaataacaaaacatatacctaatataactatagttcctacaattaagttaataatatttgaaatattaaaccctgtagttattaaacttcctatttgatatacataaaaagctccaacccatgcaataaagaattgataagaaaatgatattaaagtcatcttagttccatactctttttgcatagtcgcaagtgctgctatacatggagtatataatgaactaaatattaaaaatccgtatgcacttactgaagtaaacaatgttggcaataccgtatttaaatctccatataaaatttccatagtagctactactatttctttagccgaaagtcctgttaatatagctacccccgctctccaatcaccaaatccaagtggtttaaacaaaggtgataccaagtttccaaggtgtgctaagaagctttcatttatttcagctgtaaatccactaaagttaaatgaagataatccccatatcactatagacatagcaaacattatagtacaaactctaactaagaaacctttagatttattccaagtatttttaagcaattgagaaacttttggcattgaatatttaggaagttctagtataaatggtgctgaagtataactattttgacttctagttataaataatgcaactcctattgcaaccactatacctactaaatatagtgaagtcgtaactattgcttcattctttggaaagaatattgatgcaaatattgcatatataggtaacttagctccacaagtcataagtggtgctataagtgcagttatttttctatcttgttcactatctaatgtcctagttgccattatagctggtgaagaacatccaattcccataaccataggtataaatgtttttcccgataatccaaccttaaccattactttatccattaaaaaagctatcctagacatatatccactatcttcaagtaaagttattcctaaaaataatacaaatattagtgggaaaaacggtaatgctcctccaaggcctcctattattccatctactattaaagaacaaaaccattcacttgaatttaccatcatttcacttactggtgtttgtatgtatgtttctattgctcctgcaaaaaactcttgtaatggtcctcctatccaatcaaaagtaaatttaaatagtatgtataaaagtcctataaatattggatatgcaaatattggatttaaaacaacattatctatcttatcacttaaagtttttttattttcttttttagtatttagacatttacttaaagtattttctaattcgttatatacctttatttcttcttctgggtagtttttatatataactagtgatttagaagcttctatgatatcttgtttaagtatagtgctatctacttttttcttagctaccatacaaactacctttactcctagctctttttctaattttttaacatctatatctattcccttactttttgccatatctatcatatttaaaactaatattataggtttattgtatttcatcagttgagtagttaaatataagtttctagataaattagatgcatctactatgtttactattacatctacatcttcattctctaaatagtttttagaaattttttcttcatttgaatatgtatccattgcatatatacctggcaaatcaacaatatttatatcatttcctaacttaccttcacgtttttctattgttactcctggccaatttccaactctttgtttaaggcctgtaagtgcattaaatattgtagttttacctacatttggattacctagtaaagctaccttaatcataattatccccctaattaattactttatttttatatatttagcttctttttttcttaatgctatatcaaatcccctaaaattaattattatcggatctcccaaaggtgctattttttttaattttatatgagttccttttgtacatcctaacgctaataatcttttagtaaaatcattttccccatctatataatctactacaccactaccacctacatttaattcataaatactcattcatttcctcccttatttacagtaaatattatatatatctatttcaattgatattaattatcactatattgtatatggtagcatttttgaaattgattatcaataacttttaatatattttttcaaaaaaaataaatactattcatttgtatgacatgcaaaaataattttcagatttgtatactaaaaattttagatccaacttcataatttataattaaatgttataatattggtattattttatagtgttttagaaaggatatttatatggataaagtaaataacaaatctatgttgagtaaagctcttgataatcaagaaaagacaattattattgatgataaaaaaataatcaaaggtcttaaagttcttgataatgtagttataaaaaataatgatagaaatagatgtaaatactctcttaaaagtaaaagttatgattctgcatttttaggatttataggttttgctcctatgatttctgatatgggtaatattacttttatggaagctatgggtgtaatttctagtgttgggttacatgaaactttagttatatttgcggattataatattaaacttaaaaatgatgaaattatattaactaaaatctaattaataaaaaagaactgttaaacttatataaaatttaacagttcttttttgttatatagtttcttctaacttagattttctaagtactacttgtgaaaaggtaatagatgctataccacataaaaacattaatcctggataataaagatatcctaatatctcaactggagatataccagctatacctgctgctgttaaaagttgagctccataaggtataaccccttgccagcaagatgaaaatatatctaatatactagcagtttttcttgggtctatatcatatttatcagcaatatccttagctaaaggtcctgctgtcactattgctatagtattattagccgtacataaatctattacactaactaatgctgcaatcccaaactctgcaccttttttactttttattttactagttataaagtaaagtatataatctataccaccattaaatttaataagcgctacaactccaccaactactaaaactaaaagacttaattcatacattccagccattccttcagatactgcacctataagtcctagtaaatcaaaagattttgaaaaaagtcctataattcctgcaaataaaattccacctccaagtaaagcaaatacatttactccaagtaaagcacctgttaaaactaatatatatggtaatacttttattatttcatattcataagtttggctccctgcacttttataacccaatgtaactagagtcaataatatggctgtagctatagctgctggtaaaactattaaaaagtttactttaaacttatcttttaattcacaaccttgtgttcttactgctgctatagttgtatctgatatcatagataagttatctccaaacatcgctccacctacaactgctcctattactaaaggaactggtatgccagttttttgtgcaattccaagtgcaataggcgaaagcgctgcaattgttccaactgaagttcccatagatatagatataaagcaccctattataaacaatcctgctactaaaagattagatggtagtatagataaacttaagtttactgttgaatctactccacccattgctttagctacacttgaaaatgcacctgcaagtaaaaatattattaccattaagataatgttattatctcctgctcctttgcaaaatacattcattttagtttctaatctttcttttttattaaatagtaaagctactccccctgctactaaaaatgctactagagctggcattttataaaaatctccagttataatcccactacctacaaataatattaaaaatattactagtggtaatagtgctaatggatttccttttttaatttcttttttcatactattaatcttcccttctttatattttttttacttgctaaccttaattttgggtattaaaaaactcccacccctaagaaattaatcttaggaacgagagttgacttcgtgttaccatcctaatttatttgtatttcacaatacaaacctcatcaagtacgccaaaattttggttatactctatcactgtaacgggtgaacccgttgtagcctaaatctaaaagatctcggtacacagctccaaggccattttcactttaatatcctttgctttttctcaccaataaaagctctctgtaaaagtattcttaaagttactttccttttcatagcatttaatttaactttttatttgtttatatttttatatgatatacacttaaatttagtttgtcaattacttttttaattttctaaattttttcatttcaacttttatataattattttccacttattctttaaatattcatttttatgccattatcttttagccatttaattttctgtttataatctggtataacttgtcctactgcattataaaaatctttagagtgatttctatgttccatatgacacatttcatgaaccactatataatcaattattttaataggtgccatagaacatcttaaattaaataatatttcatttttataagtacaactagcccatcttgttttttgatctttaatcttaatagaagttacactatctttaaaatattttttataataatcaattcttttttttactatatctaaagtttcatcagcataccatctttttaaactttgttgaatatattctttattgtcaatattagttctaactactagtttttcattttctaaatttactttaggtcttattaagtttttatcaattataacttgaagtttatactctttgcctagatacaaaaatacatctccattttcataatttcttataatctttttatcatttttatcttcaagttcatctaattttttgactatccagtcagctttatcttttactctatctattataaagttcttgtccactccatttggagctaatacattaataacaccgtctagtttaatttctaaactcatagtctttctttttctatatattatattaaagcttatttctctatctttatgaataaatgttattttcataaaatatctccttatgactttataaaacttatttgttaatatgctttctaatatcattatatataaataatgataaaaagtaaaaatggttaagtttatgatatttactatttacttttatatcttaacaagcttttaaaaaattttaatttaattggtttatattgtatatttaatgggaatatatatggtattactaagaaagaggtgtttaaaatgtatgataaaataatattaccatatgaatttgatgaattagaaccacatatagatgctaaaactatagaaactcactatagtaaacatcttcaaacttacgtaaataatttaaataatcttttaaaaggttatgaaaaatttacgctaggaaaaactttagaagaattacttaaaaatgcatctgaattaccagaagaaataagacaaggtgttataaatcagggtggcggagtttataatcataacttatatttctctattttatctccaagagcatttacaatgccaggtggaaatttattagaaaaaataaaccaaacttttggaagtgttgaaagtttaaaagatgaattaaataaaaaagctataggtctatttggatcagggtatgcatctttagttatggataaagataaaaacttatttattaaagcaacatcaaaccaagatactactcttcaagatgggttaattcctatacttacaattgatgtttgggaacatgcttattatttaaaatatcaaaatcttagagctgaatatgtaaaaaacatgtggaaaattatagattggaacaaagtatacgaattatacaatagacattagaatatataaaaagaggatatcttaaaacttattgtttttataacaatgtattttaagatatcctttttatttttaatttattttttcaatgtaatgacaattaacatctatatgatttaaaaaaagaagtaacctttcataaagtggatgagattcttttttatattttagttctaaattttcaccaatttctttaacagtctttttaccatcaatttgtaaaaatacaaaactaccatatttatcaagctcagtctttttatacataggaattttaaattttaattttctaaaaaatctttgtattttatgatcttgtttttcaagtattgtaacaatttcctcttcatttacttcatattcgattttgtcactttttttaaatattatatttaaaacatcttcattatttttcattattctttattctttaccttagatgtaacaattggccatgtagtaagaccaactaacactattaatagaattgttgccatcatatttccagcagcaaatccactaggtccagctccttttataacacctgatacttgtaatattatacctactaatcctattatagaaccacctgcaacaagtccagatgataaacttataccattagaaactttaacttctttttctttttcactcttagaagttttttcaacaaatacacggattaatgctcctactaatattatagaagttgttgcaattggtaaataaaatcctatagcaacagtcattataggtaagtctaggaaatataaaactattgccataaatactccaacgattaccataacccaaggtaattgaccagacattatacctgaagtaagtgttgatattaagtttgcttgaggtagtgcaaatggaggattatctcctgcaactgcaagttgatctgaaagtaatattgttgtacctacaacaactattacacctactataccagctattgcaaaatatttttgcatttcatttttactaccacctattatgtaagttactttttgagattgagtatatccaccagctatagatatagaaacaactatgaatgtaccaaataataataatgatttgttatctgctaaatcagtccatcccattataacaaatactaatgttgctataactaaagatgctattgtcataccagatactggaagattcgatgtacctattgtacctgttaaacgtccagcaactataacaaataatgctgctaataaaagagatactatgactcccactattgccatcactatacttcctgaaatgaagaatgctgctacaaatgcaattacagctccacttaataaaattatattttgaagagttgagtttgcatcagcatctcctgatgttgatgatttagcttttaatgtttcttttacagaagctattatagttggtataagtttaactgcacctattatacctccacaaagcatcataccagctcctatgtattttacatagttaccagctatagcatttacatccatttggttaatagccattgttgggtcattccatactttagctccttctcctgccatatcagtaaagtatcctattaaaggcataataccaaaatgtgataataaagaacctgcaaacattgttaatgctacttcaagtcctactataaatccaattcctaaaagaagtggattaacttcaacttcaaatttaaatttgtaaaacttgtttccaataaaacttataacgttattggctacgtttaagaatgaacctgttaatacagtaattagtccacttataccaaatcccatacccatatatttcattgaatctccgccaccatctgaagcaacaagtgtttcagaaattgccattgattctggatacataagtctaccatgttcttcaataattaaatagttatgaacaagggatgcaactccaataccaaataaaactccacctattccaactatgaatccttctaaaaatgaaacttggctaccaattaataagatagcaggtagtacgaaaatcataccactggcaactgattctccaccactggccataccttgtactatatttttacctagaataccttttccgctagcgaaggctgcgataaatgctgaaccgattatagaaccaggaatccctgcagcaactgtaagaccagctttcattcctgaatatgctgtagatgctgagaaaataactgctaagataatcccaatgattaatacagctatatttgcacccgttctagatttgtctgttatgtaaggaacgtaatcttttccagatactcctccataagctcctttaggtaattttttaccactcattagagttcaccctccttttgtttgattgattttattatatcacattatttagaaaacttactttttcagaaaatttaattatattttaatttttttttaattttttaaaataagttaaattaattaagataaaatgtaatattttatcttaattaattattttatatatattttctttttatatttattatatagactttaattactcttattttttaatttatattaacaattgctacaaaattttataactcatatataaaataaaaaaactagtttatataaactagtttttttatttataatgcaatcaagcgtcagatgtagttttatttaaaacaaactatttaatatttaaagaactaatagtaaatgaatttgaaaatttagaaaaattagaagatattatactagatatggaagataagatgttagaaggagtaaaagataaacactttcatcaaataagttatataagaggcttaactagaactgtagtaaaaaacataagaccgcttctttatataggagataggatattaaaagaaaatataagatacttaacatatacagatataaaaaaacataatttagaaaatttacaaagtatagattttggaatagataaactttataattttgctatttcaacaagagaattagctgataagcttttagatatatattcctcacaagtagctgagaaaactaatagtttaataaccaagttaactttacttactgctatttctgctcccttaactataataacaggtatatatggtatgaactttaaatttatgcctgaacttggatggtattttggatatccgttagcattaggtgttatgtttttaattatggttataagtatactgatattcaaacttaaaaaactactttaaaattaagttttttatttgatattaaagttattattatgtattagttattttgatataatattaatacactaatacattggaggtaactatgtttataaaaactagagataatataaacttatatgtaaataaagtaggtaatggatatagctgtatatatatacatggaggtcctggtgcttggagcaaggattttgaagttttttgcagtgattatttaagcaatcatttaaatatggtttatttagatcaaagaggttgtggtagatcagaaggaactatgtattctgattattctatagatactataatagaagatatagaagatattagaaaagaacttaaaatagataaatgtatattgcttgcacattcatttggaggtattatagctactaaatacgcttataaatataaacagcatataaaagggattatacttatgaattgcacattagatctgaaagaatctcttaaaagccaaataaatgaaggttgtaaacttttaggtattgattctatatattattgtgataatttaatagaagtctggaaaaaaatagcttttaatcttgttaaagaaaataagtattataaattacagtataaagaatatgaaaacttccttaaagtagaagatatagataagggaatattaaatactaatatgtctaaccaagcttttaataatgaaagttatttttatgattacagaaatattagcagtgaaatagaagttcctaccttgattatatgcggaaataaagattacgctattggaattaatcattataaaacttttaattttaaaaatagcatagttaaaattattaatggtaaacataatccatatatagaggatacttttgaattagttgatattattaaaaattttgctttatctttatagtaaacaataattaatagccaaagttaaaattagactcaatataagcttttttaatgtaaaataacgattagtttacataattttattattttatacatcttttaaaattcaaaatgagattttagtgtaaactcgttaaaataaaatataaaacaatttatgtattaaatcgaataaatatataataaattaaaatccgacgccttaaaatggaatttaagaggtcggatttttacggttttaacctaaattaaatagtacttcggaaattttatcgctagcttctttatccatttctttgagtacgtgagagtatatgttaagtgttgtatttatatttgaatgaccaaccctttcagaaattactcttataggaactttagaatttataagtaaagttacatgagtatgacgcaaatcatgaaatcttatatgctttaaattattatcttttaaaaatctattaaattttttactaagtacatcttgagctatagggttttcgtttttatcaaagaaaagtaaatttaatttgttctttatttttccttgtaacttcatttctatttgttcttttttataacttttcaagcgattcattagttcatttggtgctgaaatagttcttgctgaactttcagtcttaggatcttttaatataacttcaccgttgtttctcactgttattttttctattgtaacagtattattattaagatcgatattattccatgtcaatcctaatatctcagatattctaagacctaaaccgcttgctaaaaaaataggtaattctaaataagttccatcacatttttcaagaagcttatgcatatcatcttgattatatatattatttttgaattttttcactctaggtatttctatatattcaactacattttctcgtataagttttaatctatatgctttttttatagcaagttttaatatatttatatgtatttttaatgtctgagggctaagtatacctaccaagtcatcaacataattttgtatatgtataggttttatatcttcaattttatatcttcctagcataggaattatatacttattacatattctaagataacaattatatgtagtgatggatatatttactttatatttttctaaaaaatcttttaaaaaaacttctagtgtcatcgtatttggtagcaataaatcattgttgtaaatgttatcttttagttctgttagtcttttagatgcatccctttttttatcgtatgaacccatatttttctgtatttttttcttagtttctggatctttatattctaaataaactatatagtttttacttctttttcttataaatgcaaaactcatctctttcctccaataaaatacattatagtatttattgtaacataaaagtgaaataaaaaacatttaaatatctgacataaaactgacataaatctattttatattgataaaagcattgaaattactgactttttaaaatttgacataaaactatatattttatgtctttaaatatataaaggtatatctaagaagttataatttttaaaattatactatattcttaagatatacctttacggtttacttaactaaaaaagagcaacaattagtttgtttataattttcagcttcatttccagatacaaatatattgtcacatctgcactctctattttcattatgaacgcagtgagtaacattacacattacatgctcacattcactttctatattacttttcatacttttatgtacactgataaatgttgtacaataaacttcttttaaattatcaggatgaggaccatcaacttttatagccccactatggcaattttcatttttattataacagcatgtagttgcactacagttaatctttggcataataaattcactccttatatttttatcgttattactagtatgtgcataaatcaaataaaaaattgataaaaataagtactatttttaagatatatatttagtgtcatgtaatgatgattaaccatatattatactgtgactaatatataaaaggaatgatagacattggaaaaaaatacgaaccattcatatatcagtagcaaccttaaattagctttggctaaaaaatttaacatgcatatatctgaaataacaaaagaatttttaagtacattaaccgaaatagatttacctggtaacaatatcaaaaatatagaagggatagagtttgctaaaaatgcaaaatatataaaccttacaagaaataatatttatgatgcttcttatttaagtaaccttaaaaacttaacgacgttagaactaaacgaaaataaaatagaagatataagcttcttaaaaaaccttaaaaatctaaagagtgtaggattagaaagtaataatataaaagatatacctaatctaaaaaataatattaaattagatatgattaacctagataataatacaatattaaatttatcaaatttaactaatgataattttaaaaattcaactatattagctagtgatcaaaatattttactagaacctatagaaattgaatttggaaaaactgtattattttcatctaaagtaaaatgggatgatgatacattagtatttttagataatattcaagtgaacggagattacgatagagtacatacagatgaggttccatctattttgtattctatatcagaagtttttataacaaatataaaatcagattgtgtattgaaagcagacttttatcatgaagatatatccaacaccccacgaatattaagcggcacacttattcaacctatttatttaaccaaaaattcaaatgtaataaataaaaagtatgaattaaataaaaaattagaaacttctcaagtacaaggttgtatcaaattagaaaatcctaaaaattctaaaaaaattaataatttatatatatttaacaacaagataataactcttataaatgataagggtgatactttatatactacaactaacgaagtaggagaatatgtatttaatgatgtacctttaggtaaatacacattgttatttcctgttttatctgattataattacacttcagctagcgtacattctttaaacataaaaagtaaagataagtatatagtaaatgcatcaactgagtttataaattgacagagtagtagttaattactactctttttttgacttgctttgaaatattaaccaaatattaaatatttttgaaaaaatgttaagttttttaagaaaaaagtttgattatatatattatgtaggtatataatatatataaatttgtttttttacaaaaatttttatataaacagaaaggatgtattaagatgaaagttaaagttgcagatactgctgtaagtactttaaaagatattttagctgacaatcaagatagacctacaaacataagagtttattttgcaggtgttggatgaggcggtccatcatttggacttgctctggatgagcaaaacggagacgatttaacatatgaagttgaaggattaaacttcataatgagtaaagaagatcatactaagtatggagatatagttatagaagacactggatatggctttagagttgcacctgaaaatcaagctgatggtggatgtggcggaggatgctctggctgcggacattaataactattttaaagagtattggttatccaatactctttaattttgaataaaataaatattaggagtacattatgagaagacgtaagaaaaaaggagctgatactaaattattaagttatgataatttagttataaaaggtgatacattggatttaaagggtaaatggaatgaaagatttaaaaataataatcccatacattctgaatttggaactggtagaggtaaatttataactactttagctaagcaaaatccaaatataaattatatagcaatggaaataaaagaagaagtattattaaaagctgtagaaaaagctgttgataataaattagataatatattatttatttggggagatgtaaataaaattctagattattttgataatagcgaactatgtagagtttatgttaatttctgtgatccatggccaaagaaaagatggtacaaaagaagattaacttatagaggatttttagaaaattataaaactatattaaatgaatctggagaaatacattttaaaacagataatgaaaaactgtttgaattcagtctaaacgaattttcagaagctgatttaaaacttaaaaatataacacttgatttagcaaatagtgattatgaaggaaatgtcacaactgaatatgaagataagtttatgtcttatggtatgaagatatatagagtagaaggtataaaaagataaaatggagttaaaaaactccattttttctttttatacaataaagtccaaataaaactattaatatgtacactaaatataatattattctgatactttgtatgttaatcccaaatatataatttacaaatgtagtgtctggtaataaaactaaaatagccgatatagaaataagcagaggatttataactatttgtttatcacttcttaaaaccataattttcccaacccatataaaagataaaatggtaaataatattttaagtatagtttcaacagtgttcaacataatcatactcccttgttaattaattgataagttgttttaacagtaattacaacctatcaaaagtatacacaaaagaattaactttaacaagttaaatttataatatatattaaagtaaattttaataatttgtattatatattaaataaatatatatactattaataaaatactttaataaaggaggttaacatgtgtataaacttatataaaaataaaatatcatcatctaatcaaatgattgataaagaatatgatctattaagaaaaatctacacatctatagaaaacaataatctagaaaatacaaaagtatttacacaagagctaatagatcaacaatcagaaaaaaacaatgaaaatatatcatatctagaagaagctctaaataatttaaaatatctttaatatacctcgtaataagtgcatattatcttatatgataatattttattacgggggaactaatatggatagagcatttttaaattggtacactcaatcactcggaggaattctaggattaattgcatgtatatgggcttatttaaatggggatatggctgtatatggtcatatatttaaaaatttagatgaaattggtataggtggatttatagctagttatatattaatacctttgtgtataataataacactattaggagctattgaatcttattctaaaaatactactttatcatatttaaataaaattttgataatagcaactagtgtagtaggtcttttaggttctaaaatatattttataattccatctatatttattttatttaaaaattatagtcatattatatttgctgatgaaagcttagacacagaaaaagctaattcagacacattaaaagattttaaaatcagaaaaatttcttatgattctactaaattgtataatataccaaaaagtagaagacctaataaaaaacttgaaaaaactaaaggtgaaatggctgtagaactgcttcttaaaggtgcagataaaaattttatatgtgaaataacaagtttaactctagaagaattgaattctatagagaaaaaaataaactaagttaagtgttactttttataaaagtagcacttttttgttttataaatttaaaattatgatataatattagtacctgatgttaatacaaggaggtaattatgaatttaaaagaaataaaagaaatattattgactatagataaaacgaatttgacatatgtaaacctaaaagagaaggattttgctttagaagtatctaaatcacaaaatactaaagatgaaatactgttaaccgattctatcactaataaatcagattttgtagagactattaactcaattgcagttagtgatgatatacacttaattaaaacgcctattatgggaacttattatgaatcaccaagtcccgaatctagttcttttgttagagtaggggataaagttaacaaaggagatacactttgtataatagaagctatgaagcttatgaatgaaattcatagtgatgtagatggagaaatagttgaagtattacttaaaaatgaagatttagttgaatacaatcaaccattatttaaaataaaaacaatttagtttaggaggcagttatatgattaaaagattattaattgcaaatagaggagatatagctgttagaataatacgtacatgcaaagaattaaatatagaaacagttgctatatactctgaaatagacaaagaaagcttacatagatacttagcagatgaatcaatatgtataggacctaataatataagtaaaagttataacaatatagataatataatatatttagcaaaaaagatgaattgtgatgcaatacatccaggttttgggtttttatcagaaaatgttaactttgctaaagcttgcatagaaaacgatataacgtttataggcccaacacctaatcaaatagaacttatgggtaataagtcaaaagcacgtgagactatgatgaatttaaatgtacctgttgtacctggttcaaaatctgttttaaaaagcaaagaagaagcaaagaaattagctaattcaattggatatccagttatgattaaagcctctagtggtggaggcggaaaaggaatgagaatcatatataatgaaagcgaatttagttcattatttgatatagcaaaatctgaagctttatgttcttttggagatgattccttgtatatggaaaagtatatagaaaatccaagacatatagaagttcaagtatttggagatagttttaataatgttatacatcttggtgatagggattgttctatgcaaagaagaaatcaaaagcttatagaagaatcattaagtacttatttagatgatactcaaagacaaaaactttatgatgtatcattagcattaacaaaaggtataaattatataggagctggaactatagagtttatagttgataaaaataagaacttttactttatagagatgaatacaagaatacaagtagaacatccagttacagaaatgattactggaatagatcttataaagctacaaatacttattgcaagtaaaaaaagaataccttataaacaagaagatataaactttagaggtcatgttatagagtgtagaataaatgcagaagactctaatgacgactttaagccgtgtcctggtaaaatagagtctatacacgttccaggtggatttggagtaaggtttgatacatttatatatccgggatattcaatacctcctatatatgattctatgctaggcaaattaatttgtatagctgatactagagatgattgtataagtagaatgagtagagctttagatgagctaattatagaaggaattactacaaatatagattttcaaagagatcttattaactcaagtgaatttatagacaattcccatcatacaaagtttattgaaactaactttattaaaagtttaaatgcttagttaaggagattttaatatgattaagaaattcttaaataaaaaagaaaaaaattatgcagttgttaatctaaataaaaactttaaagaaaacagtgtagatgataagttttggatttattgtgattcttgtaatacccaaatatttagaaaagatcttgaagataacttaaatatatgtccaaagtgcaataaacattatgattttgaagctagaaatagaataaatttgctaatcgattataatacttttgaagaatttgattataatttagaatttaaaaatatactagactttcctgattatgagaaaaagttattaaaatacaaaaaatctacaaatgaaaaagaagctgtaataacaggtataggtcttataaataatataaaggttgttttatgtgttatgaatccaaattttatgatgggcagtatgggtgctatagtaggtgagaagctaactttagctatagagtatgctatagttaacaaacttcctattataatttcttgtgcatctggaggagctagaatgcaagaaggaattatatcccttatgcaaatggctaaaacatctcaagctctatctaagatatcaaattcaggtcttttatatatttctatacttactaacccaacaactggaggagttacagcaagttttgcaatgcttggagatataattttagcagaaccaaatgctttagttgcttttgcagggccaagagtaataaagcaaactattaaacaagacttacctaaaggatttcaaacttctgagtttttattaaaacatggatttgtagatatgatagtaaatagaaatgaaatgaaagaaagcttatataacatacttaacttacatggttatacttgtgaaaaaaatttttgtgaagaaggtgacttaattgtatatacagaacattagttcggataacggaataaataaactaaaagatagtataaatcagttaaaagaaatatctattcaaaataactttgatttaagtaaagaaataaaaaagttagaaaataagcttatatgcattgaaaaaactaaatttgaagaattatcaccttgggataaagtttctataagtagagatatcaaaagaccaagtgccaaaaattacataaagaacatatgttctttgtttgtagaacttcacggagataggttatacaaagatgatccttctataattggagggattgggaagataggagatttcaacgtcacactaatcgggcatcaaaaaggtaaggatctaaatgaacaagtaaaaagaaactttggtatgcctcaccctgagggctatagaaaagctttaaggttaatggaacaagctgaaaagtttaatagacctataataacactcatagatactccaggtgcattttgcggcatagaagctgaagaacgtggtcaaggtgaagctattgctaaaaatttacgtgaaatgagctctattactgtacctataatatctatcgtcattggagaagggggaagtggtggagcactagggataggagtagcaaatgagatagtcatgcttgagaactccgtttattctgtaatttctccagagggtctttcaagcatacttttcaaagactcttctaaatcaaaagaggcgagtaatcttatgaagcttacaagtctagatttaaaagaattgggtgttgtagattatataataaaagagcctttaaatacggcttatagtgatatagaagctgtatcaagcgatatgaaaaaatatattgtaagcaggcttgatttttataaagattttagcaaagatgatatagtaaatcacagatataataaatttagaaatataggagtctattagattataacttaatagatttttccatattaaaatagagggttttttagttttgttatagaatttgtagttaaatagcacaacatataaagatataatagggggatgttgaaatggaagtattaaaagtttcatcaaaatctaatccaaattctgtggcaggagctttagctggggtaataagagaaaaaggtagtgcagaaattcaagcaataggtgcaggtgctttaaatcaagctataaaatcaatagctgttgcaagaggttttgttgcaccaagtggcatagacttagtatgtattccatcatttactgatgtatatatagacggagaagaaagaacggcaattaagcttttagttgattgtaaataagtattaagagactatttaaaagtagtctcttttttgtttttgaataagataagtataatgggaaaacataagttaagaaatgtaaggaggtgtttttatgcaacttagaagagcagttgaaatatgcaataataatgataatgacaacgtcacattgtattattacaataaaccagtaaaattagttagcgtagacaataatattggaacagcttatgtaaaagctttaaatgatgattcacaatttgaagtaaacttagaatcattacatgaaaatgaaaaaaaataaattataatcaaaaagtcatttaaaagcttattttagcttaaaatggctttttgatttttaatttatttagatttagatatatgaaattataattatatattttatataattattgttaggaagtaattttattatatagataaaaaagatataaattatatattaatatataattttaaatacatttaaatagagagtagtccttattttaaaacataactattctttaaatgtatatttagggaatagttagtattgtataaaacatatatgcttaaatttatatatatttttagtatttttactaaaatatataattatatatatttcttctctttttgttttttattttattaatttttatattttataaccaatatctaaaaatattgcatcatcgaatccattttttactgcatattgttttgtatatatattttcaaaataattcgttgttttatgtttatataaaatactgtctccacgttttattggaggtattgataatttaaaacctttttcatgcatattttcatcatatattatatctcttgtagatatgttgtaaccttcatcaaataaagttaatcttaatgctttattgtctatgttattttcttttatatactccaataatattgtttttatattatctttttcttcttttatatttatatttaaatcttttatagatttatatattctgtctaagtgcatatctaaatacttaggtacaccttgttcaatttttatagtttcaaataatcccataccaaatttgcttaattcactttcaaaagatactttattcttcataataacctcttaaagctttcattattgattttgctttatctaatgtctcttgatattcatcctctggatttgaatcccaagttatccctccacctacctgaaaatatatatcttcatctttttttattaaagttcttatggctatatttaaatccatatctccgttaaaacctatataacctatagatcctgtatatacatttctttgagtaggctctagttcatctattatttccatagctcttattttaggagctcctgttatagaccctcctggaaatgttgcttttatcaaatttatacaatctaaagagtcttttaactctcctgtaactgtggatactaaatgacttacattagcatatggttctataacgaataattctggaactttaacagttcctatttttgatacttttcctaaatcatttctctctaaatcaactatcataagtaactcagatttatctttttcactacttcttagttcttcttgtaaagcaatatcttcttctatagtgtttcctcttggtcttgttccttttattggtcttgtttctatctttttatctatacactttatgaatctttctggcgaatttgatagtatttgatatccttcaaaatttaaaaatgcagcaaaaggcgctttgctgacatctcttaatcgcttatacagatgataacttgataaatttgtttttccactaaatctctgagttaaatttgcttgatatatatcaccttgtcttatatattctcttactttgtcaatagattttatatattcttgttttttaaagttagatgttaattttattatatttgcttcttcatcactgtccttactatcttttttagcgctaagtataatgcattctatttcatttataatatttttttctttttctttatctatatctggtgttgctatgtaagttttattttctaaatgatctattactataacaaaattataaaatccaaaatacaaatcatatacattagtatcatctatagccgttctaggcaagttctcaatataattacctatgtcataagacaaataccctacagctcctcctataaacggcaaatctgttttattttcaactttatatttagataatttttcttttaaatcatctaatggattattcttagtatttttcaattttacaatatcaaatggtctagagcttataaaggaatatctacctaattttttttcatccatgccactatctaatataaaactattttcttcatctttaaataaagtatatatttcaaatgcatctaaattagtatgtatctgttttagcatatattttcctccttacattctctagatttatttataaagtttttaagtatatcatgtccttgttctgataatatagcttctggatgaaattgtacaccttctatattatagtttttacactttatacccataatttcatcatctatagtttttgccgtaatttcaatttcatcaggtaaagttttttcatctattataagtgaatgatatctagttacatttaatggattattaagatttttaaatacacctttatttgtatgttttattgagtgaactttaccgtgtactggttggtttgcctttactatacttgctccaaatgcatgtcctattatttgatgtcctaagcatataccaagtataggtttcttgcctttaaaattattaacaatgtccacacatatccctgattcttttggagaacatggacctggtgataaaacaataatttcaggattaatactttcaatttcttctatagttatttcatcatttctttttactaatatttcttctcctaattctcctaaaaattggactaaattataaacaaaagaatcataattatctatcattaatatcataaaataccccctctacattaataaattacatactgatttatttttaataacatttattttactacaatttaattatatatttcttaagaaatcaatgtcaatatgtacgtttttgatgaaattatcaacaatatgctatgtatatttattagtattaaacaaacactattattgagcatattatctattactttatgtatttttaggaggttataatatgaataaatatattatagtaagatccgatacaaaatctatatcatctccaatgtctaaaaaagaagccttaaaaacccttaagtattatggtagacaaggcatatcttacttgataatatctgaaaataaatttacaaattataatgtcttaaaaaattaaatatataaaaaaggagctaattagctccttttcatccatctataccctacattataatacttttctttttttccttttttgcttctaacatctataagttcatttattttttcaatataactttcatcatttgtaagccttattaaactagttaaataatatgcatttgtacttttgggtatttttttgtttatgactaagtctatagcttttttagctgcatcaaagtgttttagatgtgtatgccctttttcaaactcttttttcgtattgtaagctatataaccttctttaacctgaaatattataaactcttttctttcatatattttattatacatacacttcatcctttttagaaatagtcttattatataatattaaatttttgaaaaaagtttatatatttactaataatttttattttaattataaagttctgatactgttacaaatttataacctcttttttgcatttctggtataaatatatccaatgcttctacagtattatttgttgcatagtcatgaagcaaaattatatctccatttttaacattatcaattatagtatttgctatgtttgaagcaccaggatttttccaatcttttgcatctacagtagtccataatactactttatatccatgttttttagctatattggctaaatcactttccttataacttccatatggaggcctaaaaaattcaggtttttttcctgttaatttaattattacttcttcacattttattatttcgttttctaattgagatgtgcttaaatttgatatatccgggtgattaaaggtatgatttcctatctcatgaccttctttgctagctctaacaagtggtttgctataccaattagcatgctttccagctataaaaaaagttgcttttacattatgtttttttaatacatctaaaacttcttcagtttcttttggatgtggtccatcatcaaaagttatagctaaatattttttatctcttggaccattttttaggaaaatttgctcatttttggtgcaaaatgttttcgttgggatagctactataaaaaatacaattactaaaattactgaatataacttatgctttgtaattttcatatttatacttcctttcatgatgtcaatttattcactgtaaaaattttgagtataatatatattataatgcccaccaaaacttactcctactcctagattctcataatctcctaaaatatttttcctatgacctaaagagttcatccaagcttcatgagcatatatagcacttatttgtcctgctgctatattctcaccagctaaactgtatattatattttgttttttcattctatcaaatggagtttcattttttttattaatatggtcaaaataatttttatccctcatgtctatactatgcattaatgaacttttactagctttttcactaaattctaatctcgttaaaccttctctatctcttacactgtttgtaagatcgattatttgtttttcaaaacttaacttaagttcttcactgtattttggatatatatcctttactttttcttctattcttttatctataatttgataagatgtaactttattatcgcaatgtaaatcgtaaaatacagttatatatttattatcttttataaaaatatcgaattgatttttagattctattataaacctagtatttcccttttttttatattctataggtttataattttctcttacatattttaatttgtcttttaatttaatatctcccatttcaatagaatttattgaattgctatataatccaacaactttattatcttctattccaaccataacaaaattannnnnnnnnnnnnnnnnnnnnnnnnnnnnnnnnnnnnnnnnnnnnnnnnnnnnnnnnnnnnnnnnnnnnnnnnnnnnnnnnnnnnntgactatctccaatttttatatcatagtatttttttatattttgattttgtatcattatagtttccttagatttatttaaatttaatttttcactatctttatataccataatatgtgtcgttattagtaatataaatattaataaatataatatttttttcaatttatcacttccttattacaaattgactttttatagctttttaaattatatacatttattaatacttatattcttatcgagaactataaatttacacaataaaatagaccaatctaagtaagatatggtctattttatacctgatataatctcatctaaacttttattaaatataataggtttatcaaacttccaattaccttgatagcatatatcattttctatatagaaagttccataaccatgttttttaccatgtctaaattcacctacatattttttattatctgcccatatgtatatgcctttaccatgtggtaggttatttttaaactctccttcatatataattctcccattttcatcatagcaagttcctataccatccattttaccatgtttaaattcacctatatacattcctctatttttccacgtatacataccatgaccttcttttttgccatgtttccaatgtcctaaatactcatcatcactaacgtagtgcatctttcctattccatccattaaatcttctttccattgacctgtatacacacatccattaggcaattcacatgtaccatttccatctttcatatcatttttaaagtgacctacatattctaattcttttccactttcttgaaaaaatttataagttcctttaccttccattttcccatctataatttttcctatatattcatctccattataaaatgtgtgtattctacctgaaggttttttatttgaattatttatatttgaaacacttataacttgtccaccctctagtgctaatgatttttgttggcagtgtgatgatctctttgatataaatttattaaaaagacttatacgttttatttctttttctatgctatatatagtttttctatatgtttctattaaatccttattattttgttctgtattcatataactaccccactactttcaaattatacacttatatattactattatatattaaatttctactttttttccataatttcaataaattttaagatttttatatgtctaattataacaataaagcatactagaaatctagtatgctttattgttataattgtttttcacgattcacattaatcaatacgttccgctccaagtaaataatgcgtacattataataatttttattttagactatagagaggtttttgtaatctatgtatactatagccaatccgatagttaagtagatctaaatatgatatataaatatatcatatttaatattttatctataaaattattttttattcatgtttatagaaatttttctttaaatcctctacccttaacttcatttacatcatttacagatataaatgattttttatcatgtcttaatgcaatctcttttattttaggtatttcactagatgcaactatacaatatattatttttttcttttcatgagtatatgcaccttctgcttcaattaatgtaacacctcttattaattctttcattatactctttgatatttcttcacttttattagatattagcattacagatttctgagaattcatagcatctttaactatattcatagaatataagttaaaaaacatccctattaatgtataaagccctaattctaatccaaataatgaagatcctagacatacaattaaaaaattcataaaaagtccagtatccttcataggtatattttttttaatcttaagtattgctgctattatatctgtaccacctaacgaagattttgccttaaacaccatacctaagcctattccacctagtataccaccataaactgtttgtagcaataaatcatctacagctatataatctccaacattttgagtaaaacctaaaatagttgaaaataaaaccatatttattaaacttgttatacaaaattgtttttctaaaaatatgaatcctaaaataaatatagggatatttattaaaaatgataaaaccccaatatttatattgctaacatagtttaatgcaacagataaacctgcaactcctcctcctaatagatgtgctggctttaaaaatccattaatacctatcgatgatatagtaataccgactattataaataagtaccttagtagtatattctcttctaaagtatttcttacctcactcattatagttctcccttcaaaaacaattatttaactttattattttataaagtttattaatataggtattaaaattacagttattgtacctgatatacctatagctaatccactcatagcaccttcaatttcacctaactctaaagcttttgttgttcctaatgcatgtgatgctgttccaagtgcaataccttttgatacggggtgttttgtatttataattttaaaaagaggtattgctatcattccacctattattcctgttaatattattgccactattgttacggattctatccctcctaaagtagatgttaatgatattcccataggtgttgttattgattttcctaataaagaatccattatcaatttatcagatccaattagtttacttataactacaatacttgaaaaagaaactaaaactccagtcgttatacctattataatttcatagaaatgtttttttagtaaattatattgcttatataaaggtaatgctaatactatagttacaggtcctaagaaaaagtttatagaatctccccctaatttatagctattatatggtatattgcatacttttaaaaatactattattcctaaaatagctattagcaatggattaaatatagccattttagttttattttgaatatatgaaccaatactgaaaaataatatagtaactactattccaaatataggtgtttgtaatacgttatacatgccactaacctctcttactctttatttttatcatctgttcaacaactatagctgttacaatcattactaaagtagtacttattaatattgttgcagctaaaactaatatatttgagctaattaaacctaaagaacttataagtgaaacccctgcagggacaaaaaatatagccatgttatctagaaaaaaattgctaagttcttctattgaatcgacttttacaactttagattttaataatacaaataatataatcatacctattatacttccaggtataataattatattacttaaaaacgaactaatgtattctcctatggcccatattgtaaagattaaggccagctgtcttaataatttcatctacttttctcctaaatttatttttttattttttgcaaaattaaagggatatttttaatcccctttaacttccttatatatattactactatatccttgttttttcaaacttaattttcctaaatttatagcttaatttattaaaatatctccatttttatctatgtagttattattatctccatcaattatctgtgcatacccattttcaaaatccgaaaccgatttcaacgttggcaatatttttatttttccttctttatttaaaaatccccataatccaccttttggcacacacatccccctagttaatgaactcgaacctatattaaacctagctaatccatcattaaattcgcaagcataatcaaatatcggttcaattactatttcaccaaaagtatttatgtatccccacttttcatttatacatactggtgctaatccttcactaaaagatttcgctctatcaaatttaaaatcgataatcctatctccatttacatttatatatccccacttatcattaactcttattcctgctataccttgtgaaaaatcagttgctatatcaaactcaggttttataacgaaatctccatttttatttatatatccatatttatttttgttttcaactaatgctaatccttcattaaatttattaacataactaaatttaggctctattgctatatgtccatctttatttacatatccccattttttatttaacttaactccagccattccttcattaaaatttgcagctgattcatatttagcatttattacttcatttaaatttttatctaaaaaaccatatttcccattaattttaatccttgataatccttcactaaaatctgatgcactatctaaatgcaaaaatatattattatatccatgttcatctaaatatccaaagacccatcttacagatttgtttatacgttttatatatgttacaacacaatatccatctctaaatctctcagatacatatttaaacttaggttttatttttatgttattattttcatcaataaatccatattttccatttcttaatatagggagaaataactttttatctaccatctctgacctcctttttataaaattattaacatctttactaataattaatattatatttttctatttcctatactaatttttaaatataaatttatatgcacataaaaaaagagcataaaatgctcttttatctttcttttaatatagattctacttttgagttgttatacatactatctggatcttcagcccttaaactataaaatgtcttttgagctttatctaaatcgccttctttatagtaaatcattccaatattataataactatcatcataataattatctgatggtttataagtatttatatatttactataatactttatggcttcttcattattattttctttttcgtttattaaacctaattgatatatagcttcagatatatatttctttgttttaccatttttaagtactaattttaaatattttatagcttctttgttatttccatcttctttaaattccatagctttattaaataaatcttcttcgtcccctactataatctcatcttttttattatcttctttttgtgttttagcttgttctaactcatctttagtcttatctaatttctcactagttttatcaagttctttatttttttctgtaacctgacttgcaagatgatttaactttttcttattatttatatataaagctcctattgctattactaaaactactattaaagcatataatggaatatgatttttagtttttttacttgcctctttaggtttttcatcattagtaattttacttacttctttttcaaatagactgttatctttatctacagcttgtaatttatctaaatattcattagctttttcattatcacctaatttttcatatatcaaatgcaataacaaataaggttctataagttctggttcttcatttattatgttttcaagtatttgtatactctcttggtttaaatcattatttacaaatcttatagcatgattatatctacttaaaaatatactaaattcttctgaacttaataaatctacatattttctagctaattgattgttattgtaacataaacttttatagaaactttcaaaagactcatcaaaattacattttaaaaattttaataaacctcttaaatttagtatatctacatcttttggatttaactctaatgcctcttctacaatttcagtagcactagtaataaagtttctatctatcatatttaaagcttcattatactttttgtaagactctaattttaaagctctagtatctttaacctgtctctttgtcttatgttttaagttaagtatagtttcatctttactattagctgttatgtaagtctttttaagtgtttttaaagtttcatttatctcttcatcatctatattaaaaaaagtagtatcattgctatcttcttctataagtgatatgtctattatttttttatgtaagctttttatatcactttttatatataaccttaatatagtaatcaccctctctttttactttatctatataataaaataccatattaaattaatttagtcaaaattatacatattataaaaaaatcttacttaatttttaagtaagatttttaaaatattatttattgattagtttctatttgcaattgctgttgattaggttattcttgttgtacttgtgatttattttcttcatttgaaaccacttatatactagtttctttaggtaaagtttatgttaatagatactaaacatccatatcttccttttcctaaagtaggattatcgactttttataggagcaactgaaacttatctatatcgatatatattattaaattatattaaaaataaaagcgtgttttcacacgctttcgttaaatcttactaatcttatcctctaatactttgtatatttgcttagtatatggatttattaaaaatacttgcttagatttgaaaaatcctctatttacaacagcataataataaatatcattattttttcctataaacttatctaaaacttctttatcatataaatatcttaaaactttgtctctatcttcaatcgttacatgcttataactttcatcaagttcttttaattttttctctagtaaactttctgctgtacttttgcttatagtaaattccacattaccatcctttgtagctctccaatgaccatctccataattattattgtatgatttttttgtatccaaatatgaatatatatttttacttctaggatctattaaaaattcatctattttatcttttcctaaaaaagtttctgcataataatatttatgtccatgaatcatttgttggaatatattagcccttatatcatttttatccataccactttttttggctatcaatgcagttatttcatcattggtcatagaatatgtctctagatctttttcaaatttagctgataattcatctaaagtatcgtcatttaaataatattgttttaaatactctatgttttctaaagcctctttgtaattgccagtttcattctcagtttttgctttttctatataataatcatacatatcttcaatacattcttcttttttatctttagctaaatcataatattttttatcttctgatagaactttatcataattttgtattgcttctttatacatttttttattttgatactcaacacctatgttataaacttttctagagtcttctattacgtctattttttttgaatatacataaatttcattttttgatattttaagtgtagatacagcttgtatatatccaatagctgttttataatttattttttcttgtaggacaccctgattaaaagtcaggtgctctaccgactgagctaatggatcatctttttatggagctagtgataggaatcgaacctacaacctgctgattacaagtcagctgctctaccgttgagccacactagcatatataaaattggcgacctggaagggactcgaaccctcgacctccagcgtgacaggctggcattctaaccagctgaactaccaggccgcattattggtgggattaacagggctcgaacctgtgaccccctgcttgtaaggcaggtgctctcccagctgagctataatcccacattattggtgactcataggggaatcgaacccctgttaccgccgtgaaagggcggtgtcttgaccgcttgaccaatgagccataaaaaatggtgatccatccgcgactcgaacgcgggacaccctgattaaaagtcaggtgctctaccgactgagctaatggatcatctttgctgagatgttgtttcgacttttttcgtccgccgtatcaacaaatattattatattagctttattaactttcgtcaacactttttttaaattttttttatttttttaactaaattatataaataccctatttttcaatggtttaacctaattatctctatgtattttttgttaatttaacaaaaaatattatttatttttattttatttttattttttatctaaaattttttattagtttttaatacataattaaataaaatttcaaaaaaataatttaaactttaatatatataaactaataaaaaaaatagttaatgctaagcattaactatttttttattttaaattagaatatattctttcttattatagtttgagctctgtttggtccaacagaaaccatatcaacactaactccaactaattcttctatcttagctatatatttcttagcattttcaggaagttcttcataagtttccatacctgttaaatcttctgaccatccttctaattcttcatatataggctcacacttagctaagtcttctaatgaagctgggaattcttttaatattttatctcccattttgtaagctgtacatattttaactgtatcaaatccagttaaaacgtctaataacattaaagatatactagttaatccgtttactctagcagcatatctaactattacagcgtcaaaccatccacatcttctagctctaccagtagttgttccgaactctcttccttgagttcttattctatcacctgtttcatcgtttagctctgtaacaaatgggccttctccaactctagttgtatatgatttaactatacctacaacatcttttatcatgttaggtccaacacctgctcctatagagaatcctcctgatgttgggtgagatgatgttacatatgggtacgtacctaaatctaaatctagtaatgtaccttgagctccttcaaataatactttctttccagcttttatagcatcatatactataactgaagtatcatctacgaaaggtcttatttgctctgcatatcctaagtactcattgtatatagcatcaaagtcaaaaccttcagctccatatacatttttaactaatttatttttatcttctatttgagcttttaattttttagcgaatatatctttatccattaagtcacatattcttattccagatctctctgttttatccatataacaaggtcctataccttttttagtagtacctattttgttatctcctctagcttcttcagctaaagcatctaattctttgtgatatgggaatataacatgtgctctatcacttatttttatatttttagtatttatattatctgcattaagtttagctaactcttctaaaaatccttttggatcaaatactattccgttacctattacgtttatagtttcaggatttaaaactcctgatggtattaggtgtagtgcatatttttttccatcaacaactaatgtatgccctgcgttgtttccaccttgtcctcttactactacatcagcttgtgtagctaaatagtctataactttacctttaccttcgtctccccattgagagcctactatagcaacagtcttcatattaactcacctctatttttttattcgaacacttacttttttattttaccaaacattcgctttattttcaaaaccttttttattgacctattttatttagtatgtatttttctatttcaactaaatcttttaggccttttatttttgcttcattagataatatattttctttaaattcatttaaattatcaatttcttttattaatttattatctcctgtcattgtgtttgtaatgtatatttttaaatttttattattttttattccatatacaaccaagctctctttaattttttcatcaataattctacatatattaatttcatcgtttataaagtctgtatttggatatatatatattatatttatcattttttctcccccgttaaaataatttatactaattaataagaaagcaagctaaatagcttgctttttttatccacatttatcaacaattacattgtggaaaatgtggataaccttttctaagtataattttttatacatttaaaaatatccacaagtgatatattttataaaattatcaacatgtggatatccttattacatttctctagctttgtttgcaaatttttgaatttcacctaaccatactaattcaacagatccagtttcaccatgtctgtttttggctataataacttcacctatattttttctttctgaatctggatgataatattcatctctatataaaaacattactatatcagcatcttgctctatagctccagattctcttaagtcagataacataggtctatgatctgatctttgttctggtgcacgtgataattgtgataatgctactacaggacaattaagttccttagctattatctttaaagatcttgagattttagatatttcctgttgtctactttcgttattattatcaccctccataagttgaaggtaatctataagtattaaatccaaacctttttcaatctttaactttctacattttgatcttagttcactgatttttataccaggagtatcatctatatatatattagcattagataaaactgacatagcatctattattctaggccaatcattttcatctaaattaccattttttatcttttttaactctacatgagattgtgcagataacatacgttgaactaattgttcttttgacatctctaaactaaatactgctacagatgcattacccttaagagctgcattttgaactaaatttagcgaaaatgcagtcttacccatggcaggacgagctgctataagtattaagtctgttctttgtaatccattaatctttttatttaagtcttcaaatccacttgttatacctgtgatttcttctttattagtatataatctttctatcatatcataggtatccataagtactgaatttatagattgaaaatcttcactggacttttcttgagatatatcaaatatttgtttttctgctttttctaaaatatcttctacttttatagaactgtcatatcctaaatttagtatatcattagatacttttattagttttcttaaaactgatttttcttttactatatctgaataatattttacatttgaagttgtaggtactattgttgataagctagttatataacttattccacctacatcttctaagtgcccttgttttcttaattcctctgtaagagttattaagtctataggttcatttttattatttaacttcatcatgcactcatagattatcttatgtgcttctttataaaaatcttccggctgaatagtttctgtaacagtaattattgcctctttatctaatagtatagaccctaatatagactgctcagactccacactatgtggaggaattctacctatatcctccatgtatctcacctctagtgtcttcttattgtttttctcttacatctactctcattttagtaacaactttttgatgtatttttatttcaacaaatcttgatcctaaagttcttataggctcatctagcataacttttcttttatctacttcaattccatgctctttctttatttgagcagctatatctttagaagttattgaaccaaataatcttcctccatctcctgctttagagtatatagttacgttcatctcttccattttctttcctaattcaactgctgcttcatactctttttgttcttttattttttgagatgtttgtttttcttttaattcttttaattctgtatttcctgcttgaacagctaattttttaggaaataaaaagtttctagcgtatccatcactaacttcttttacatctcctttttttcctgttccttttatatcttttaataatataactttcattactcttcttcctcctctagatactgttttatgatatctgataccatcttataaccttcttctaaagacacattttcaagttgagctcctgctatatcaatatggccaccgccacctagcttttccattaaaacatgtacattgatagatcctaaagacctagcacttataaaaatagtaccactttttgttttacccaaaacaaacgatgcttctacatcttttatacttaaaagttcatcagcagcttgtgccacaactatatttatattatttatatcagcattacagtaagccaagcaaatcttgttatttataactttagtactttgtattatctcagccttagttataaaatcttcaagatttgaattaaataattttttaacttctatagtatctgctcctgctttttttagatatgatgctgcttcaaatgtcctaactccagtcttaaatgcaaagtttttagtatctaaacttattcctgccattaatccttcagctgttaatttgtttatttttacatcctcttccatatactgaactaattctgtcaccatctcacaagttgatgatacataagtttcatggaataaaagaacagtgtcatttataaactcaacacctcttctatgatgatctattacaactatcttttcagacatctttaataattcagggcattccgtaaagtttggtctgtgtgtatcaactacaattaccaatgtatccttagtacaattttttatagcatcatctttagatataaagacattagtataatagttagagttcttaattctattgacaaactcatctatagaatcattagaagcatttaatactatattggcatttttattgcatgatttacatatatcataaattcctaccgcagcccccatagcatccatatctggatatttatgccccattatatatatctctttactttctaatataatctctctaagagcatgccctattaatcttgatttaactttagttttcttttctactgcttttgatttaccaccgtagaaaatagatttatctttggtctttattacagcttgatctccacctctacctaaagccaaatccaatgctccttgagctagtttgaagttttcattaattgtcttaccttctattcctatacccatacttatagttacaggtaagttattttcttgatttatttctcttattttatctaaaatagagaatttatccgcttctaatttatcaagttcatttttacttaatactaagaagtatttatcttttgaagttttttcaagagccccattacaacttacttctaaagaagccaatattttatcaatctctacgttgattaatggccttctttcttctggtgcactttgtaaaacttcatcatatccatctacttgtatagttgctattacatttttttcttcgttatatttgctttctaaatttaaatactctgttttatcaatccaataaagcatcatcaaatacttagctttttccccttgatcgctttttattacattatagactatagtgtaatctctatctttatactttatatttgtatataattctttattttcatttaaaacttttcttaaatctatattcttaacgagattttctatattcatacctaaggtatcttctttttctgtcatttcatggaatctagtgttataccatgtaatactaccatcgaattctaatatacataaaggtaaaggtagatttagtatagcttttttagtaacttcatcaatatctacagccaaatcttgaatatacttattccattccttccttcttatatctcgtattctccaattatgaaaaacaatatatataaaaattataaatacaacagttcctatatatatattgaaatacattaatataaggctaaggattccaattaccactatatatgcatttatctctggcatattaaatttaaaggtcgacttatcaaacatttctaccctcctaagtggatttgtagtttctcacctttctaaagtcaattgcactgtctatcattcctacaaaacttaaaatcattgatcctgataataaaaatacagccattacagcaaaaaatattttgcttggtgatttttttctccattcttttataaaatatatagctacagatatcccttgtagtaaaaacagtatactaaatattaattgtacatttagtattattgcatctgtatataagcctatatttaacatccctaaaaacattgttagcaaatacaataatagagatgttattatagcatttcctggtaaataaaaatctgagaactttggtaacttgtaattcaatctttttattcttcttaaaatgaaagcttctacataatatgttattattgaagcaattatgctatatgcaaatagcatagttggtattatattttgcataactttaattatatctttaggtgctatatcaccttttggcataatattagcactttccataatagaaaattgagtttctacagtagtttttatcatttctgagaatgtctctaataagtctatattaaataaaacttttgatattgcaaaaaatacaattatagatataataaatgctatcgtcccaaagaatataggtgtaaaacttttattcccatcttctatattgctatctttattaatcatatatccaactgctatccctggtaatatgctcattacaattaaatttaaagcatatacaaaatccacggttagtattaatatgaaaaaagaggctatagctgatattaatgcatatttatgtcctgtcattgttgctattatcgcatatggaacaggaacaacaaccataagtaaccctaaaaacggaatatacgcagtagcaatacaaaaaactatggctaaagctgttagtatagccgcttgagttaatttagttttatcattcaatctaatatcactccctgttatctaggtaatttttaagattagataaatctccataccatctctccacgctatggtcttcctctattccttcttttatcttttccttaattttataatctatttctttaaaactaatcccaagtctttttgatagtaagtatgtaaccataattatattagctaaagtgtcttgtagtatttgatctactgatcttgttcctttaaataaaaggttaaacaaatcccctaagctaataattaattcggttttcatccattcaattatctttatattctttgttatctctgaatttttatctagtctcactatttcccccctccttaatatataaacattatatcataaatcatagtagttttaaccaataaaaaaacgagccttaaggctcgtccttttcttagtctaatgtatatggtaataaagctaagtttctagctctctttatagcaactgttaattctctttgatgcttagcacaagtaccagctattcttctaggtaatattttacctctttcagttacgtatttttgtaatctttgagtgtttttgtagtctatcttagcatttttatctgcacagaattgacaaactctttttttcttacgtctctttttgtttatcatatcagtttccctcctttttagaatggtatatcgtcatcatctatagcttggaacccttgaggatctagtcctgtaggctcaaaacttggttcaaagctaggctcaaaaccttgattttgacttggatatggattatccgatctatttttattactatctaaggcttgtatatttctcgcgctaaccttagtaaaagttcttctttcgccagattgagtttggtaattatctactcttatagaaccttgcagagcaactagtctaccttttgatatatagtttgcgcaaaattcagcagattttcccataacttcaacaggtataaaatcagtttctctactaccatcttttttagcataatctctatcaatggcaatagtgaatgttgcaacggctgttcctgttcctgggatatatcttaactcaggatcctttgttaatcttcccactaatacaacttgattcatttaaaacaccgcctatttacgtaaaaattatatagtagttattaagcaacaactatcatatgtcttattacgttctcgtttatctttaagtttctgtctaattcctttggaacatcaacaccagccttaaagttaactaatacatagtgaccttcagtgaacttagctattgggtatgctaatttcttagtaccccaaacatctaccttctcaacttcaccttcagtagctataacttccttaactttgtttaatacagctgttcttacttcttcatctgcattaggctttactacgaaaactaattcataatttctcacacgattcacctccctttggacttacggctctgctacgcagagcagagaaatgagattaaaatctcatactttacacattttatcacttataaaataaattgtcaatttaattttattttaaacctcttttttaaaaataattaatatattgtaatttagcgtaaataaaaatttataaacgtataaaattttaaatttttgttaaatataataatatagaccccataacttaaacatatttcatcccaatctcccctaaaaaaagagtgacctattaggtcactctttttttatctatatatttgcgttttctaaaagagcttcatttaatgcttcagctaatctcttaacaccttcaactatcttctcatctggcatattagaatagtttaatctaaatgtattttccttacctccattagggaagaatgaccctcctggaacataagcaacattgttttctaaacatttttccattatctttctagcatccaaatggcttggtaactctatccatgtaaataatccaccttctggatgtgtgtattctattccttctgggaagtattcttttattgttgataacattaaatctctacgctttttataaactgtttttatcttttcaacatgtgcatctaaatcataaacttctataaatttacttacttctctttgagatattgtagatgcttgtaaatctgctccttgcttaacaaatacaaatttagaaagtatttgtggtgatgcacaaacccatcctattctatatcctgggcagaatatcttagagaaagaacctaagaatataactaatcctttttcatccattgattttaaagacggtaatacttcaccttcaaatctcaattccccatatggattatcttctactactggtatttcaaacttatttatgacatccatgaatttattacgtctttccatagaccatgtcttccctgttggattttggaaatcaggtataacatatatcatctttacattttcagttgattctaatatcttttctaattcttcgattatcattccattgttgtcagttggaacttctataaatgtaggacagtatgatttgaaagcatttaatgctcctaaatatgatggactctctactaaaactacatccccctcatttaaaaatatcttccctgcaaaatctagtccttgttgagatccacttgttattattaagtcatcttttgaaatgtcagtttttaactttctgttcattctttcagctatttgttctcttaaaggtccaaacccttctgtagttgtgtattgaagagcttcttttcctgattcctctaatactaacctcgatatttccttcatttcttctactggaaataattcaggagctggaagtccacctgcaaaagatattacttctggtttttctgttaacttcaaaagttcacgaatttccgacccctttaatccatccattctttttgcaaatttgatagccataattaagtttcccccttggtaaatgttttcccagtttaattatagcaaatttgaggcaaattttacaagtcttttaccttttttattcttttttctaaagtttctctatctaattgtactactctttcacactttaaacactttattttaaaatccatacctactctagtaattttaaaatctttacaaccacatggatgttgtttttttaattctacaacatctcctatatttaatttcattggcattaatatcactcctatcttaacttagttatttctttttgtcctccacttactctagttactttgaaaattccatgatataaaatttcgttttcttctaatgtttctactactgtatccatatctttttctaaaaacctaactgatattccacaactagaacttatttctctaggtgtaggtaaagttgtaacctttatagctttttcatttaaaactttatctgttcttattgcatgatgagttgagttaaatgctactatatacatttcattcattatttattcttcctttccatgtctttatatattgattttatacataaataaagactacataaacttgtcatgtagtctttattatttatatagatatagtttttgatgaattgttcatcgtttctacaattgtatacatatttgttactgttccaacttttaaagaatcttttacgccgtagtaatctaaacatgttccacaagataatatttctacacctgcatcttgtaataatttaagattttctactgttgcttcattttctgttgttaactttattgcactattaacaaataatatactctttggatatggcttactttctgttaaagtatatatatatcctttcataagaacatgtcctaattcatcgtttccatttcctattttatctgaatttataaatatacatgtatctgataaagactcttgtgatttttcttctattataacattttcaccctttataatctctatacaaattaaatctttttctgattttaaaatattggcttcgtgattcattgattttgctaactttaatacattttctttagccatttcattatctacagttactactactaccccttgatcaatactatctaattctttcttagtatttataactggtttaggacaggctaatcctcttgcatctaactctattctcataaatactcatctccttaaatacgatacttccttaattttaacataattagatgtattttgttatagattatttctataaattaactctaacttattatattagactatgattttaaatttattatttgtatataagattctaattctactactaccgtattatttggtataaaaagcagttttttaatattttcatcaaattttttcaattcgatacctttgttgtccattattttattgtcactgtatataataaatgaatcttgagtatttattattccctttaaattttcaatgtatatttttatatcctctatatctttatcaaaattttcacatattccaataatgttatcataatatttcttttgatttataaaatccaaaatcatataagttgtaaatggaccaaaccatattacaaaaattaaaaatataatttgaatactagttttagctgctaaaagagctatagacactataaaaaataataatgtattaataattaaaaataccaatctatcttttaaatattcacttagcttcatttcattatataccctaatcctcttctagtttctatataatcctttaaatttaattcttctaatttctttcttatcctagtcatatttacagataaagtgttatcatctatatatacatctgaattccacatataattcatcaattcatctctagatactattgtttctttatttttcataagatatgctagtatcttcatttcatttttacttaattctacacttttgtcaaaagcagttattatgcctttagataaatcaagatttaaatctttatatgttaatatatcagtatttgagctatcattatatgttcttttgattactgcacttatacgagcaagcaatatttgtgtattataaggtttggttacaaaatcatctgctcctaaattcatactcataagttcatctatttcactatctctacttgttactattattataggtatatttaagttttttcttacttctctacatatataaaatccatcatatactggtaagtttatatctaatagtataagatctggattttcgttttttatatcttctattatatttccaaagttttcagaagtaataacttcatatccatatcttgtaagtagtgattttagttcttctcttataatttgagaatcttctattatcattaatttcttcatattatttctcctttaggtaattcttgtatattagtttatcatttttataattattattaaagcgttatgtttttattatgtatcatagtaaatatataaattttggaattctataattattactttgtcatattagattatacgtttcatattttaaaaattgtagccttattcatagtaatttaatatactagcacatataagcctctccttcatttcatttatgtcataaatattatcaaaattattatttggatatttataaattttttcaggtgggcaatttatataattattaatagaccctaaagctttgcttactttaccacactctatataagctaaacattccataaagtataaatctttaaaatttggtgttgtagattttatactttctataaatcttaatgatttatagaactgtctagtatttgaataagctttaactgtatttaatattaaacaaggataaaatagataattatatttcatatcaagtaccttaatagatttttcataggaagctattgcattttcaaagtcttttattcttgaatactcattacctaaaacatagtaataataggcatctctttcttcttcttcatagttttttaatatgcttatatttcttttatatttactttgtatatcagttgtatttggatcatatccataatgaaatatacgtacatctaatgtcttaatacaattacatttattgtattcttgtatcgagtttgctacttgttcatgtacttttcctttaaatctgtaatttttattatttttaaatagcctaaaaactaaataatctccaacattagtttcttttataatatttataagtcttaaaaagtaaccttcagataaattattactacttaataaattttttattttaattaagtcttctttaggtatttcttcatctgcatctaaaaataatatatagtctttagttgcataatctatggatatatttctagcttcactaaagtcattgttccatttgtattgtattattttagcacaataacttttgcatatttcaatagttctatcagtagaaccagtatctacaattataatttcatctgatatttcttttatactatccaaacatcgccctatatttttttcttcatttttaactatcatacaaatacttaaagttttcaattaatctccccccaaatatgaatttaaaaccaaaagaggtctaccataattaatatgatagactataattttttagttatctttcttaaaaaaatcattactcgcacttgttaaaaaacctatagatgaaaataataaatttttaataagcaaaagagattgattatctacactcacatctactatacatgcaaagataataacaattgtagatattacagaaaaacttccaactaataaaattttattttttaataatttaggatttgaagtacaagttttagttgatttttctaatatatatcctgatattgaagaaaaaattgatcttatagtaatcaaatgttctttttcatctaattccggattaaatactgatatgcaaacaacaaagaagtataatatacctaaaggaattagatatttacaaactatgcctaattcattataaaaatctttgaattcatcatagattcttttcacaaatttttgtatcacaataaccaccactgtagcttttttaaaagagttacaatttataatatgaaaaatatcaaattctgttacatttaagtattttaatagaaaagttttgctaaataattttagggtaattaaatactaggtttaaattttataaaaaggaagcgattttaatgtttgatttacttaaaaacctagttaaagaaaataaaaaatatataaaagatggtcacgttgccacttatatacctgctctagctcaggttgatgaaaatcaattaggtgtagctattgttgatttaagaaataataactataaagaatattttgctggagattataacaaagtcttcgcaatagaaagtacttccaaagttataactttaataatggctatgatggataacaaccctgaatatgtatttaaaaaaataggcatggaaccaagtggatttgcttttaattctatccttaatatggaaataaacaataaacctgttccttctaatccttttataaatgccggagctatagttgtcaactcattagtaaaaggtaaagatagtgatgagagaactaaaagaattttagaatttacaaaaaaattaactaataaccttgatatcaaagtaattgaagatatatatttatctgaaaaaagaactggagatataaatagatctttagcttatcatatgaaaggatgtaacattattgatggtgatgtagaagatattcttgactcttattttagacaatgctctatatctgttactgctatagatttagctagaataggttcagtactagcaaataaaggaatttgtccttggagtaatgaaaggttaatacctatggatatttgtactattgttaaatctataatggttacttgcggattatatgatgaatctggagattttgctgttcatataggtataccagctaaatctggtgttggtggaggcattttaggtgctgtacctaataaaatgggcattggtatatttggacctgcacttgactctatgggaaatagcatagctggagttaaaatgctacaacaattatctaaggatctggatttagatatatttgaatagattattttaaggagatatctttatataaagatatctccttttttggaataaggatttatatattaattttaaacaaaaatattaacactaacaccaatatttaaatcatcatcaataaaaataaaatctagaggatttattaataccttttcatttatatattcctctgattctatgtgtttttttataattttttcctttgattcaaattcttttttagttctatttacatatttttctatatcaagtagtttagacttataatcagatagcttcttttttatatgatttatattttctaaagcttcatttaaacttgctatcatatttttatcatcatttaaaaaatttctcactacgttatactcatgccctaaatcatttgtttctttttttattttctttatttttattttattttttatttgcttttgtttatcatcttttttatctttttgacaatgtgattttatttcttttaaagtattttccattttacgcaatttattttcatgaaattttgctaactctaacttttcttttatagttttttgacttctatttgctatatcgattcttctttttaaatctttacaaatattattatctggatttttaccttttttacgctttatctttttgttaattttattttgtttctctgtccttattcttttgtttaaatcattttgtatatttatttcataatgtctaagataagtcttgtctcctataatcataaatacacctcccttctataaaaacttttgactcaaattttgagcctattaccatatatcggtactttttatttaaacgtaagtattataatgcaattaatcaaataaaaagcaatttttattgctaaattttaaaatttcataatttttttactatatattaaaaaggtgctaatttaaactagcacctttttactcctatatcaatgaacctatacaaagcattgctacagataatgccatgattattcctacaagtggtaaaacaaattttaaccacttatcataagttacatctaccatagcaagagatgctagtattaatcctgttggagttattattcctattagtccttgtccaaacatatatgcagttattattatatctctgttaactcctacaacatctgcaagaggtgccattattggcatagataaaactgcaagtcctgaagaagagtttataaagaatcctaaaactatatacacaaaatacattactacagagaatattactccactcatgttagacactactccacttagtgaatgtaataaagtatcacttattaatcctccatccattattatagtaacacctctagctaatgctataataagagctactcctaataaatcagctgcaccttgtacaaaattagatacaaactcactttctttttgtttagttagtggaaccattataaatgttacaccaaagaataaagatgtcatttcaatgaatccccaacctaattctttaactccataaatcatcactacgaaagataaaccaaaaattaataacatcaatttttttgtaaaagtaaattttactaattcttcatcattttcttctgataaaaatttcttctcaatttcttctttttgaaaatatattaaagatttagttggatctttttttactttctcaccatatcttattatgtaaattaatgttactaccattcctaacactaatgctaatattctaagaggcagtccatctgctatagttacacctgctatattcgaagctattacagtagaaaatggatttatagtagataccattgtacctatacatgaacctaagaatatagtagcgattgcaactattgcatcatatcctgctgctataaatattggtacaactattggataaaaggctatagtttcctctgctaaaccaaaagtagttccaccaagtgctactaatgaagctattatgactatcatccatttttcttttccttttaaagctttagacaatgcatttatccctgctgtaaaagctcctgtactattgataatacctactaaacctccaattactaaaacaaaggctattatatcaatagaatcatataacccctgtatcggagcttttaaaaatgttgttattgctccaaatattgttgtattttctttttttaattgctcatatgtatttgggatagcaactggttttgatattgaaccacttgtaaattgttttaagtctacatttacacctaacttgtctaatgtttgttgagttgcttgatattccttcgttcctccattaggtaaatctactataaattttgaactattagtatcatagctaagtttagaatatttccctgaaggaataatgtaagttaaccccattactattagcattactattagaattacagtatatgctgtaggaaaggaaaactttttcttgcttttcataactgtacctccttttttattgttaatatgatgatatcatgattacacttttttggtaaccaagttaatcaatttcgaaatgttaaaaatattcatcaatcttctaccttatttataataaaaaatcacaaccatattgattgtgatttaacttagatgatatttatcttttgcttgtatgtatactcattatttattaaagatttctctgtattattagaaagttcaaatattgtatctagatttgaatcattacttaaatacttacttcttatattatttgaatttactaaattctcaatatccccataatttatattagaatttattacagagtttattatttttatagctccaactaaataatctctacttaattggcgagctttagcatcttctatattcgttggcaccttaaatttacatacatctgatacactttttacatctgatctaggtatatctgtatttactgatatataagttgaaaaatgattatctccttctacaccaaaagtacttattttagagttttctgaactttcagcttcatatacaacaggtcttaaattatttgatttagcaaattcctccgaatattttgttagcttagtttttaaaatttctctttgatttttatattcttcatatgtgtatttaacttcattagtttttaaaatttctcttttataagttttttcaatattaaacttaacaatatcatcatagtatttaaaatttatactattaaaagatgttgaatttttatctaattttatattatttgcttttttatcattaatttcatatctaaattttgaaatacttatatcttttatacttttagtcgaagttaataaatcatatagtacatgaaccgcggaatcatttttcaatatatctttatctttaaatatactaccttcaactttaatatcataatttgatttatttgctatcatatttattattatatattcttgttctaattttcctaatttttccctagttgctagatttaaaattatagtttgcttatcaggtgttaactctggtttaaattcgcttaacttaaaacttattttctccatcaattcttgagcttgcttatatgtcaattttatatcgttatttgttttatccttatttttatctatattacctatttgatgactaacatcagtcatagtatttttcatttctttatttttttctgatgaacagcccactactgttaatgcaataattgttgtcaagcttagaactgctatttttcctttcaaattactcactccatatctatattgaatatagccataatttatctacccattttattgtcacactgccattttttacattcttagttaataataaaattactttatgatcttctgcaaatagttcataaattacttcattaggtttatgcttatcatatattttatcaaccgtatgaattctttctttaaataatttcggaagcgtatagcttatattgagtaactgttcagataaagttactatatcatctttttctaagtcacaaacctttatatgctcgggtacataatttttatatattctaaataccttatccatcattaaatcttttaattttacaaatattgtattactcaactaacatccgccccctataattataaatttattttatataaactcgctacttgtatatatacacatatttttaaaagttaaatcatttataatttctatatagttaaaatttaactaataatattatattatatctaaaataaaattgtcattatttaatgattattataaattaatcagataatatattttgatataaaaaaatgacctactaataaggtcatttttaagctataacttttttttatctcatggtttttctctaaatatttaataagtattggtataaatattaattgtattaatatccctggtatagctttagatatattcccaaatataaatattaaatgacttacttgaagtgctattgttaaagatactaaaaaagctccaactactgcaaataatcttccaccaatcatagctgttataagtgataggtatatgttttgtgttttatcaaataaaattccagttaaaaatccataagcacataattcaaatgtcattataggcatcattggaattataggaggcattcctgtcattaatccacttagtataggtgttattattcctactaaagctccaaatgtaggtcctagcaaaaaacctgctattaatactggtatgtgcactggtaaaaatattgttcctgccaagtttactgtatgaaatatcataggcattattattccaaaagctataaatattgctgataaaactattttcttacttttcattgcttatcccccttgaatttaattattacttaaaactaaataatacatttgatcattttcaaaagcttctaccacatttagtccaatatcttcaaataatttaacttgattatctataggtattaatctagcttcacttactgcttcatctttttccttatgcatgttatttaaaaactccctactatttgaatgtgctatcataagttttccatttttacttaaattcttcttaactaatgttttaattgttttagttttattttctagatgcggaaacatagagtaaagaattattttattgtacttttcttttataacttcattttcaacgtctataatttcaaaatctaagtttggtatatgtttgtatttttttcttgcaacttctatcattccattagacaaatctacacctcttatataaccatttttattaagtttctttataaatggtattaatactcctgttcctgtacctacatcaagtactctttcattttctttaatatccaatttagatagtaaagtattgattttctcctcatttacttcgataatattgtcccattcttttgctatattatcgaaaaaatctctttggttcacaaatattttcccccttaatttttaaatcaaaaaaagccatgaaggttttaaaaccttcatggctttggttaaagtaatttatctaagaaaattatagttatatttgtcaactaatatttaactttgtttaagtatatattttaaaactatttttatgctttttaatatatttaatttacgtctatttctttaaaataagaaatagaatctactttgtctttatttgtccctataaataaattttgtgaatcatataatctttcatatccaaaccttactataaaatttccttttgatgatgtgtaataaacatacttttcatcatcaaaaactttagaagttaattcttttgagtcatttggtaatactttagaagctgtatataaagcttcttcattagtaaatgctttttctatattcgaatagctatatccttttagaatcattgcatattttttattatttaatggttttaaatctttatttgctttatgattataagcaagcccatttttaaattcataaaaatagtcatctgagtttttcatagtgttgtcataagttaaatatttcttattaacttctttgtatctttttaatacttcttcgttatcaaaaacttttatactatcatacatagcttctgtatggctattttcaagttctattttatcattaggatttacaacttttgtaggactgtcattttctatacttatttgagcttttttattttttgagtttgtaaaaataactaatgatattataactaatgttaatactaccaccactataattatatattttttatttatcataaaatcctccattatttataaagtggttttgaaactttactatcctttatcataagcaagtactgtatataatctgatgtatattgatctttcttagctttaaacttatgctcaaatggccatataaattttgaactaaatggtgtaaatttattattaagtttaaataatatagcatcatcttgactatttatataatcatcaaataaaattgaatctatttgtgagctagttatttcatcaactgctccagagttttgatatccataatgaatagataatattttacctttatactttttatccttatttaataaacttgcaaaaaaatctattttgcttttattaaattcatcataaaaagtttcttgtaagatatgaaaccctccccattgaccaaagtattttgcatcatttatcttagagtctaaatatttaaagtttttatagatataattatccctaataatattccatttgttgtgaggttgtaaataagatatacacatttgttgtatattgtttgatacatacctaaaattttcaaactcttctttaaatatcttcttataaatatcttcatttttagatatatcttttaaaagattttctacagatgtttttaattttaccttatcatcattagaattatcatagttcttcaaatttatcattaaatattttaaagaagttgtacacaaatctttatctttcattatgtctactatataatctaaactagttttagaactatgttctatatctggacctaatatttttattcttttattttcaggcaaggtctgattaaattcatacaactgtttataactacgataatcatctttattacaaaatgcagttccttttgaatttttaaaaactcgctttaaaatattttcatctccagtttctaaatacttatttataaagtaagcactagtataagggatttcatccaaacagtaatttaattccatttctttttttaaatatttaatcatttttattttaaataaattatccttattcaaagcatgatcttctcctgtaaatactatcttcttattttttaaatcttttttaatcaattcaagtcctgaaaaatcatctatatcatctaaatttacagttgatttattattacttaagtatttacgttctgttttatacggagtacttaaatatactattaacgcaataggaattagcataaataataatatagtgcctaaaatctttatttttttcaataaactatcctcctaatagttaaaagtgattatgtagaaggagaaaaacctttatatatagatggtatatacattgttataattttttctccagtaattttcatctataaaattatgagcttttatagtactttttagccaaatatccattattatatttatatctttattttctaactttcttatcatttaatgctctctcctagtttaaataatatttaatatattataacattttttattttattaaataaaacaatatctcttaagatatggtttttatattgatattttattttgcatatttaaaaattgcatctcttaaagtctgtgctgcttttggtccttttttatcattgtaatattttttaaatctttcatcatctacatacatttgagctaatcctttatgtgattcattagaatatgtcggccatgaataacataaccactctttatgtttttcatatacttttttagcaacattactttctaaatcttgagtttttataagttcttctaaagcttcaaacatgtcttcttctatttgttgcatatttgaaaattctttttcgcttaagtttaaaaacttcttatttgatttttcaatagtttctttcccgtacttttctcttatttcttttccgtgtttagcttcgttttcttctaatttttcttttttaaatccttcaaacttttctttatttgacatatctatttctcctttattatacgctaatgttttttcaacagttaatataagcttattaagttggtcacgtctagagataagttttttataatgctctttaagtgcattatttatatcaaaatttggatttgaaattaattctcgtatatcttctagcttcatatccatagacttataaaatagtatttgttgtaataagtctacttctttttggccatatatacgataccctgatgaatttatacgacatggttttagcaagttaatctcatcataatatctaagagttcgtgcactaactcctgctatttcagataatttctttatagtatattccattttaactacctcctgacaatttaataataaaggattacgttgggtaaaggtcaatagtaaattttctattataagtttataattttctacttatgatttcaacttacttaattttttgtatgtaactaataaaggttatatgtcatataattaactatcacttaaaagggggataagcataatgatattaacaggagcccattacatttacattttctttatcttaataatattaattgctatgataatgaaaaaagacacaatcgtaccttgtatgcttggtgtattttgtctagctttattttacactaataatttagctaaatcagttggagctatttttgatggtttaataatatctttaggggaattaggtcctattataatgataattgctatgatggtgtcattatcaaaagccttggaagataattatgctatagagtatatggttaaaccatttttaaaagtaatcaaaaatgaaacgactgcattttttacagttggtatatctatgacaatactttcttggtttttctggcctagcccagcagtagctttagttggttcaatatttttgcctatagctgtaagatctggccttcctaatattggtgttgccatagctcttaatttatttggtcatggatttgcgctttcaactgattttataattcaaggtgcacctagtataacttctggagctgctggtttaaaagtatctgatgtaataaataatggtatgattttattttgggttatgtctatagttaccataggtgtagctttttatatgctaaaaaaagatatcaaaaaaggattgtttaaaaatgaaataagtaaaagtaaagaaataaacataaaaacatttaacattaaagcaaaaatagctacatttttagtattaattttatttttattagatataattgctatgttagtttttgagttaaaaggttcaaatgcaactgcactgcttggaggaacagctatatttttattaattattataaatataataaaccacggtaaaaatagtttagataaaatatgtgaaaatataactgatggatttttatttggaatgagaatatttgcagtaattattccaataggtgcatttttctatatgggtgaagttgctcctttaactaaccttttaggagatgtacttcctcaagcttcacaaggtttgttatctgatataggtgttgctttatctgaagctatcccattaaataaatatatcgtttgtggtattgagactatagtaggttgtataactggtttagatggatctggattttcaggaatggctttagctggttctactgcttcagtatttggtaatgctgtagatgttaatgttggaactttagctgctcttggtcaaattggtgctatatggacaggtggaggttgtttagttccgtgggctgttatttcttcatcagctatatgtggtgttgaccctatagaactagcaaagagaaatttgattcctgttggaactggcttaattgttactactatagttgctatgtttattatataaaaaaactcttatatcaaaagatatgagagttttttacatattggttgcaaaggcaggactcgaacctgcaacatttgagttacgagcccaacgaactgccaactgctccactcttcgatgttatttttcttattttaaattaatttgaaagttataagtatacttgacaatataaaaaaaaagatttattatgttaatagttaaatctattaaatatattaacaatagaaaaaggtgatgatcaatgaaaaaaaatattaacttgatcgggcaatttaaatccgattggattaggtatagcgactacgaaataaaagaaaataaaaaaggaaaaaaatatatttgcccaattgaatcttcttactttactatgtataatccttttgataatgcaaatgaattagtttttgacttaataaaattaggtgattttgcattagataaatctattgaaaaaagtactattgaaaataaattaatagtatttgcaaaaaaatatggtttattaggtttaatagcttctagtgtttacaatagaaacataataggtgaagaaaaggtactttttgtagaaaacaactgtataaaaaaagaaggtattatggacgtagataaataccttgatttattcttaccattttgtgaagaagaagaattatatattagaaaaatgggtaaacacttaacagtacataagttagaagattctcctaaattttatggtaaaagaccacttatattagaccttgtattttcaagattttactgtgaagaagtagattggattttagattttgcgaaaaatatctctacacatattaaccaactacttatatacaaaaacgctaacttaacagaagctgttactattatggcgggtaaatttaaagcagaaaaaataggaataactataggagtattagataagccaattattgaatgggaatttgattcgcttaaaactactatagaaactatatatgcttttgcagtgactgatgaaaataatatattaactagatgtgaatattgtaaaagtgcttttatagctaaaagtgaaagagaaaaatattgtactccttcttgtagaaattgttctaacgttattaaaagtagaaataagaaaaaagctttagaaaataaaaaagctaatgataataaagtaggtgatgaaaaaatgagtaataaagaaaaaagaaaaaaagaatttgttatggaatataaagaacgccctgttactggtggaatttataaaataacaaatacaattagtggtaagtatctattaatgaatgatatagatttaaaaagcactaaaaatagatttgactttagtgtaaagacagatatgggtatgcaccctaaaatgaacaaagattggaaagagtttggtgcaaattcctttacatttgaagttttggaagaaatagaaaaaaaagacactcaaagcaaagaatcttttaaagaggatttaaaaaaattagaagaaatttgggccgaaaaattagattcaactaaaagatattaataaatatataaaaaactaccaatatgttatttatcttagcagattggtagtttttatttaacatttaattataatgctttttcaattactttacgacttatatctaatcctaaatcaccagtttctgataaattagtcataccatgacgatttagtgaatctactacagtatctacatcatcttttgtaagtccatatttagataaatgagttggcatatctaagctttcaaagaattcacgagttttacttatagctaagtcaattttttcatcatcgctaccttcttttatgtcccaaacacgttcagcatattgaactatcttagctcctttttcttttcttctaacttcccaaagtgctggaagtatagtggctaaggttttagcatggtctattccatatatagcagttaattcatgtcctattttatgagttgtccaatcttgtggtactccagcagctataagtccgttaagtcccatagttgcacaccagacaagatttgctcttgcatcataatcagttggattatctatagtttttcttcctatttctattaaagtttttaaaataccttccgctgttctatcttggaatcttgcatctactggatatgtagcatattgttcaagtacatgtataaaagtatcaacaacaccatttgcaacttgtgtttttggtaatgtatatgttaatgttgggtctagtattgaaaatttcggaaatgataatggacttcttactgagaattttccaccatcgtaactaataactgcccctccgttcatttctgaacctgttgcaggtaaagtaactacagttcctataggtaatccttttgaaactggtactggtgtaaatccatattttaataaatctgttttgtcttcaccatcataattagctgctaagtttacaaactttgttccatccattacagatccaccaccaacagctaataaaaagtttatattttctttttttactacttctactgctttcattaacgtttcgtacttaggatttggttctattcctgagaattcaaatatttcacgaccttttaaagcttcttttactttatctaaagtaccaaactttttgatacttcctccaccataaagaattaatactctagcatctttatcaacaagatcgtttaatttttctattttatcttttccaaagacgattttagttggattataaaactcaaaatctagcataatattcatctccttttgctttatgtatttataataccatatttttttaattgttctcaaatttttacataaaaattcaaatcaaatttaataactagccataaatcccccaacaattatatttttaatgtaattacaaaattaagaaatttataaagaaaaatttttaaaaattcttatatcaaaagccatttatttgtagttttcttgatattacaaataagtttactatgtaggtagttggtgtagtagtataaaaaacactcataagttataacctatgagtatttttataaaccttagttccttattaatataagtattttataaatatatatcattaaataacttttctgttatattttcggtattattcagtatgtttttcattccaaaaaatatacttcctttaacttctttatattttctatttatatttatttgtttatctatttgctttactatatctatatcacttatgttttgccctatatacagtttaacattcgtacattttactacatctgaccaccattttactaaaacttcatatggactatttttatcttttatagtccagtaaatttgtggcgctatataatctataatctcttcctttatccaacttaaagtatctgcatataaactatagtaactttctaaattgttagtttctgatcccttaatatcactacttttatttttccatactccaaaaggacttattccaaataaaacgcatggatttgttgattttataactttatttactaatctaatcatattatttacagcttcacgcctagaattagcaagtaccccatccttatcttcgccttgtggtaatggatagttgtatggataaaaataatcatcaaagtggatgccatctatattgtaatttgatactatttcaaaaatagttgtagctatataatttataacttctaaatttttaggatcataaaaaagtgaattattatatgacagtacccaacttggatttaattttgctggatgattatttgataaatcatctaaatttattccttgcgtagttattctgtatgggtttagccaagcatgaaacttcatatttcttttatgtgtttcttttataaaaaattcaagtggatcatatccaggatttttcccctgtgttcctgtaatatattttgaccatggatttatttttgatttataaaaagtatctgatgtaggtctaatttgaacaaacacagaattaaattttagactttgtaatttatctaaaatttctatgaattcttgtttttgagcatctatattattttgtgtttttggccaatctataccgtaaactgtcgctatccatgcaccttttagttcacataatttataattttcattcattttatagcactcctattatatagtactttaaaaatttaatatatatcttaaactgtgcttgttgttaagatttgtgactttgtatcttcttcatttaagtttctaaacgaagtagacaacatcagtttaattctatttaattggttaacctcactagctcctggatcataatcaataggtacaatgtttatattagaataaactctcttaagctcttttattacaccttttccagttatatgatttggtaggcaagcaaaaggttgcatacatataatatttttcacaccactttcaataagttccatcatttctgcagttaaaagccatccttctcctgcttgatttccaagagaaataacttttgaagctgtttttcctaaagcttcaatattttttggcatactaaatcttttactattttttaaagctttcatataatgtttttggtacattgctatagcatttatagtaagctttccacaaagttttttatattttttatctaaataattgtcagctttataataggtattaaacgcacaacttaaaaagaaatttataagttctggaacaactgcctcagcaccttcttgttctaatatatctacaatattattatttgctaatggatggaatttaactaaaatctctcctactaaccctactctaggttttttctcatctgttataggtaattcatcaaaatctttaactatattatatatattttctttaaattgagataaacttcctttttctaaacttttcttacaaatatctaaatgtttttgataaagtttattagcacttcctttttctacttcataaggtcttactctatataaaaccttcataagtaaatccccataaatagcacccattaaaactttatttataagactcaatgaaaatacactatataaattacttttttcatctccatttactgataatgatattacaggaatatctttatagccagcatcacttaatgcttttcttaaaaaccctatataattagttgctctacaaactccacctgtttgagttattgctacagaagttttgtctaaatcgtattttccacttttaagagctttaattatttggcctataacaattattgcaggataacaagcatcattgtttacatattttaatccttcttcaatagccccttcataacttttaagtaaaatcatattatatccgcaagattttacaccatgttctactaattcaaagtgtataggtgacatttgaggaactaaaatattgtagttttcttttattgatttacttaagcttccttttgtatatgtttttttaatttttataccttcaatattattcttttctctttcttttatagctgcttttaaggatcttagtcttatttttgctgcacctaagttattaccttcatcaatttttatgcaagtatatatcttaccttcgctatttaaaatttcttgaacctgatcagttgtaactgcatctaatccacaaccaaatgaatttaattgtacaagagataaatcatttctagaacttacaaaatttgctgctctatataatcttgaatgatatgcccattggtcaacaactcttaaagaattatctaattttcctagatggcatatgctatcttctgttaaaacagccatatctaaagagtttataagatctggtattccatgatttatttcaggatcgatatgatatggtcttccagctaaaacaattccttttatattattttcttcaatatgttttaaagctttttcccccattttttgtatatcttttttaaacttatcatactctttaaatcctagttctacacttttatttatttcttctttgcttatttctataaattctttatcataatttttaattttatttagttcttcatataattttttctttaatgcgtttttattgttcataggtaaaaatggattcataaaattaatattattttcttttatttcgctaacattgttttttatgacttctgagtaagacataactacaggacagttaaaatggttatctacattttcaaattctttgtgttcatgtcttatgcatggataaaaaatatttttgatacctttttctattaaatcatttatatgaccatgtaccatctttgctgggtaacaaactgattctgaagcaattgaatccattcctttttcatataaatttttagaagatttactagaaagtacaactctaaatcctaaatttgtaagtattgtatgccatagtggataatcttcatacatatttaagactcttggtatccctatttcttttcgttttgcttgatttgcgtctagactttcgtaattgaatactcttttatatttgtatttaaataaattaatgtttttgttttctgctttttctaatcctactcctctttcacatctatttcctgatatgaatttatccccatttccaaaactatttatagttaataaacagttgttagaacattttttacatctagtagtagttatttttaattttattaaattaatagattctttatttaataaagatgtttcatatcctttttcatatttttcttttgcaataatactagctccaaaagctcccattattccggcaatattaggtcttacgacttctctatcagttaatatttcaaacactcttaaaacagcatcattataaaaagttccaccttgtactacaggaaattcacctatatcttcttttgattttacttttataactttatataatgcattttttataactgaataagaaagccctgcacttatatcatttactgaattcccttctttttgtgcttgctttactcttgagttcataaaaaccgtacatcttgaacctaaatctactggatttttagaatatagtgccttttctgaaaattcttttatgtctaattgtaatgattttgcaaaagtttctaaaaaagatccacatccagaagaacaagcttcatttaatattattgtctctataactccattatttattttaagacacttcatatcttggccaccgatatctaatataaaatctacattaggtgagaaaaatttagcccctttataatgtgctattgtttctatttctccgatatcaatttttaaagctttttgaagtaatgcttctccataacctgtaactgcagaattaactatttttgctgtaggtggtaaaatatcatatattttatttaaaatatttatagtagaatctagcggattaccttcattgcttttataatctgaatataataaatttccatcttcatcaactaatgcaacttttgtagttgttgatcctgcatcaattcctaaaaagcaatttccactataattagatatgtccttagtttttacaatatttttatcgtgtctttctttaaagtttatgtaatctttttcattttcaaataaaggcttaagaccactactatctttgctttcatcataatttgaattttttaattttgatagtaaatcacttagcataatagtttcatttttacatgatagcgcggctcccatagctatatataattgagcatcttttgggaatacaatatcttcatcttttaaattaagtacatctataaatgcttttcttaactgtgataaaaagtataatggtcctcctaaaaatgctacttttccttgtatctttcttccacaagctaaaacactaattgtttgaactactacagcgtggaaaatactcattgctatatcttcttttctagcaccttcatttataagcggttgtatatcagtttttgcaaaaactccacatcttgcagctatattgtatatatttttataattttttgctaattcatttagtccactagcatctgtttttaaaagtgttgccatttgatctataaatgatcctgttccacctgcgcatattccattcattctttgttctatgccatttgttaaataaattatctttgcatcttctccacctaattctataactacatctgtttctggattatagttttcaatagcttttgtactagctattacttcttgaacaaattctacacctaaatcatttgctaaattcattccacctgaaccagttataactatagatacacttttatttccaataacttcataagtatcacttaatacttctgtaacagctttttttatatctgataaatgtcttttgtattgtttaaatactatgtttttgtttttatctaatacaactacttttactgtagttgatccaacatcaattcctatattgaaaatgtccatcatacctatcaccccattatttttgttgtatttttgtctatatttgtctttttagatggatttttaggattaattatcgttccttgttacattttaccataaaagaaatgtattatctaatattagataatacatttcttttatggtatcatctccagcaggtataggtaagtctttaactatgataggtggaccattaggatctattataactgtagttaaacttatctctttagcttttccagaaaataattttaatactatataagatattacaccaaatactataccatctgctatagaataagatagaggcatcattattatagttaaaaatgctggtatagcttctgtaaaatctactaattctatttcttttattggttctatcataaataatccaactaaaactaatgctgatgctgtaacagctggtgttataatagaaaatattggtgcaaagaataatgctaaaaagaacatacatgcagtagatacagctgtaagacctgttctaccaccttcagcaactcctgatgcactttcaacaaaagtacttacagtacttgttcctaaacaagctccgattgtagtacctattgcatctgcaaataatgcttttttaacgttaggaacttttccatcttcatctaacattttagcttttgtagcaactccaactaaagttcctatagtatcaaacatatccataaataataatgtaaataaaactattaacatatctatgctaaatatattatgccattcaaaattaaataaattagaagatattgaaggtggcatactaataattttagtaggtaaatctataattcccataggtattcctattatagtagttattatcatacctataaataatgcaccttttacattcttcgttaataatatagatgttattaatatacctattatagttaataaacctgttcctgatgttatatttccaagtgcaactatagttcctccaccatctggatgaacaattactccagctccttcaagccctataagtgatattaaaagtcctatacctactgatatagcttttttaatattgtttggaatagagtcaactatagcttcacgaacattaaatatagttaatattataaatattataccttctaaaaatactgctgttagtgcaaactgatatgaatatcccattccaacaactactgtatatgcaaaaaatgcattaagccccattcctggtgctagtgcaaatggcaattttgcatatagacccataattaatgttgctacaactgctgaaaaagcagttgctgtaaatactgatcctgaatccattcctgctgcagataatatactaggatttactattaatatatatgccatagtcataaatgtagttatacctgctaaaatttcagtctttattgtagtgttattttgtttaagtttaaaatacttctccatttaagtcatcactctttctgtcgaattttgttgtttcacagaattatataatatcatattttgatattttgtacatactttttcgaatattttttttaatttaggttttattgtatgcatttttaatcattattatttttatattagattgattgaaaatgtttttatattatcttataattaaagtctgaacataaactaataattttattcggaggtacttattatggaaataaaaagatatgaaggaactggaagaatgagtagagctgttgttcataacaatactatatacttatgcggtcaaactcacggagaaggtgatgttaaagaacaaactaaaatggttttacaaaaagttgaagatttattaaataaatatggatctgataaaaatcatattttatctgttactatctacttaagagatatgaaagattttgctgatatgaactctgtttgggatgcttgggtaaatgaaggttttgaacctgctagagcttgtgttgaagctagattagctagagaagctttattagttgaaatgtcagttactgctgctgttaaataaattttaattaataatatacttaagaactacactttttggggtagttcttttattttttataatccccagataatttcacatgtatttatatataattataagtagagatatattttttattagataaaaattttatgaaaatatttatcagtggcgatatcgaaagaacttagggtgttgttaatgctaatgaaattaatataaactcacaatttagcatgtatcataattaagcttccaaataactttaattttgaaattatatataaaaatcataaatatgcttctagaacatcattttatccaaatgtaatttaaaaagtttctcaaaccatttcatttaaaaccaatgattattttcaaatcctcagattgattttatttttagttaaatagaaaatgagctatttaaatagcccattttttctataattcatcttttgttaatatatgattaattggatagtctaagctatcatttatatattcacctttataaagaatttgtcctgttttttcatctaatactactatgtcatttttcattctttcatcttttgaatattttccatttgagtctttccaactatttatacacatatatattttattatttaaaactctaaaagctacgacatcataattaccatcaacattaccagttttataatctttatctacataatctattttatcgttttttaaatcaattttcgaaagtttaatattaatattttcatcttcatccttattatgttgtaataaatataatatatctccttctacatcagcacttattgttatatttccacctaataatgatgttgaactatcttttattactgactcttttatagtattaaatttattattatttatatcataatatactaaataataatctaccttactcttatcttttaaatttgcttgttctacaagagtataaattttattgtttttattaaaaccttcagttaagtttaaaatagctttataaccttctttttcaaaagctttataagtattatttttcttaacttcttgattattcaaattaaaagtgtataaatttaaagaactatctccaatactagttacttcccctttatgattataatctataccgtctactattgagtttaatatatagactttgtcattttttatacctactacaaatttatgttcaatatttttatcttcttttattttttctggtaatgtaaaataccactcatttatttcaccagtttttaaatctttattatggatagtaaactcttggacaaattcaccattttcattgtatgttgtagaaaaactttctacatatcctacattttcatttgacttatatattgtatttccctctggataataatttttaaacaaatctggattagaaattataatcttattgtattctcctctaaacttttcattatttttatatttattaactttaaatccatctttagatacaattgattgtatacttttgtacaaatcagttttttggctttgcaaaaatacaacatctcctaaattttctttacttccttgaatatctactaaatcataacttggttcattgataattacacctactcctatacctataagagaggctaaagttattattaaaactgatattgataatttcttgttcatatataaacctcccttaaattgaaatcttcttattcataatataatatgataaaagtaaagatatcataaataaaaatatataataccctatatgaacagttagtaaattaagtaacaataatctactaaatttaaataagtataaatatccaaatatagctaatgatatatataaaagtcctagtattacccctacttttttaatgcttctttctattaaaacagctgtaaatataactacaacagctaatataaccccaattatatctaccattaagaattctacaatatttggtgatactatattaggtattcttacactgtgcatcatatttttaaatatatttaaaaatattggcgactgtattccagctaagttcttaactatagttaaatttatataccaaaatacaaactgcgatactatagttccatatatcataacagctatagttattaatttagataaatatatattgaatcttgactgaggtaagcataataaggtatatattgttttacttcttgaataataatctctataccatattataagagcatataataaacacattagcactgctattccaagtgcaatagttccatatatatatatatatcttttacagtaaatgtatttacaaattcataccctgtattagtttttaatatacttatattcattggaagtttattatccatactaatttctttcacagaattttttatactaattgctaatccagctaagtttcctagaaataacatacctatcaatgcaaaatatagcttatatatccttttaaattctatattgtataaagttaatattttattcattcttatacacctccctcatcttatctattatagattttccttcttcttcacgagttttttctgcattaaatattaaagataactttccttcatctattaaaataacatcatctgctatcatctctatttctgctatttcatgagttgttattattatactttgttcatctgttatatactttgtaattacacttaagaagtcttctcttttaaatatgtctatccctgaaaatggctcatcaagtattgtgtattttgcattttgagcaaaacctaatattattttaactctagctatattaccttttgaaagattagctatttttctatcatctgttagttcaaataattcaagcatttcataagcttttttctcatcccagtttttataaaactctttcataaattcaaagctttcttttatagttaattgtgcaaaataattatctacatctggaacaaaagctattttattataagttttataatttaatttttcaccatctataagtatctcgccactatctaattttataagtccacatatagcttttaaaatagttgactttccaaccccatttatacctaatatacaagttatcttaccttcatgtatttcaaaagatatatcatctaatgccttaacttttttgtatctctttttagcatttttaacttctatcacaaccccacctcctaatatctatcgtttattatttttataagttcttctttatttacgtttatagctttcatattctctataaaaacattcatagactcattaattaaatcttcttttattctagttataagttcattgtctgtagttatattactttggtagtttctttgagttgtaattatccccatatcttccatctccttatatgctttttgaacagtatttggatttaccttaatatttactgccatctcccttctagatggtatagggtctccaggctgtaaatctccccttacaatttgctgttttatgtatcttataatttgtatatacactggttctttgtcatttggaataaagttcatatcctcacctccgtattactgtactatatcagcagtacacttcataagtgtattatatatataatacacttatggttcaagtattttttataatttattaaaataaataaaaaatggatgactctattttgagccatccattttatttatatcttattccgctccaatacacattttcattgacttgtgctatatccggcaattctacaccttctaatacccattttttaaattccataaaacctgttctatcaacaatataacctacatgttcttttcctgttggagcatttttatctatatacgcctcaacatatttataagtattttttataatcttaactatactttcttcatctgcccaaactataaaatcttctccaagtcttgggtttttctttcctgttctccccattatagatagtctgaaatattttttttcatctctagtccatgcatttgttgggcagtttagtacacactctccacatcctatacattttttatgatctctaactggtctatagttttgcgcacttaaggcttctgttgaaagttgtttgcactttttaacacatgccccacaagatacacatctttctttttcaaacttaggtaatgccatacctattattccaaaatcatgcattctagctttaatacaatcatttggacaccctgttaatgctactttaaagtgaaaatcatttggataaatttctttttcaattctctttgcaaattctgtagtgttgtattgagctttaggacagactttatttccaatgcatgaagctatatttctagtacctgcagctggatatcctttatctttttcatattgatttatattcattttttctataactggttgtattatcttattaacttcatccattttttccataggaatccccaatatttcaaacccttgtcttgttgtcatgtgaatttgcccatttccatattcatttgctattttagaaattatcataagactttctggatctacacatccaccagggattcttactctaagagctgtttcatatttattcttagttattctatatgcatttttcattactttcttagtatttaaatctcttatcataatcttaccctcctagtctattaaatttttagcttcaaaatagttaaatacaggtccatctatacatatataagtatcatccattttgcaatgtccacacttacctactccgcaacacatctttctttcatatgaaacccatatattttcttcatttaaatctctttttaaaaattctcttactgtaaacttcatcatcataggtggtcccacaactatagccgatacattatccatatttttaatttcaagatctggaatatatttagttacaagacctacatgatcttcatatccttcttctgcattatccacagttactataacatctagtttttcactccatctttttaaatcatctttaaataaaatatctttaggtgatttaaatcctactattagcttaaagcttttacattttccaaagttatcgtaataatagtccattatacctcttactggtgctaatccacttcctccagctactactataatttctttatcttcataaagtgaaacatcaaatccatttccatatggccctcttaagaaaaatttatctccaactttataattaaatatttcatctgtaaccttacctacttttcttattgtaaaatctatataatctttacctattccagaaactgatataggactttctccatatttaggtattgatatttcatagaattgacctggcaatacacctttagaattacactttgttctaaaagtccattcaatctctgtatgttttattatttctaaaatttcagctccaactggtatatatggattcatattatttttcctccttatttactaggtcatttactttttctatacaagttgaaaaagatatatactgtggacatgcatcatcacatctaccgcatccaacgcacatttgatatccaaacctcttgttaaaatcatatattttgtgtaaagttttaaatctcattctatctccacgtaactttctaaatgaatgtcctccagccatatcggtatatccatccacatgacatgatgcccatactcttcttctttctcctacattttcattttctttataaaagatatcttgcatagtaaaacatgtacatgtaggacatacaaagttacatctaccacaagctatacatctatcatcgtattctctccacatatcatccatgctcaccttaagaggatttatacttttatttatacttacgcttatgtcattttctttgacataatctacttcaaaatctataacttctccatcaaagtaattaataaactctttatcatttatatgtaattgtatttcatcatttcttaaattcagacctattgagtaattatcagttttattagagttcatacttacacaaaagcaatttctaaaacttttactacatcctataagaacaaattttactttctctctaattcttttgtaaaagtaatcttcttcttttccgtttcttaaatatatctcatctatccttttaatcccattaatatcacaagctcttaaaaaaattaatatatctttatcatatttttgattagcttctttaaattcatcttctgtaaaataaaatagagtttgcgatattggtaaaacaatttccttaggagaaaaatttgactttttatttaactcaatttcctctatactatctacttctttatatctaattacatctgtatctgagtacgttcctttgtatggcaatgatacaggtgcaaataacttatatttttcttttaatttctttaatgaattattaaattcacttgtagataattttattttcatataacccaccttctcaattattagtttgttaaataaatattaacattattttaattttacttccgtgatatatatcacactttgactaaaatctaacaatttttaaatataaaaatagcaaaatactttagttcctaattccctttaaagtattttgctatttcagcttttcttacatatatatttttatttataaattttacaagttcatgtttttctaagattttcattgctcttgataaactttctcttggacatcctaacatatcagataaataagttatagttatttttaaatctataaaatgccatccatctatttcttttccatattcattagctagcctataaagttttgcagctaatcttttgtctatttttattgaaatagagtttttaacttgtctgtataatcttctgtttcgcctttccatataacttataatatttttggttaattcaaagtcatttttcatcatatctaaaaaagcttttaaattatattctaatattaaacaatcttcaaatgcttcacaacttatagtagattttttaaattctaaacttatttcatttatcatctcacctttgtttaatataaatattatttttctatctccattttcacttattttaaatatagaagcctttccttcaactaaaatatataccttatcaactatatctttttcattaaataatatgtgtttttgatttagagaaattaaatttccatttttaaaaattttttcttttgtgctatcatctatatttttaaatatttttatatgttctaaattatatttattatttcccataaaatcttgttctccttgaaagttaatcttctaatctacattttacttttttgtttaaactctgtccacagattagtatatgtttaattttatttatataataaatacttttaacaattgcaaagttcataaaaaatataaaaatagctatctaaaaatttagatagctattttatttaattatttatactattaaagcttaagtctctataaaaattagcttgcgttaaactcacatatggaattaaccataaataacctattcctaatgtaagaatagcaagaattgcccatcctataaaacttaattgtataacaaaatatctccatttattacctttcatcatctttatactcaaactcatagcttcaatagtacttaaatgttcgtgttctattattatatatggagttaaaactaaagctaaatcaaatattgtaagtgcaataataaataaacatattaccaatattcctataatagctcctagtccccatgttatatcagtaaaaataaatgaagcaatagctccaccagcaacaaacattactataaacgttgatacgaatacaactaagcttattataattgtaaaaattagtgattttactaatttactcatggatactaataaatcactaaagctagcatttcctattttttcaatgaacattagataaaaattaggtaatcctacagttgcccataccccaaggccaaaaactaatataaatgttataattgagctagtttcatcttgaaataaacttaatacagttgacaatacaacatataacagtgttaatactacaggaattgtccaatgcccttttaattgactctttgatagctcttttaattctaccctattaattttaaactcctcctctaaccctttagttatatactaaaaaatatatacattatattatattaaaaactttgattttattgattagattcttattttattgatatatattatatataaataaattttgaggtgacataatgataacaataatttccccggcaacaactatgaactttgatagaaatgtagatattaaattttctaaaccattctttgataaagacataaaaaaacttatagatacactaaaatctttagatattattgaaattggaaatcttatgaatttaagtgatgatttagccaatttaaattacgatagatataaaattttaggtactgataaaagtaaatatttacaagcaatacttgcatttgatggacaagtttttaactgtataaatgttgatgattttaatgatgatgattttgagtttgctaataatcatctaagaattatgtctggattatatggaattttaaaaccatttgatttaatccaatctcatagacttgagatgaaagctaaactaaaaaatgaattaggaaatgatttatataaattttggaaaaataaactaacttcttatttatatgatgagcttttaaatcaaaatgataaaactttagtaaatttagcttctaatgaatattctaaagctataaatcttaaatctttatctaaagattttaaaattattaacatagagtttaaagattatagagaaaatagtaactcatataaagttattggtctttactctaagaaagccagaggctatttaactagatatataataaaaaataaaatagataatataaatgaacttaaaaactttaattacgatggatatgtttttaataatgaactttcagatagtaaaaacttataataaataaaaagagtaaatataaatttatatttactctttttatttattatctaactattttaacgtctaagctgtaggattcttctttttacccttagagcttattcccccattttttttaatatactcattatgaacagccttaacagttccagtaagagctaataatgcaactaagttaggaataaccataagaccattaaacatatctgacattgtccatacaatagatacttctcccaacgttccaagtaatacacaaacacatacaagtactgcatatatcttaacagcctttgctccaaatagatattttatattcgcctctccaaagaaataccatccaataatagtagaaaatgcaaagaagaacatacaaatagctatgaatatatctccaaacttaccaaacactgacgaaaatcctgcttgagtaagtgcagtacctataatagaaccatctggagttactgaacgagtagtaataataactaaagctgttaaatttagtataacaaaagtatctataaatactcccatcatagcaacaaatccttgttctgatggatgatcaacctttgccactgcatgggcatgtggtgtagatcccatcccagcttcatttgaaaataatccacgtgcaacccctttactcatagccttttggatagtagctccaataaccccacctgctattgactgaggtgcaaatgctcctacaaatatttcttggaatgctaaaggaatatttctaaagttaactagtataacaattaaagaccctataatataaaataatgccatgataggtacaattgtttctgtaactttagctattctactaataccacctgaaaatactacaaatgataatactgctaatataataccagctataattggttttataccaaatgcagtgtcaaatgcagctgcaatagaatttgattgtactgcatttcccataaatcctaaagctagtataataaatactgcaaataaacttgctaaaatcttaccaaatttacctttaaatgctccttctatataataaactggaccacctgttactgttttatcttcgccaacttgcttatacttttgtgccattacagcttctgcataaattgttgccataccaaagaaggcactaacccacatccaaaatattgctccaggccctccaactgcaattgctgtagctgctcctgctaagttaccagtaccaacttgtgcagctattgctgtagctaatgattgaaactgtgacattccatctgcaccagctttttcactctttttaaatagtcctccaaaagttcttctgaatccttctccaaaacctctaatttgaataaattttaattgaattgtgtaccatatgcctgttcctacaagtaaaaataataggatatttttatcccataagataccatttacagcatctacaatttttgatattacttccatcgcaaactcccccctcgttattgaatctagtatgactaagttttttaatttaaatactcagtctaacctatatttatatcaaagaatttttcaaattttattatagattttatataataaaattacttatatgaaaaattccgtgatagcataaaactaatattctataacttaatggacttatttgacgagtttacttatgaatctatgcctaagttatcttatctatagtttaacttagtaagtgtagtttgaattgatattattagaaataataaatcttttttatatctatattgtatatatttttttcagttttcacaatataaatatagtcattatcaatttttataatattaaatatagataatgactatatttacataaatcaaaaaataatttactatgcaaagttttaattcctttttctagtactatatacataaatcaaaatattatgactaaataaaaaaggtattgattattcatcaaataccttcttttgaactattttaatttttatctaataaaattagttcttaatctatcttctttttcaggtatatttataccatttgcttttcctaattcaatacatttcattaaccatgccatattattacctaaaacacgcatagtttgcataccttctaaatcttttctaacctcatctggattgcttccatgaaccatattccagtattgagaacttaccactggcatattatttattgtaaaatacttatttatttgatcaaaagttgcagtagttccacctcttctagcacttattatacatgctcctggtttatatgaaagatgttttcctccactataaaatgctctatctaaaaatgaagttaacgcaccagatgctgctgcatagtgaactggtgatccaaatacaaatccatcggcttcttttgctttctctgtaaattcatttactacatcatccataaagcatttctcagtcttatagcatgaaccacatcctatacatccacaaattggtttcgttcctacttgaaatatttctgtttctattccattttcttctaatgatttagctacttctgtaagtgctgtataagtacatccttttaaatgaggacttccatttactaataatactttcatatttttctctcccttatattttatgttaaatttaatatacattacgattatatcataaaatatattatttaaattatatgaaagtaccttatttaagtattacctaaaattccccatttcttttcctatcatcatccttgataaaataaaaaagtagttttgacaactgaacttacattatcaaaactactcgttgtataatttaattttttaatatagtttattttttacatactaaaacgctaataaatgtttttataatctgtataagaactgttattccaattataaaactcatataataaaatgctcttatttcttctgctgaatacattaacataaatcctacaaaagaaagtacaaatataatcatagtaataaccataatagtaactatattttttaacattagccttcttttcatataaagtattaatactattaacatcagtataataaacgttattatagtggtatttattatatttgctataggatatttttcttcccaaacataatttttatgtataacatgtcgtagcattcccattttactttgggtaaagtaatttaccatatatgctccaattaatagcaagcattctaatatagtagttagtgcataacatattttttttgctttttgcatattacatcaacctctttgtctataatttaagataagcactgtaattattacagtgcttattttatataatttattttgctgctttatctgttggtaatttgcctactgtagtatattgacagttcccgctatttggatctcctacttgtacaggaaggttattattcatttgccattcattccaacctccatcataaacagtcattccttcccatcctgcatcatatgcaattagccaaggaactgcagctctccaaccagttccgcaatagaatgaaagttcattactcttattaaaattagaatctgaccataatttttccatttcattagcagttataacagttccatctttatgtaaatagtcttgcatattgtatgggtcacttcctgcatgtccccaaactgcacccttaggttcaccagctctatcaatatagctgtatccacttgtcttaccctcaaactcttctttacttcttatacttactaaacggaattttttatcattttttaatttatcttgaactgtttctattgacatcaaatattctggatgtgctggaacagttgtaccaaaatcttttgctggtgttgctttttctactgtagtttctgttttataaccagcttttttccatgcatcaattcctccatttagaacttttacattgtcaacccctgcccaaagatatgcatatgccactctactcgccgctgaaatatcatttccatatataataacagttttatcttttgttactcctaaatctaacatacctttttcaactactttaggatctgatatattccaaataggttcagattctacacttgaagtatctacatgtaaagctccaggaatatgcccttttttgtaagttggactgtctttataagttccccatgaagcttctaatatagtataatttttagattctggttgatttccatctattacactttgtacccactctggtgaaacaaacacttttttagtgtctacttgctctgcctttacatttgacttttctccagtcgttttttgagaatcgtccgaaggcttgctacatcctactgccattgttgctaccatcgtgataccaactagtgcactaattaatcttcttttcataatcatcctccgtcattttttcatcagcttaaaataattatactgcaacgcagtttaatattattctctattttttgaattaatagaaaataatattcaaaaaaataaatctaaaaaacttctttttacgaaatttgctatcgacaattttatcataatttctacaaacatccaatatgtatagaaaaaacaaatacttgaccttagtagtatttattttttctatacataaaatatttttgcacaaaaaaagatatcgacaaaaagtaatgtcaatatcttttcgtgaaatttatcaaatataatttatattattatttatttaattatagaaattaaaaaagttttttactatttattttcagatttttctcttcttccaattaaactccagtataatacaaatgctactgcagaaataattgctaatacaattagcacattgctatattgtatgcatatttcattattaaaaagacctgtaatatttttccctaaaggcttagcttccataagtactgctacatatgttataccaattgatgtagctatgtttaaacaaaaattataaaaaccaatagcagttcctgagttttctttaggtattgtttttatcagtgtatcaatcataggagcatacataaatgcaaatgaactagaaaataatatcattacaaaaacaaatacatatactgatgtttgtataaataaactaccaaaaataagacttattattatacctattatagccatttgaatacattgcttacttccaaatctttttgcaacatttccagacattgctcctacaatagctgctaaaacataagatggaactaaaagtagtgaaacttgatctaatctataattgtatatatattcaattaagaatgggaacataaatataaatgcaagttgaacactatatataacaaaagctacaagtagtactgatataaaatttctgtttttaaaaaattcaatactaataaaagcttttttatttttacttatgtatgtaataaataatacaagtgcaattattaaagctactaaatacatccattcaaatcctgaaacaaaaagcattaatgatgctgaaactgctgaaactaatataaatcctacaaaatcaatacctttacctgtagctttttctttaggaatatactttaatataaaaggtagtattaataaagttaatagtggaattaaaaataatactgtccaatgtaagtatgttgatatatatccacctgtaagagtacctattacttgagatatagcaaaactacttgtactaaatcctaaatatttcttttgttcactatccttaaagtattttgcaacaaatattacatataaagtttctgcacttcctaatcctgctgcttgaattattcttgaaacgattatcataaaaaatgatttttgaaaaataaatcctaatagtgatccaatacaaattaatataattcctaatactagtaaacttctaatgcttattgaatctgctaaagaagcatatacaattgctccaataccaataactaatccagctaaagttacctgccaactaactgcagtagctgataaattaaaagcacttgctaagtctgcagaaatgattttaaatgaattgtctataactagcgcgaaaatcattaaggccaatactgcaggtactgctttttttatttgtacctcattcatctcctttgaagtactaagtgaattttccatgttgacacctcttttattcttttttcatcttagtcttttttcaaaatcgtttgcagattcattattaataatctgtttattttgattcgacatttttagacagaattaatattaacacacattattcgcaattgcaatacttgttaaactatgtgttttactatatttaaaacccttattttaaattttcacatttatatataatcaattttgcaaatttattatatatatttataaaaatattttaaatttaatttaatttttttattttttaataaaaacaaaaaagaccatgttgaatatttttcaacatgatcttttaaaattcattataaaattggggcttgattgttcattgagtaaccatcacttctaacatcactcatatctaatgtatcttcttttattttaaccttactaagttttttaactgctccataaggctctcttaatgaaagtttatctcctcttccagagataacccataaaattttataacctctaggtataacttgtaacttgtcttctcctttaccatcagtaaaatataccaataaattaatctttttattattagcatattcaaaaactgggctaaatttagttgaccctcttcttttaagtctttcttttatatcctttacagatttgactttatacacacgtctgatttcattgtcacattctataatagtgatttcatgattataattttttactatattaagtacttccttaatagcttgtttaaattcttcatcactaatacttccacttatatcaagtgcaacagctatttctgctttatgtgatcttaactgaccccttaaatctaatctatttggttgtcttctatttcttcttgttatagtcttctttttattactttcaactgttcccattaatctacttaagtataagttccaaggtaattctcctttactatttttaagtgatgctatcataccatctaaatattctggaattttacctttttgagaattgttaatagctttttctgtaaactctttaagagttttttcatctatttcactagaatcttcccaaatatcatgagttttttctggattgtactcagtttctatatcatcagattgacgagtatcatcttcttctccttcttcatcatcttcttgtaaatctaattctgtttgaattttttctacatagtattcaaaaggctcataaggctcaagttttaaatcatatgctatatttacactttctaaagtagtagcatatggtggtaaattattcaaatatttatttactactatatccattgccatgttaatagctaaggtactgtatttaccttttaattcttttgctcttactaaatgcatggatattacatgaagaatttcatgtttgattgtactttccatttgtctcatgttaaggtctagaaaaattattggattaaagtatataacatacttagcacctttaaagtttatagctgtaggactacttatatcaaatcttatttctcttgatgtttgaaatagaaaatatccataaaaattatctttgtcttccataagacttagattaactttatctactaaaccaaaaaactcatttttgaaatcttgtggtatatctatttcaaatttctcacccttgcgatttgcttttaacatagcataagtgttaataattttttccgctttataataaagcgctcttttttgtttatcaaaataagtttccatatactatccccttattgagctataagattcaaagtaagctttaacaaattcttcattttctattgctttttcatatactttcttataactatttttaatatccttcataattcctaccattagatctatcggatattcttttaaaaattgtacaaatctatttatataaaagtttgaatcatagctatcatttttaatatttaattctaaatcccttaaaatgttcattgctgctaagtaaagtcttgtatgactttcatttttcactttttctataacagattcacttaaagtttctccagaaaaaacatcttcataagatattaatggactataatctgcttcaataaagcttataaattcttctgcaataacttttcctacatttccttttataacatttaaaaatacagcttttggtattgattctttttgttctttgtatactttataacttttagaaactctttcatagcttcttggagttgcagatacatcttcttcatttattttgtgtaagtattctgggaaagtagatataaactctataactttttgttcaagccctttgtctattgcccattttatccattgattatgatctggttccatatttaaccaaacaaatctattttcttgagctgcatccatatctacaacttgataatcaaaatctgaaccatacttacttgatggattcattgcagctaatatctttacttcatcacttaacttatatccgtttatttctctatttaatattaagttcataagttcttgttgtactatatgttcacaacggtttatttcatctataaataaaagaacatttcttcctttagataattcttcatcaatttctcttaatttagtatgaacagcatatactgttgttttctttactgtttcttcaccattagaattatttactacataagattctacagttggtaaccctcctatttcaccttctttaagtaagtttccatcaataacaattaaactccaattattttcataagctagtttttttgctaatgcagtttttccaattccactttctccaactactaaaggtacttctccagtagctagtactaagtcaacgctttttaatgtctctataaaattcattttctctctcctatatcatctttagtttttcatctacagctattcttttagcttttttacttccatatttataaataaacattaccttgtccatttgcatagtatcactatttctatctatgatactgcaatttaaaaaatctcttacgtatttttcatcaacatcttcttttgataaaacttcctttaaaacttcttctaagtcttctttagttattttccttacaatatatttaatcactaaaatattttcttttaaaaatgctagcattttttctttatctaaatcatctataaaagtaatagctttttcgtcatttttaatggctataagttgtactttaaacgttggtgaatttatatctcttaatgctctataacttatttttacagcttcttcttgtacactttcataaggctcttttatatattttattgcgtcgtaatttttttttactgctaatagttgtaattcttcacttggatttttagcatattgtatagcccatccagattgatttatagctaattttattaccttttctgttggattttttatatattctaataaactccagccagagtttacagcttttatcatcatctcttcacttggattatttatatatttaattgctctaatattattactcattgctaattcttgcatctttgtagttggattttttatatattctaatacaagtccatttttttcaagagctaataatttcatttcttctgttggattatttatagttgatataatattaggattatttgatatcattttaataatttttgattcttccataatattcctttccttctgttattacttttctttgggtataattttccctattatattaatatactttttttataagtttaaacataataattattccaaatataaaataaaatacctaaagctataatagcattaggcattttttatgcaaattatttaatttttacaatcttttaactaatattactttcactttcttcatgtattcttttgagtatttacttgttttgtatatatgagttaataccatattcattaaaatatttaactaaggttcttccatttataagagttatattattatctgctgcaaatttttcacattgcgtactaaagttacttgtagatataaataaccccttcatagcatcggagtttcttagcacagattcaaactctctaagctttggtatatcaatattatttttatatcgctttacttgacctataacttttccacctaatataggatcattatgatttaataaacaatcaattcctccatcatgtgactttttagtttcttctactgtataacccatatttctaaataaaatagttactagactttctaactcatagggatcaacttctagtaagttaatactttcattacttacaatagaattatttaaataatcatacttacatatagggacaatgcttttaagttctaaatttgaattggcatttattctactttgcatagtttctttcaaacactttaacttatctactcttgttaaatctatttttctaaaatcatatttatctatcattgacgatattatataaggctttatatcttgacctgtagataaatctacgtcttctatgtatccattaaatacaatactatctatattattatatatatctgacttaaaaacttcatccatagatctaagcgctattgaatatattacttcgttgtatatattatttatatctttattttttcttggtacttctcttatctcgtctagtttaatcatatacttataactatgcacattttggactatatcttttttcggtaataagtaatctattactaaccttttagtatctttgcagtatccaatatttatatttttattaaattcaaatgggtaatttgaattataacttgcctggtttagagggctctactcctcaattacctggtgaaaatggtgaagcaggcaagcctcaagatcctggaactagcggtactactcctaacttacctggtttagagggctctactcctcaattacctggtgaaaatggtgaggcaggtaaacctcaagatcctggaactagtgcattaaaacaaaatataaaaaatagtaatcttagtaacaatctaaatcctaaaacaggagataatggtatattagtatttattgcattaggatttttatcgttattaggattggctttttttaacagacttaaattaaaataattatattaataatacggaaaaaatatttatttctaaactgaatatgtattaattttaataagaagaattttatttacaataaaaaagcctttaaaatccaaataaactgattttaaaggctttttatataattgttgaagtgtataaaagatatgttattaaaaaaatatggaggtttggtacaatggttaactttgtttttggaatattttttatcgtattgggtggaatttttactaattcagccttaaaactacaaagaactcaagatataaaattaatcaaaaataaaatggttaatatggataaagttaaagacaaagatagttatattaggtttaactttaaaataaaccttattgtaagcgctatgtgtattgtccaaggtttaattcgtatattagctacatgtttttcagtaatagacgatctatcgtgggttacaaatataattctaatgttaactattttagtgtattcatataagcttattttcaaagctcctaacttttaatactaattaactaatatacggtatatgaaaacttttctgcatgattattgtttacatatgtttttcaatctctctatatataactatataaaattgtatttttaggagaaaagattttatatcttttttatgttcgattgaattaataaaaaattttcactttagatttttgttaggtcctaaaataaaatttgataggaggtgagataatgaatataataactatttcatctattattggtggatttctaggtgtttatttttataaaaaatataaacagtcagttagtcaataaaaaaacttaaactaataaattataaaaatatactgtcacttaaatttcactttaaaaactagttttatgttttaaatagtataattgagttactaatttggaggatgaaatgtatgaaattgcaaaaatactgtaggtttattctttatacatgttttctaattactcttatattaactataggaagttatattttttcacgtaatgattttataacttgtttatgctcagcaatatcaattttgggcttaattctaatagttcacagtaatcaaaataatcttaagaaaagtaactagtcttaaaattttactttagagactagttaagtatttaaataaaaattaaagcccttaaaatccaaataaatggtttttaagggctttaatttactggtcatcttcatttaagaaaaatgattttaaaaaactattaaagtttacccattcataatttaatttattattttttaataattcatcttttccttcgaaatcaactttataaatattttcattttcactatttagaactaatatttctcctgcaactaaatcacttaaaactatatacttgttattaaatttatgatattttctaactgctttggtaagagaaataatttcgtccatatcttttaattcaaatcctaaattttcttcaaaaaaaggtccactatattttatataaaattctttcataccttttggaaaagtaacatttaagactttttccgcttcaaaaatttcttgtatattttttcttgaatacatttcatctcttaaaatagtttttaaattatctaaactcataatactaacctctatacttattttttatttctataatataactaaaatttttatcattaataagtaatactggtctactcttcatatgaaacgcatccaatataatcaaatttattagaatgttttatgctattttcatatttaaaattataaattaaaacaaccgtattataaaacttattagtgcctatgtatctttttaatttaggaattatattttcataataagaacaaccttctaataattcatttatactattactccctttctccaatacatatctttctataaaatcttcatcaatttcatatgaatctattttaaaatctgaacaaaatttagagcatataaaatccccatcctcagtataagtacaatcaatataatcttctaattctgtttgattttttatatttcctaaccataatgatactctatttttatcttccatattcttagctcctactgtttaatattttaataaaaagtatatcaaagtttagatttaacattctattttttataactccccattaaatttaagtttaaagtatagatgtaaataatacttaattaaaagtcttatttacatctataaaatcaattatttttttattctatttctatttaaaattaaccctactaatgatgctaccactaatacaaaaaatcctaaaatatctatatctcctgttttaggatttaaatttactaaatctccattattatccgtaaccgttggaggcacttccggtttatccataaccgttggaggtacttccggtttatccgtaaccgttggaggcacttccggtttatctnnnnnnnnaccgttggaggtacttccggtttatccgtaaccgttggaggcacttccggtttatctgtaaccgttggaggtacttccggtttatccgtaaccgttggaggcacttccggtttatctgtaaccgttggaggtacttccggtttatccgtaaccattggattatcatatattataggttgaataactatacctgaaaattccattggtatttcaagaactcctatattatcacttatttcattatgaaaagaatactgtaatttattgatatcctttaagtttttccacaaaatttcattattgttgctattataaatgccattatctgaaatattttctggagttagtatacttccatctttcaattttaatatattattgatttgtatatcatctccaggtttaatttttattggatctaatgttattaattgattatctgcatataaactaatatcatctgaaagttttgataatgaacttaaatcacttatttgattatttcttaaatctaataaacctaatttaatcaagtttgacagtttttttatatctcgtatcttattttccttcaatattaagctaaataaattagttaaattagatagtgaatcaatatcacttatttgatttccatataaatttaacctagataaattagttaagttagataatggacctatatcacttatttgatttttacctaaatctaaacttgataaattagttaagttggataatggacctatatcgcttatttgatttccatataaaactaaacttgataaattagttaagttagatgatggacctatatcgcttatttgattttcacctaaatctaacctagataaattagttaagttagataatggacctatatcgcttatttgattttcacctaaatctaaacttgataaattaatcaagttagataatggatctatatcacttatttgatttccatataaatttaacctagataaatcagttaaactagataatggacctatatcgactatttgattttcacctaaatctaaattagttaagtttatacaatattgtaacccttccaaatttgcaatatttttcccatataaatttaaataagtaattgattctagctgttttttagttatgttactattttcatcttgtctaaatttactattcaatgctttttttaaattttgatctagaatatttactatttcttgttgatgagaatctttttcttttattgtatcgtctgacttgacttctaatgtatccccctctaattctgtacctttttcttgtttttcactttcttttatatcttccgatttagtttcttttgattgaattttatctgtttttagacttactttttcaataacttgttctttattgattgtattgagttcagttttttcgtttgttttttcatttgcaaacacacctatttgtgttgattgcattaatactgttgttgctattgatatgacaatagtctttttcttttttttatttttcatatcttttgttttaattttaaattccccttccttttattttttttatcttataattattttaccttataataatagcaaattttttctattttacatatttttttacaatttataacattttttttaatttgtctgttttttctggataactattagttatttaaaattgtttaaaataactaactagtcttaaaatttagatttagggaatagttataaataaaaaagagtgaaagtattggaattgctatattcctttactctcattctttttttctttttttgtttttaatgaaactttattttttaaatttttgtaaattctatatattttaaccattatcctatttttactttatttctatctgtattatttgtatttgttttgcacttttctttattttcttatatttcattttactttcttttaatcttggattgttagatatattaataatattcaattctttatttgagtgtatgtaattcctaaaaatatatccaatacttcttttttcacctacacttaacctgttccattcatatcctttaaataaatctttaactgtaaaaacttcttcttcatgaatatattttatctcttttatacaatactctaataacttattcataagtgtctccttgctttggtgtgtaattatttttttaaagcttgcttgctatccatgaaaaaatatataaagcagcatacattataataatttttattattataaataatattacaagcctaatgttttcactcataactattaacccctttaaaaagagttttatctctttatttttattataaattagtttaggagcataaaaaaataaattgaaacacaatttattttttatctgtttttaaattttgagtaagcaaaaaatttactttttcaaaaacttgtttttgaaaaaaagagcataatgagtttttgtgcccaaacaagttggtcagctaggcaaagcctatcaaaactctaaaaaaactctaaaaaaactctaaaaaatagacggcacacttttttagcctgtgtaacaccttttagcccctatttgtcccactaataccccacaaaataccactttttataccacatactttttttgttttttttttgaatttgataaaaaaatatattaaaattttaactaccctttttatttaaaataaaagtttggtttgcttatcgctttagtttcaaacaaaaaagaactcacttttaatttaaaagtgagttcttttttaattagcttttaatatgagtatgtatgaaatatatatttttattttatcatactttaactctatacctaaactttgatacaattattttgtgatagaaataatataacaatttgttgtatttcattcaaacctctaggagcttttttatagctcctagactcccagggctatctatatcatatttatatcatagaaaaaaagagcaatgatttttaatcattgcccttttttattttgttaaaaatctaaaattttataaaaagtgttttaaattatttaaaaaagaattaataagtaacgcctataaattagttaaatatatattactttaatttaattttgtaaatcaatatttattatctaaaaaaattaacaactgatgttattttttaagcgtagtctaaaaatataaggatggcgttagcatgattttttggattgaaaaatgaattgaaagtggattgaactttatataattttggattgaaaaatagattgaaaaagtaattttcctaccgacagcatttttattgtaagagttagagttttgctaggctttgcctagcccgatactgaaagtgtcggcaaaaactccttatgctcttttttcaaaaaaataaaattttgaaaagttataagtttttcgctcactcaaaacttaagaatataaaaaaataaatccctaaaaattaaggatttatttgaggaacagtaacaacttttaattattttttagcttggaaactaaaagcatagacaatgtcaaatactaattttattatatcaggtttgactctaactttaaaaaagttaatatattttcgaagttttttattttttattttccatatactcatacaacgccattgataataaatcttgtactttataatttgagttttctttgcaaaatttactaaattccttttgaacttcttcatagactctataacatcttgatactgtattccctttgaatttttttatatttatatctatatcatttatagtctgtctatttatcttgtcctctaaagcctttattcgcctttctaaagcctttaaattatcttctgatacatttgtattgtttttgcatttatttatcctctgaggcttattatcggcttcattaatacaaatgtatttattttgaattttgtcatatacataccctttctttaaaaatctttctcttattgttgaccttgatatttttattttcttacatgtctctgttaaattattttcttctaattctttgtttatatattctatctgatctattacttctaaactatcaaactcttctctatttttcatactacgccccctaatacagtaaatacatttgtattaattgcattaaaaaagtgtatctccttcttaaaagatacacttttattttttactcttctttattttttttatattccatgaaatctattacatctacttttttatttttatttatataaactatattttcattttcctttgaaaaatttctattctcttttaatcttcttttttgcaatctttccataaaagtatttttagctttacttactaactcatcatttactacaacaaactcatatgtctgcttatctaaatatctatgtaatccatcatcttccatatcatccggtaatgcataatctaaataatcttttaataactcttcatctgttttttcttcatcataactttttaaatagaatgtgatactcccacttattttttgccataacttcttatcatccattctcttttcacccctctttagatacaggtactacgtacccctaatacaagccgagaaaatttggcaccttattttatttgtatttttatacttttttacttataataatactagaacaaggttatattaaaccttgttcttttaaaactttaatatcacgaatgcagtttcgtttagatatatttaaaatatcacatatctctttttgtaaaaggccttccgctaaaaggtcttttattttttttcttcttcgtgatatcttttctctctccgttagttttccttgtttaactaatttttcattatatctatttttttgatattctctatctcttcgcttatattcttcttttccaattattacagtcatatgctcttgttctttttctgttatctgtaacaattctattaatgtatcatttttatatttataatttttatctttacttttaaatactttttctgcactttctgttgcctttataagttctctttcttttagaggttgtttaaacatcttatttagttctaaaacgtcttctagtgcctttttttcatcttcataaaaataacataagtagtatctatataaaaataatattgtttctctatatccttttacatcatattctcttatttcacataattttgctatatctaatattcttccttggtacagtgacctttctctatgtacaaatactatttttttaggtcttccctttttctttactctattttcatctaattctggtaaaaattctttttgtatttctcttaaactccatacatgcttatttacttcaattatctttacctttgtcccactttttggatttatacttcctggaaccctaaatattcttgttggatctaatgcatttctatctgctccaaattcttttaattcattatataaatattccattacagctttccataatggtaatgccatatacggtaccttcggtattaaccataataaatatagccctcttccactatctacaattacatttggtattggcatatttttcccaaaataattatcgtttaaattcatcaatacctgcgtttttgtaaatttagtattatatacatctagatctatcatacaacatcctagctctttcaatgtatctattcttctatatggtttataaaatgaatttaatgatacaaatatattttctaagtcttcatattcttgcttttttagattttcaaataggtagtgccattgcctatacccatctttttcattcttttccgctcttgttatccatcctttagtatctccatgaagaatagctaaatactcctcactatcactcacatattctattttcttcaattgttccattatctcacccccttatattgagaatactacaattatatcatataatgtctgattttctcttttttactaatttgttgtgtagttcttagtatcataatattaattaatcatttgctaaagcttaaaataatcttatttcaaataaaaaaaatttctaaaagtcaatactgaaaagatagatctaagtaattaaaatagttttatatatcgtttatatataaaattttactttttagtgatagcataaaattttaataaatgggtatctaaaacatttatgcatatatggtaaaatctttaaaaatatcaaatttacttttttataattaaatatactgtctaaagtaaggggagattgtatgagacttttagaaatattattatttttgatgaaaaataataaaactacaatggatgaattgtccaaaaaatttaatgtatcaaaacgaacaattcaaagagatttagataaactttctgtactagggatacctataataagtaaacgtggaaatgatgggggtataatactagataggcattaccttctatcaaatattgtattaactgtaccggagtacaaatctataattacatcattgtatataggagaaaatatagtagaaaatataaagtcaatatcaattttaaaaaaactttttttagtagatcgatatagactagaaaaattacatgatgaagtaaccgagtattttgttgttgacttaattgaaaaaaaaataaatatgcttgaaggttctaataaatcaataaattatgctttagagactaaaagtatcattagggttcatttggaagaaaaatcatatactataaagccgataagttacgtattaaaaagtgatggattatatttatatgctcattacataaataagtatatccttataaaaatagatgatattaataccattgatattctagaagaaaattataatagaaattttattcaatataaatataacaatgatattaattttataaaaaaataaactccttgttgtactcaataaaacttcaaataatattctgataaaaatttaacatcttacaaaaaaatagtaaataagacatcatatgtcatttttgtaccttattttacttataataaattaattatattagcttaaatattttatcaggaggttattatttgaaaggaaaaagaaaaaaaattagcatattgagtattatgactagtttgttattagtaggaagtccaatttctgtttttgctagtgaacaaaaattatatcaagcatatgctaaaagagcagagacatatccaaatccaataatcagggtagttgatggtaagggtatagatggaaaggataatattgcttattgctatgatcatgataataatttacctggagttcaagatggacctgaaagtgaaaaaacctattatactaaaatccaaagttatttagattctaatgatccatatacagaagcatatgggaaagataaaaagcaaagaatagcagctacattagttgcgggatatccgttagattcatatggttcattagaaaaatttgggataacaaaagataaggctaatcatctgactcagctattaatatgggatataactcgaaatagtgataaagaaatgtcaccgcatggatatattacatctaatatggctcaatattataatgaattactaaagcattctaaagaaaataaatttgaacaaggtaaacttaatctacaaggtaaattagaattcgttcaaagagaaaacttttggagtacaaatagattatctacaacaggaggcaagggaagttttacttttgaaaacttacctaaaggtgttgagataagggactttgacactgataaagtattagatggaaatataaaagttggagaagaattttacgttacctctaatgataaaccaactgaagattttaaattaaaaataaattacaagtatcaagaagtagaattatacttttataagtatcattctggaggcatatctgataactcaaaatcatttcaaaatttagtacgtgcagagttaacagacaaggtaaaagaaattccactagaaataaaaataaatggagattttgaaaaaccagagatacctgatattggtggtactactcctaacttacctggtttagagggctctactcctcaattacctggtgaaaatggtgaggcaggtaaacctcaagatcctggaactggcggtactactccatatcttctaagtttacacctccaaatactggttccattaattttacagtatgtatgagttagcattcctattatacatgaatatgcaaaaactatggcttctttaaagctttttatattatttttataatttaataaataaatatagtattttgataaaaatgttggtaaattgattataaaagcatcttttacaaatttaaatattaagtaattaagtaagaaacatataggtaaatttaatattataaatcctgtaaatatatgacctaaattactacttgggttaaataataaaaaatatataaaatctggtgccatagatcctaatatcaatccaactaaatttaaatgtctatttttcacaaataccactgctgatgggtgtgctaatgtaaatggcataattttctcctttttaagttaaatttcatactttctaattatacaatatataatacatataattacttacaaaaacgtaatataatatttataaaaataaccataagttgcttaaatcaacctatggttattccctattttccataaaatggttctatatgaattataacttgagtatttttattaatattttctcttaataaattttcaactctatgagttagatcatgagctacatcaacagtaataaaaggatctaccattacatgcatatccaagtatatattattttcacttcctctacttcttacattatgaatgtcttttatgtcttcttcatttttaagaatttctctaatagtgtctacatctataactgcactatcaactaaaacttcaattgaagatttaaatatttcataagccgaatgaaatatacaaatagatactcctatagaaactacaggatctataatcataggaaatccaactcttatgcaaactaaagcgattataaccccaatagaaacaaatatatcacttcttgtatgaagagagtctgaaattaatatataactatttaatttttttccctttttatactcatatgttgatacaaatatatttataattaatgtaatcaataaaactattaagctttcattggttatagttaaatcaactggatttataaatctattaatagcattaaatactatctttatccccataaataaaagcattactccaataaacataccagttataatctcaaacttgtagtgtccataaggatgttttttatcaacaggtttagatgctagtctaactccaactaaaccaactacattagatgaagcatccgaaacagaatgaaaaccatcagcaataatacttgcactgtttataaaaaaaccaactataaccttaagaaaagctactattaagtttgcaaataaaataacccacaagacctttttaacttctttgtaattgtctcttctcatattgacctcctaaattaaagctattaagtctataaaaaaatccatgagaaagtataaaactatcccatggattaatccactgcttattaaaagcccagtacatatagtacctgataaatttgtatataatttacttttacaataatttatatgccaatttatctaaattgttacatgtactatattaaattatcattttttaataacttaagtaaagttggttctaagttaaattcatttataatattattaacttctttaagagatttttctcttttatctttagatatattgcctttagaagctctaattaatatattcttaggagagtgggctatatctataaattcaagtaattgagttttatatcctatagcttctaataaatttcctctaactgcatcagtcataagagctgaaactctttcctttataatcccatatttagtaattaatgagaattctgaacttcttatttgatcattaaactcatgttggcagcaaggtacagaaaaaatcattttagcattccatttaatagcattataaagcgcataatcagttgcggtatcacatgcgtgtaatgttataaccatatctactttatcagtatatttgtatccatttatatctccaagctcaaaagttaaattctcatacttatattttttagctatctcattacattttttaataacatctgctttcaaatctagacctatcattttaacatctattttctttatttcaacaaagtaataatatagtacaaatgttaagtaagatttaccacaaccaaaatctaatatagtaagttccttataatcatttttctttatttcatcatctatgatttctataaatctatttatttgcttatatttatcatacttagagtttacaaccttaccttctttagtaaatacacctaaatctattaaaggttgtattagcataccttcttttagtatgtaatttttttctctattatgacttttattaactacatttttattgtcactttttttctttcctaaaaatatcttaccttttttagatatttttaaatcataagtattagtttcagaccaagcacctacttgtttatactttccatttataaattctaacatcttttcatttaacatatttttttctatgttttcatgaaaaacttgtttatctgtatatttttctatttgataatattctttattatttttttcttttaattgaatattgattttattatattcaacatctttatttagtttattacttataactactttaacaatattatcattagttatttcattaatacttttctttagttcttccatattgtcacaccttatcatttcttttttaagtttatatatagctattactattatatattactattcttataagttaaacaattttatatatatttaatattgccaaatatattaagtggtattagcttgctttgtgtattatttttataaataaatagagtatcaaaactagcttgatactctattttcttactattaataagtgttaatttaatattatttactttctttttcttctaatagtatttactgctaatcctattgatgaagctgcaaataatcctatgtatggtagcatactactgtctgatgttttaggatttttagaattatttgtttcatctgaattaattttatcacttgatgcattttgattagtgttttcaatcttctctggtttacttaacacctttgaatcatctttgtcaggcttttctgtattatctaattcacctggatctttcgggtcatcttgactaggtttttcaaccttatctggttcacttggataagtaagtttatctagttttggtttttcattttcatcagttgatttatagatttcttcattagctgcagttttttctattacttgattatttttagctatttcaaatggatacatcttgttatctattgcatatccttctggtgcttttgtttcttggtaatagtaatttccatatgctaaattattaaatactactttaccatctttacctgttactgcctttgttacttcttttttagttgaatcaaatattgtaaattctgttccttctaatactttcttagcatcctttgaatctaccttcgttatttctatacttccaactatcttatcattagctgagcttttttctatcacttgattatttttaactatttcaaatggatacatcttgttatctattgtgtatccttctggtgcttttgtttcttggtaatagtaatttccatatgctaaatttttgaatactactttaccatctttacctgttactgcctttgctacttcttttttatttgaatcaaatattgtaaattctgttcctgctaatactttcttagcatcctttgaatctactttcgttatttctatacttccttttatctttgtatctactacttttactgtattagttttttctgcttcaactactatattctgatttttagctaaattgtatccttctggagctttaacttcaactacttgataatcaccttgcttaacattatcaaatattactatcccttgagaatttgtagtttttgtatctactacttttccattttgcactaagttaaatgttgcaccttctaaaacttttccatcttcattagttttgtttattacaacttttcctggcattgccataagttcatcctctgcaacaactttaactattttactattttctgtaaccttaaatgctataggtgtactatcaagtttataacctttaggtgctaccttttcaactaatttataattgccataaggtagctctaactctacaggactatttgatgaagtagttatatctttaacagtttgtccataaatatcctttactagattaccatttgaatcagtaagtgagtaaactgcacctgataacattttttgagtcttgtcacctttttcaatttttattatttcaacttttggactctttatagttacaacttcatcagttggatttccatttacataagcagtatttgaaactgcttctcctgttccaacttctttcatattagcttgaatagtaatatatgcatcgtctcctggatttatatccgacttatcattaactgcatttaattcttttgtttgatcattatacgtaaccgtaaactgacctgtttgatctattttaatatcagtcagcctcgaatctaatttatcttttacatgcattgtattctttaaaaagtgtcctgctgaatcaaatgctattttatattctatgttttgatccttttcatcattagttatattagttttatttacagttttatagacatttatagcccctgctcctgctgctaacttaactgtagcactagaatcattatttttcccattatatgttaattttgctttatttacatatctaatgtcttttggaggatttggtaatatcaaagtattgtaattaactgaatagctatcattatatatatcaccaagatctatttttagagaatctttttcagctgtaagttttccagactttaaaagctcattagttacatccctatccactccactttcatagtcatgctgaattatacttatactatttttatctaaaaccattccctctggaatttggtcctcaaagtaagcatcccccatttgtccattttgatctctatttatttctacatagtatctaactggtttatttatatctgttataagcccttctcccttagaatctagtggtaaatatgaacctttatacataagtggatttgatcctccacctgttgattcttctctaccttcacctgttaatgtaacagtttctgtatctccattagtgtttataacaatagggtattctccatctttaatatttttatcaccaaccattgttacacttaaatatccctctaatgcattttttatattatcattaaatatcaactttaatactccagtattagggttatattcttgccctgaaaaatgcttgtctgaacatactgggttaacatctctaaagatcttaggcagtgttatagtaatgctatctcctggcgtaattttgcttggatctttaattttataatcaattctgaaagttttaatcataccttctcttacagtataatcatcaaatgttgcacttgttatttcaactgaaggactattagatacatcttcagcatataccattatccctgatgaaataagatttaaaatcatactaaacacaaatactaaacttaatattaccttattctttccctgtctcaaatgatcacctctttttttcaataaaaaaagctatacttacatgtttgtaaatatagccggttgcatcactaactccatatatcccagatgcccatatacagaatatacttcttcgtttcttgtttattaaattttagaacaaaaaaggctatacctacagtttgtaaatatagccggttgcatcactaactccatatatcccagatgcccacatacagaatatacttcttcgtttcttgtttattaaattttagaacaaaaaaggctatacctacagtttgtaaatatagccggttgcatcactaactccatatatcccagatgcccacatacagaatatacttcttcgtttcttgtttattaaattttagaacaaaaaaggctatacctacagtttgtaaatatagccggttgcatcactaactccatatatcccagatgcccacatacagaatatacttcttcgtttcttgtttattaaattttagaacaaaaaaggctatacctacagtttgtaaatatagccggttgcatcactaactccatatatcccagatgcccacatacagaatatacttcttcgtttcttatttattaagtttttaccaaattagtttatcaaatttcgacaccattttcaatattctttttaagaatataattataaatctaacaattagaattatctcttcttactttaactaattttttctttatacttatttccttatatttttttaaaaacatttcacctttatgatttaataagtcaacataagagcataagtcacaaacttctataacacctatatcttcattatttataccttcaatattactaaaagtcccaacaatatctaaaactctaattttcttcttttttcctgcatttaaatatattctagttacctcactatgaacttttttatctttcttttttatccttttattatttaataatatacttgaagctttctcgaacttaatttttcctttttttatatcttcactacttaattcattaatagtatttatttcatggccaatatattttattatctcagctatatatttttcgtctttttcattagccatggttatagcttttccatatttatctgttcttcctgttcttcctattctatgtatataattttctttatccataggaacatcataatttataactaaagatacatcatctatatgtattcctctacttgctacatctgtactaattaaaatattatatttaccttctttaaagtccttgattacaaatatacgcttttcttgagacatatctccatggagttgttcaactaaaaacttatcttttttcatcttgttgtataatttagttactctatctttagtatttaaaaacactatggtagtttttggattataataatatattagatcttttaaggtattatatttttcatcttcttttaaagaaactaaattttcttctatttgtcttttgtctagattttcatcattttcaatttctatcatactaggatttatcatatatttattatatatataagatatatctttatctatagttgctgaaaataagcctataacagtctctttaggtatattattaaatataaactccatatcttctataaatcctttgttaagcattttatcagcttcatctattataaaataatttatattgtctaagtttatactacctctatttatatgatctattactcttccaggtgtagcaactactacatgaactctttgttttaattcatttatttgatcttttataggttgttttccaaatattgcactacacctaattttttttaatcttcctatattagatatttcttcttttacttgtatagctaattctcttgttggtacaactattaatgcttgtagattactgttgttaacatctattttttcacatatcggtattccaaaacttgcagttttcccactaccagtttttgatttaacaactatattttctttatttaaaagtcttggaattgattcacattgaactttagatggagtattatactcaagattataaagggcttttattatatctttatctaaatcaaaatttttaaaattattaatcattactaccaccttacttatctaaattaaaatttttatagctatttattatatcatatctttaaagtaatacatcttttttaatatattaatcttattgtctcttaaatatttaatttcataatattatatattcataaaaaataccttagcttaataaaatttaatataagctattattttatattttaaattttattatttaaaggagaattaaaattatgtttgaaatgataaaacatccttataacaacaaatctatagctagattggacttaaataatattgtccacaatcacttatatcacaattgtccgattggaaaagtatctgcaaatcttgtttatgataactataataatgtagttggaaaagttgatgaaaatggacttatatattctaatctagattcaaatcctataggaaaagttctagataatggatttgtatataaaaacaacaatttagttggaaaaattaaatgtactaaatcctcatctccatacttagctggagcttcatatttattgttaatacatgaaaatagataataaaaagatgactaatacaaactagtcatcttttttattattaaatttattgatattgttcttttaatatatttttaaattctaaaaattcaagtggtttaaaatatacatacccttgtatcatatcacaattaaattgtcttaatatatctacctgtttattattttccacaccttcacaaactactttaaagttaaactttttagctaatttaattatagtttttacaaataaaaaagtttttttatcttcctctaaatctattatcatagttctatccaattttaatatatctatatctattaattttaaatttgataatgtagaagtacctgttccaaagtcgtccatagaaacttttattcctaattttttaatttgatatattttgttatttatatattctatatcatttagtgctgctgtttctgtaatttcaatttctatcaatttaggttctacatcatatttttcaatagtttgtttaatagattgaattaaatcagctctgtaaagttctactcttgataaatttatagaaattggaactattttttcaccttttaatttgcatttttttatatccttgcaaacttcctcaagtacccattttcctattaagtttatatttccatttttctctgctatcggtataaatatatttgggcttataaatccttttttattatgatcccatcttattaatgcttctgcaccaactatcttttcattatttatatctactttaggttgatatacgactttaaattctcctgattctaatcctttttttagttcactttcaattataatttcttgactgattctattttttaaagcttcatcatatatatagtatggcttgtccttaacttttttagattctaatctagctatatttgcattatctataattttatcaatttcttcagtagtattttctattatatacgcccccatgtttaattttaaatttaaatcactattattagaacaaacaatatttatataatcatgaagttttactaaagttgttttcaaatctaattttttatccaatttaaacatcaaagcaaatatatcattagaaattcttccatgtatattttcaaattttaaaatagataacttttcacctatacttttgataagattatcaccctcttcatacccaaaaacatcatttataaattttaacctatttatatcaatagaaactaaaacatatttatcatcatcnnnnnnnnnnttttaacttttttttacaatctatcttaaactttatttgattatttatattagttaaactatctatataggtggcttttcttaaagctttcttattttcaacatattttttatagttattaatcacataaagtaaggtagctataaatatagtcaataatgatatatttattatattagtcaaacttgaaaaaactttatttataggtgttattgaaactaaataccaaccatcagtattttctatataattataatacaaatatattcgttcattattaaaaacccctagtttgggattcttacaatttgaaatatttgttttttcttttcctttatctagatatttacttttattatatagtgtttttataccttctttatttttttcattaccaataataacattaccatatttatctactatatatagacttcctttataagaatatatactttgttttaagcttaaagctataccttcataatgtgaaaaaccaactaacactccctctattttatcgttaattacaaaaggaatagaatatattatactatctttcccatcaattatgctttttgttggcttgcttacatacttctttcccttaatgctttctttaaaataattactattacctacatatatttttccatttccataggttagataaccagctttgttaataatcccaatacccttaaatgaattcgaaacatttgatttgttaaatgtatctacaaatatttgttttgcattttcgataccatatttatctatatcatagtttatataagaattaaaactctctaacttagacatattattgtttatataggtagcaattctagcttctacttgtatatttacctctgatatattaattgctatttcatcttttaaatttttatctacaattaaaataaaactaatacttataaatcctattattattgtactttttaaactttcaataatatttttatttaaattcttactcattttacacccttctgtctttattattagcttattgaaaataatccacattgaatttttttatgttattatcatacatattaatactcctttaaaaaataatgtataaatattatttcaaaaaactttcatatttatttatataatattttttaatactagcttcattaattattctttgaaaacatataatttttaaggaggtgatatattgataactataaatttaaatttaatagctacactctcgatagctataatattatttcttattggatctttttttaaaaataaaattgaatttttcaataaattttgcattccatccccagttataggaggtttattatttactttaatatcattaattttacaactttctaacttaattactattaatattttagaaaatatcgtccctttttttatgagtatattttttacagttctaggtcttaatgctagtttcaagcttataaaaaaaggtggaaaacttttatttacatattggatactctgtggaggtttagctctttttcaaaatataatatcagttgtaatggctaatattacaaatgttcatccattaataggtcttatgtgtgggactatatctatggaaggtggccatggaaatgctgcagcttttggaagcactatagaaggtatgggtgtggatggcgctgtaactataggtcttgctgctgcaactttaggtataattttaggtggtgttctaggcgctccagtatctaggttcttaattgaaagatataaacttagacctaatcctatatatatcaataatacaacaaattttaaatctagtcttattaataaaaattacttaactagaaatcctaaatctaataaatttaatactacaaatttttttgaacaaattttagttattcttttatgtattaatataggagaattaattacaaaaatattatttataaaaactaatatagttttaccaagtgttgtagggtgtatgtttgttgcttttttatttagaaactttaatgaatcaacaaacataataaaatttgactttaaactccttgattttataagtgaaatatctctttcaatgtttttaactattgctcttatgagtattaatttattggatttagtacatatagcaggccctatgtttataataatacttattcaagttatatttgttttactttatgctatttttatatgttttaaattacttggcaaagattttgatgctgctgttatggtatctggtctcataggacacgggcttggtaatactccaaatgcattagccaatatgaattcaataactcataagtatggagtatctgaaaaagccttgttaatagttcctttagtaggtgcttttttacttgatatatttacacttccttgcataataatatttataaatatgttcagataattttgcatttttctaatttttgtaacatacgttacagatttattttaaaatttaatttataataaattgaattatttaaagtttaggaggaatttatatgtcttgtggatgcggaagtacaaataaaaatgatgggaagcaagttgttgatttagtaagaagtaaaggtaagggtgattttccactaagaacacctcatgaaatagtttgtgttaactgttctaaatcttttacgatgaatactcatgtagataaatgccctcattgtaatatgacttatggagttactccttgtagttctatgaataaggaaaatataaaagcagctgatataaattactaaaaaactcccatatgggagtttttttattttaaattagaattatctttttcccaagctataaatataaattctttacctgtaatatccttaatcattttttcagctttttttatttcatcttcttcttttttatttaaatcagctattttatattctttcatagttacctcctatatattagaatagtttttttgtattaatgtttatttaaatcgttatctactgtatctattttattcataaccttttggatttcttcatttgatggatgatcttcattttcataacttaatctattactattaaattcatttattttttcttctaactctgaagtttctttaacttcattattatagttttccaagttatacatatactcatcataaactccacattgttttgatttagattttttatatatcatagtagctcctatagttgctcctatacctagagctgtaagcgtagtaaatttaacagttttatatcttttttgttttcttttttgttgatttttctcttctttgacagctttgtacattctagttgctagcataataaaattttcctttctttgattttaagtttgttacttaattaatattagtatttgatattatctaaaaaaaacacaattaattattgtcatattaggaatttttatgctatgaataaaaatatttttaatataatatattagttaatatatatatttataaggagtgttttaaattgtcattttctgaaaaagaagttttaaaatatttaaatattactacaactatattaatgtttatttatacaatatctttaatatattttgttttatatggtaaaacttttcaaatatcaccttgcttttgttcacttatcataactggttttataaaagttgtttcaaaaaaatttttggatatagtatctccaatattaatatttgctatacttatctttatctttattgcttcatacttaggttctagttttgatttttatggtatagttagtcattatgatgatataatgcattttttatcaggaatcttagcaacactatttggatatgatttattcaaaatgttaaattccaagaatgtagatatttataaaaacagaaaattgattgtttcatttgtatttttctttaatttagctatagctggactatgggaaatctttgaatttttagtagataaatttttcttaactaaaatgcaagttggaggccttaacgatactatgattgatatgattgatgcattattagcatctatcatattgattataagctatgaattttttataaaaaaataaataaataaaacctcacataaagtgaggttttatttataactattatcttcaaattttacattacaatatctatgatataaatctatatcattgcacattccattgaaagaacatgacttcatttgatttagtatactcatataagaacttaagatatcttcttgttcaaaattagtattcacaagttctttatatgagtttaattctcttggtttatcttttttcttaatcatcttgatatccttttcttaaagcaaaatttacttatcgtattttccttctgtgtaattctttacaatgtctacaaaccctaatatttctaaatttgcatcagtaccacttaaaatttgattgtaataccaatttgcaaactctggatttgctagtgtctcattaagctttagaaaatctaattcattaaaattagtaccttgatttttactttcttctgtcatcagtatcatctccttaagtactattattattactgataaacattttagatattcacttaaatatatatttactttattatattcatcttttaaaaattattacctttttatacaaaaataaagcctaaaatcttttattatagattttaggcttttgaatatccatttatttcattaatatagcttcatttaactttaaatttacttctacagttgtattatcacttatatcatcataaatatatcctattacctctaatttttttgcatcattagggtgaacagagtttagttttatctcttgagatttttttattacttcatatgaatctaaatatgttacatttatatattcacctttatcattaagctctgcaatttctaaaactaaactaccaatatctttatctgaaatattttttattgttatttgtgcattatatccacctttaactttatttgttattttaggttcagatattcctaatacatcatactttttatatgcaacaattttttcattagtatttaagacattaaatttatcttttaataaatctacatatattaattgattatctaagttataagaataacctataacttctactttttttgtaaattttttgtgagcagattgaatataaacactttgtcctggttttaaagttactttagacaaagcttcagttttagctaaagcattattctcattatcatattctctaaatattagctctatgtttcttatatttaaatcacttatattcttaactttagtttttgtatcaataaacttattattgttgttatcattaggatcgtctgtaactactggttcacctatttctaatacatttgcatctttataactcatatctgattttacacgttctaaatttattttatcatctttgatattattttcatttgatgcacaccctgaaagaatgctaactgtaaatattaatattatggatattatagatgttttttttacactgtcgttcatatattagcacctcagttctatctctattttattatattatactatatatgactccagttacaatttttttttcatttttttaatcttattgtaatcttttttcaaaattaatccattatattaattattctccaactccaaaatcagtattattataaagaacttctattttattattttcatctaaaaaactatacttttctttaaaccaacttactaattcttcatctctttttatatttgttgtgttatttacaaatacatttatagttgcatgttcaaagttatttaaaactatatccatatctttatcaatcatttctttactttgaccctttatacctaccattatacaaggtgagtcaaaatactttttaagttcttcaactgatttaaacttagcatttttatttaaaaaattattcctaaagtcatagtcaaaactttctacaccaattttaaatactataggtatattaaaaaattctctcatttcatttaatctatttttataagaccaatgactttctaaaaataatttttctatgtttttttcctctattatactttttattttttctagtgtttttttaggaagttcaaaacaacttcctgagtttataacttctaatactttatactttcctgttacattttctaaagttttaaagtttatttcattcattttatcttcattatcatcattatctagtgtataatcgcaaaatgaacatttaccccatacacaagaaaatccttttaataatactatttctctttgatttttattcgtaacttcactatatctatccattgttttctccattagttttagtttttattagtttttaatttatatataaaattagatggtattgataatacagcactatttacaagtaaaacagctataagcttatctatatagtctgttaatacttgagttaaaaatacactcacaactttgttgattccaaatcccgataaaatttgcactatataagaagaacctgatgatgtcactcctccaaatacaaatgctgctattatagcacttaatatagaggttggaattgaaaatgcaagtactcctataggtgtttttactccatttaaaaatccttttttatacattaatccagctattagccctgttgagatttgaactggcataaaaaagaatgaataaatatcaaaagtcatgccacttaccatgctcccacaaacacctgtaattattgcatacttagaacctaatatacatgctataaatatagttcctatagaatctaaatatataggaagttttaagtttaaagctataaatgcgcctattacatttagagctattcccaatgatattagagttaaacttgttgttgataaattttttttcatactaaattattcctcctgtagtgtttattttatctacatgtgatggaaataatctttttaaaaacatatacataaactctttttcattagtttgagtaagaacaaaactatttggttcctttttataaaaattaaaagaatctacaatagattgccccatagctactccatcttcaactacttctacatagctttcaaaaccactacataaatgtctatcaataaagtaagcaactgctaatgggtcatttattacacaccctataataccttcttgttcccagtgaaaatctatataaaatcttgttatttcagtaatatacttagctaaatcttcatcaagtctatttataaattctattatatttggggttaatactatttttctagttacatctaatcctaccatatgaatttttttaggcaagttcttgtaaacataatctgctgcatgtggatctacccaataattaaactcagccactggagaacagtttccatgtattctaaaagcacctcccatagaaataaattcatctaggttattaaaagcttttttatctttcataagtgcttttgcaatatttgttagtggacctaatgctattatagatacatcttcattattttttaatgtttctataataaaatctacaccaccatatttaatatttttattagttgatgtcttgtagaagttttctcctaatccatcttctccatgagtgtcttgggctgttacaagttctcgttttagaggattttcttctccaacatatacatctatgttttcgtttgaaaatctatgaagtgtatacaaagcattttcagctcccattttagcaggtacattcccgctacaagttgttattcccaatatttctagctcaggtgagtttattgctaataataaagctagagagtcgtctattcctgggtcacagtcaattattacctttcttttttgcataacaaatctcctccttaaaatttataaaggagaaccttacaactttttaactaaaaagtcatagctaagggtatatcttatatactgccactatataaataccttagttttttatacttggaggttctcgaacaagtcccaacattaaattgcaacgttggattttcaatatattcattaatttagattgaataaaagtcagtaattagtcagtttgaattttttattcacattatccacaactaatacgactgcttttactagttgattatacattcaaatttattttttttcaataatataattaatctattgaattagataaatttaataaatataacataaaaatttatttttatataaggacatgcaactttttatatgtgttcatcatatgctataacatgcgtagcgaacatgtagcaagtgtaacgcagttaacttgacggaatgtgagtgaagtgtttatgttagctcatagcaacctaggcacattctatgctatttaaaattatataaaaaataaacaggagagtgtctgctctcctatttttatgccacattttcttcctcgatattaacttttataacatgaggtagtgattgcaaatctttatccttattagcataaactttatctttatggtccttataaaaaaattactccaaaatacatatgtactctggagtaatttttattatttatttttcacttcataatttacaactttataagttacaggagttcctgtctgttcgtcgttatcatattgcacaacttctaccttgtgttttccttcttttaacgaattatcttgtaatgttattgtagtttgagacatttctccaagttgttctttagtattaagcataccatctatatatacatacgataatttactaccatctaaattttcactagacaaacctatttgatctaattgagtatcttgtcctacaaatacagttggaatatttccattttcagttgttcctccagttgtagataaaactacgtcaccattacctatttctttatctagcccttctggtatatctttcttagaactcacttcctctttagttatattttcatttgctttagtgtctccttttgaactagaacatccaacaactcctaaagctaatacacctgctaaaactaatcctaatacttttttactcattatgataattctccttcaattaatataaatcattaatagtatacaatattgcacgtgtcactttttgtcaatttgtgataaaaattacattttttaatttttaaaataaaaaagcacctaacttgatggatgctttatatctatataattattgttcatttatgctttctaattggctttctactaatccagctcctgctgctaatataaatggtactatcatcaaaatttctaatattattgtcatatataaccactccaatgttttatttatttgatgagtctattgtacatgtttaatcttaaaaaagccttgcgtcaaccttaaacattccttacatttttgatgcatttatttctgtttcatttttctttaaataattgttagacataaaaaaagaaaactaaataaatcaaatttagattccatgctatataaataattaacctattagagtatcactgcaaatagcatttaagctctcaaggttatttatctccttaaggaaatctgtttttaatcttaaagttgatttgtttagttttctataatatatttataccttgttttacttaaaataaacactattttaggaagtttttcaactaagtaagacaaaaaatgtagtaagccatttagcctactacgttactttttatctaacacatacattacaaggatcactcttacctttgtttttggcttctcttagtgtcatgcttaatatagttttactattctttaaagttgcacaattcttagatgaatggtagctttttccacctggagttatgaaaacagtactattatcagataaacctgaatttccaccattgcttatatatgtagcgattccattagatcctatatgccagccatctatagttgtatttgtagccatcataccatttccatagaaataataccatgatccatctaattggtgccatcctgtaaccatcatacccttatgatttagataataccaagttcccatatcatctaaccaccctgttttcattcttcctgatcgattaaagtaataataagtatagttcacttgctcccaaccagttgacatcacaccattttgttttaagtaataccaaatgccattggattccaaccatcctgtttgcatagcacctgaagtacataaataataccatgaaccttcaatttgttgccaatctgttgccattgttccatttggattaagatagtaccatgtatttcctaactgtttccaacctgttgccattactccgtttggctctagataataccatgcaccacctatttgcttccaaccagtcgccattgttccatctgattctaagtaataccatttacctgaaactaacttccagccagtttgcataataccattactatcaaaatagtaccatttgtctgaattttgtatccaacctttcttagtatctgcattagatacagacatactagttaccactagccctaaagctaatacactagatataagcaatttttttaacttcataacttctcctccatgtttatttataaccgtaacaagtatatattaacatttatgtaaaatattgtaaatttttagaattaaattggtgttttttagtaagaatacttggatagtatactcttattttcatttaacaaagaatctgaaatcccgaatttacaattaccaaaacaactaataaaaatatttaaattatatatcgtactattatatatgttttttatataaatagactgtaaaaaagtagtaggttcataagcctactactttttattgtttaaactttcatatctatataattattgttcatttatactttctaattgatttcctactaatccagccccatgctgctaatataaatggaactataattaatccacccaatcttattgtcatgtataattccacccaatgttttatttgacaagtttattatacatacttaacctaaaaaaacccttacaaaaacatttaaatttgcttacatttttgatatattcttaaagttattttatttgtgatttaacccacagtaaaatttgatctccagaagctttactaaaataataactttgtaaagatttatttccctcagatgatgagtctgtatttaaaaagcataataagtaagataaagacatgctataataatttaatgtatttaaaaatgctaatgctaaaggatttttttctatatttccactctctgttttgtgatattctgataattgaattctaagatttcttatttgactgtttataaatgtagattccttaaataaactagttttatcttgcttattaattacagctttaagtgaattagaacttaatatatatatttgatctcttattttagtcaattcatttaaataagtttcttctattttttgaggttgatttaataatctttcagcataaatattatatgagttatcaaatttaataaacataaatgaagtacttactaaatgagaaattttaatgtctataattgatattaggatgttataaaaataagaaagattagaatataaaataatctttcttatttttatttaatgtattatttaaaactatttagacatatttagaagtatttgaaaacttatcttgaatgttttaaatatgacaaataggaagtgtattatgacttataaaatagaggagatacatatctaatttatagattatgtagctttatttaatactttttaaatagttattaaataaagattaaacaactatttaaaaagtattaaaaatatagtaaaatagttattaaataaagattaaatctaaatttaatctaaaaaaggagtaaggaaattggctaaaaatcaaacaattctaacacacatgagttttaaaggcggaagttctaagacttgtttaaatttaaattttatacatcaattttgtacaaattatcctgataaaaaagtactatttatagatgcagatcctcaatctaatgcatcagtttttttattaggtgaagaagtaattcaatctgatatatatactttaaaagatggacttgaaaatgatgttgagattagtaaattaattataaaatctccattagataagtttaaaaatttagatataatagcaagcaatatagatatggttacgcttgaattaatacttaatacaaagccaggaaaagaatatacgttattaaactatttaacagaagataaaaatatagatgttttatcagaatatgatttagtagtatttgatttaaatcctgccatatcagttttaaatacaaatgtatttatatgttgtacagatataattcctataataaattatggttgttatagtactttaacaggatatgatttattattaaaaacttatggagatataaaaaaggcacttagagttgataaagacgatataagaaaaccggttataactaagtttgaaaaacaagaaaataataaaatcagaatgtggcttgagtgtgcaactgaaaaaggaattttaggaaatacttttaaacaaacaatgagaaaatcagttcattatgaaaattcaatattatacaatgaagcaataagtgagtatgttaatgttaaagaaagaaagataaaaacagacataactaatgagatgactgatttaattaatgaatacatagaagatggaataataactatttaataactatttaataagtatttaatgattatttaattaatattaaatatagattaaatctttatttaataattggaggtaaggtatgaacattgaaaatccaatgttaaacaagaaaagtagtttgctaaatataaagcaaaaaatagatgaaaaatcaacaggacaagaatttattgaagcaaaaaataatgaaataaatgtattggatttaataaataaacctaaagcaaaagaagaaaaagtaatgcttggaattaagcttaaaaaagaggttgcagataaggttaagtctttttcttatgaaaataatatgacagtatcagaagtattagaggatatagtaagtaagatgtttgcttcagttgaattaaatgaagaggctctaatggcttatgaggaaaagtacaaaaagaagtcaaagaaacaaaaaaagaaataaatattctaaaatatttatcatgttttaaagtaggttatttaaattatttgtagaatatccaatataaagtaatttataggaggatatttaatggatttaaaaataagtgacttacctccacaatttgagaatatagctaatagattaggtatcgaaaaagttaaatggctatttgaagaatttggaggaacatctgtgtactttcctactaaaaagatgatatacaaagaatctcgtgatagagagatttttaatgagtttaatggatttaatataaaagagttagctagtaagtataatatgtctgaaagttatattagagcaattatacgtcagaaaaaggctggttaacctataatagtgtaaattctagatttttaacaaaactacaaaagagatacatatctaattttagatgtgtatctcttttagtttttactatttaatgtttcatgtgttacgctatttctaaattttgtagtttctatttgaacaattttgcatcagatgcaactattatatagtaactattaggttcaattatatttgagatttatataaagtaataggtatcaaaattttaaaaaactttatacaaataaagtaaatggctgatttaattaaaatttatctattttaactaaactttaaaaaataaatttttttaaatataattattataaaaagagtgtatctaataaaagtaagtaatttcaatagatacactctttttatttatgactattccctaaatctaaatttaatgactagttaaactattattactaaaaaaagtattgtaaaagttttctagtctttgtgctacttcctgaactgtataaaccttattactttccaaaataaacttaagtgttgctaatataattgcagcacaaatatatgattcatattcaatatcacgattttctttattgtcatcttctataagattgatataactatgttttataatttcttgcatatcatcatatacatgaattttttctgttctaattttccatagccctaaaatagtcatcttttgagcataaagttcttcaagcaattcagctttaagatttaatatatctttaagatcttttccatttacgaagataagactaactaaagatttaaatttatctaaaaaatcatgagagattatctctgccaaattgtatttatcagtgtagtacttataaaaagttgaacgattaatcaaagccctatccaatatgtctttaacagttatagagttgaagtctttttcgtttaatagttgaataaatgaactttttatattgttatttgtcttaattactcttaaatcatttttaagttccataaagcacctcataatctattatatttatgtatatattatatccgaaataaataatccaacatagtatatgaataaacgcatacaatatttttaaatttatatacatacgcaacatttgacctgattttgttgtttatcaaacactttattaaatacttgatggttgttttagagtgtaaatgagagtatatttcaattaaggacaagcaaaacaataaaaattcttttaagaaatataaattttgacttaaaaaacattaaataatataaaaaacgaaaaggagaacaaaagatatgaataaatttttaggaaatccaaatttaacaccaacaaaatttgatgaaccaaagccaggtcttaacaatatagtagtagccactacacactatggtcatcaagagatgataatggaaaaagatgtacctgttaaaatgaaagatggtgtgactctttatgttaatgtatttcgaccaaaaaaaccaggtaaatatcccgttgtaatgtctgctgacggttatggaaaagatacattttgtatgtttaaaaaagcgacaccaccaactttaggtacattaccttcttctgactttgctgtatttgaatctccagatccaggattttgggtaccaaatgattatgttttaattaaagtagcgttaagaggaagtgcaacatctgaaggagaacttcatccatggacaatggcagaagcagaggattttgctgaagttgtagaatgggcaggagttcaagaatggagtaatggaaatgtaggtacaaatggtgtatcgtatcttgcagttgttcaatggaagatggcatctttaaatccaccacatttaaaagcaatgattccatgggaaggtctaaatgacgtttatagagaagcagcgtatcatggtggaattccagaaacaagtttctttgattcatgggcaaaaggattaatagctagatggccaggtaaagttgtagaaaatatgactgaaactcaaaaatcacatccacttatggatgaatattgggaaaaaaatatgcctaacttatcagacataaaaactccaatgcttgtgtgtgcaggttgggcaactgttggacttcacaaccgtggctcatttgaaggatttaaaaaagcatcatctaaagataaatggttagtagttcatggtcgtaaagaatgggaaacttactacagtagagagtctttagagttacaaaaatcattctttgattattacctaaaaggaatagataatggttggatggatactcctagagttcgttatgaattaagagagaaattctatcaaggacaaaataaatttacaactgagtggccattaccagacactaaatatacagagttatatttaaatggtgaagatatgtcacttcaagatacacctgctaaagaagagagcgttgtatcttatagtacagaaaatacagaaaatgatgaagtaagatttaaaatagagtttaaagaaaatacagaaattacaggttatatgaaacttaagctttgggtttctgctcaagatgcagatgatatggacctttttgtaggagtgaaaaaatttgataaacacaataaggaagtgtattttgcagactataatcatattgaaaatggtcaagtaagtgctggatggctaagagtttcacatcgtgaattagataaagaaaaatcaacaccatatcaaccatacttaaagcataaaagagaacttaagttatcaaaagatgaaatagttcctgtagaaattgaaatttggcctacaagtgctttgtttaaagcaggagaatcattggtaattgttattaaaggaagtgaagttattgctgaaggtgtaggattaccacgttattcacaccttgatacagttaacaaaggagttcataagttctatacaggtggaaaatatgactctcacttattagtaccagttattcctaaaagagactagttttagaggtagtggcttagttattttataaaaactatttaaagtatcttagttaaaattatataaaataaggcgtagaatcgattctacgtcttttcaatatttaaaatatagttaacgcttaaagataaagaatataagcataaccaataaaataggagtacaacatgttaaaattctataaatctataaactcaaaattagaaactctaaaaaattttgaacatgattgttggatagagttaagtaatccaaaatcagatgaaatacataaggtatctgaaattactaatatagatattgaaactttaaattatttattagatgaagaagagcaatctagagttgaagttggggatgattatattttagtaatagtagacatcccattaaatgaaagtagttcaaactcttcatattatacaacagttccacttggaattataataacgaagactaatataataactataagtacagttcaaactgatattataaatggttttataaatggaaacataaaaaattttaatacatatgaaaaggatgactttttattaaaaattctattaataaacgccaaatactatttaagttatttaaaacaaataagtaaaagaactaatcaactagaaagagaagtacataagtctctaaaaaataaagaacttttacaaattttagagttggagaagtctttaatttatttttcaacatctttaaagtctaatgaagttgttttaaaaaaaattgctaatagtagccatataaaaaaatatataaaagatatggatttattagaagatgtattaattgaaaataagcaggcagttgaaatggcaggtatctatggagatatattaagtagagttatggatgcttttagtgctattatcgataacaatcaaaatagtgtaatgcaatttttaactacgattacttttgtactttctatacctacaattatatcaggattattcgggatgaatgtttctggaataccttttgaacataataaagaaggattttttttagtagtaataattacggttataatttccttaatcacttcacttattatgtatttaaaaaaattattctaagttattaattgtttatactcaactactctttaaaaacttgtttaaagagtactagtaaaaatgcccttagaatccatttatttggattctaagggcattaactttattcgaaatatgtaactagtccttaaagtgaaatttaatgaatagttatcttttagattgacggatatggtcctcccccaatattcacattaagacgttaattatttttgggtttaaataataatgatccccatcttaatcctaatatgtttagtactattatggttaaaattaaacctaatataaaacccttaaaattaggcataaacagatatggaaaaatgattatgcctaataagcttataataaaatttcctaaataagatagttttttatgtttatcaaagaattttttagcttttttcataatttacccacctatttattaattaaataattttaaaaattatttaattatatcatatcatatatagtttacattacttgatcaaataaactttggtgccaaattgaagaaaaaacgaaggttcccctaaaaagtactagtctttaaaaacttatttaaagagttgtagcaaaaagcccttagaatccaaataaatggattttaagggctttaactttgttctaactatgtaactagttcctaaagtaaaattttaagacttgttgttttaatataaaaaaactgcacataaaatcatatgttttattgaacagcttattaaaatttatgactactttttaattaaatattttttatcattattaaacatatatttatttcatcccaaagttcttttatttcttccaatggataaaaaccgacactttgatagaatttccttgtatctgcatagtacttatttgaatttgatgggcctagtgttttaacctgaagaaatttactacccatgttggctaatgtattattagcaacctcaactaatgattttcctacatgcttaccttgatattcttttaatactcctataacatatatttctgatgtatactcattattatgctttatacttataaatccaataggtttctctacgtcataagctacataaaacttagtatcttttacaccttctacatattcaactatagcatcttcaatatcaaaccactcaggaagttttcttaatatgcaatcagtaacattagacttaagctcaatatcatgtatttctataatcttaaacataattctccccctagcatttttatcattcatcttgaagcattttctaactaaattatatcagaacttttaatttaagtgtgttcacaataacagatgttttcgtggttactctcaaaatactattttctaaaaacttatgcccttataatccatttatctatagtataagggcacaagttttatattagatatataatgaaatgttatattttagttccaaatttatagatttcagtccatttaactttaaaaaaaatatactaatgctaaacttaaactataactttaattgaaaataaaaatataattcgtctctagcgctatgtatcaagattgataatgctctaagaactgacttaaatacattgttttggattaatatggaggatgattaaaaattatgaaaagattagaagaaaaactttttaaacactacataggttatttagatgaaagagatgagtatcaacaaagtgtaatctataagactcttgcaaaagtaaatatgtattcattctatttaatttcgattttaatgatgggtagccttatttttgattctgttaatcataggtttacatttggtactgttgcgttattttttattcagcaattcaatgcatattatatttcaataaaattaagaaaaagtggtgttgatgcaacaaaattttatgacaatactacatacctactgcaattaaaaaaattaaaaaaacaagcaattatggctggaacacaatggggtcttgggatgcttataatgatggattacatttttccaggacttgagggtgaacaaattaggatagatttaatttcggttattacatggactttaggaggtgcttttttcggaggcgctatgtatttttttggaaagctaaaaataacaaaagttgataataattaactaaaccttaaaattatttaaaaatatctaataaaaaagcaattaaaatccatttatttggattttaattgctttaactttatataaaatatctaactagtccttaaagtaaaattttaataatactatatttgggataaataatctgactttgataaatcaagaatagattcattttctttaatttcaatttctttaaatcctgcttttttatgtcctcttatagcagcttctctatctagaggaataacatttcgtagtttttttacatcaaaatcatggaaggctgtatctgcaagcttaattaatgcttttgaacaatatccatttcctctatgtttattttctacaactatacctatacgatgtaagtcttttttttcatcgtaataaaaacatacttctcctagaaaatcaccagtagcactatttacaatataagcatagtatctatcgtttcttttagaaatccacttagaataccactcatcccaatacttttcagaaaaatcaatacacccagttttgttattatagttttctgtgccgagattatatcctttattgtaagacatggtttcttcctgtgataaaaaattttgtctatattcaagctctttaaatgatggaacgtgtaaatgtaattcgttcatagttttcccccattttgaaaatttccgaaattttttgaataattatatattattatatcactaagttatatagaatttaactatactaaaaaaacttgtttaaagggatctatcaaaaaagcccttagaatccatttgtttggatactaagggctttaatttataactagtctttaaagtaaaattttagaactagttatacttgatataaataagtttttttacaccattacttttaaaatagcataaatattctgaaaaataaagactttcatcagaagggttttcctaataaaatttaaatataaatattttttaggagaatggaattatgatatttttaatttttattattagttcgatatatatatttattacttggaaaaactcaaaagaaaataaaatttcaccatggctagaaggaaatatacaaattagagatgataaattttttaaatatcaatttaggggaagtataattatatttattttaattatgtcaatatctatatgttttaaaaaatataatgtaaataatagttattttttacttatagtgttaatattttggattttaaattttttagttaaatatacagcactgaaaaaaggatatatatttaaaaagaagtgatattaattatattaaataaaaagatagttgcaagaattttagtttgcacaataaccatgattaatattggtaatgtaggaaatatatttgcatcagagaaaagtagtaattttacaaagtagtttttagaagcaagcgatgatactatagtttgttatatggaagggatgcctataacaaaaagtcatatggaaaaacaaatactcaatactattttactcatttaaatggagcaaaatttacgagtggaatagtggaaaaaactacaaatttacaatataagaaataaaaaagtgctattattagcacttttttatttcaaacaactaactatcctctaataaagtgaaattttaaagctagttattttaatatttattttatatataaaaaattatatataaaatcataaattattaatttaaattaatttttattttctctaattgcttgcgttaacttcttaatattgctatttatacaaagcaatacaattataattaatatatattccattccacttttattatttaaaagtgtattatttatctcattcaaattagcagataaactatctattgtactctgtataaagctaagttcttcttttatttggtttgttccgtccatactatcactctcccaatatcttcttaaaaaattataattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtaaaaaagtccttaaagtctaattatttgaattctaagagctttaattttgtcttaaatacataaaagtgaaattttaatgctagttactttttactattaaaatttaaatagcaccgttatttttagaataacatgaaaattttgtcaattaaagacttttattggtaaagttttctaaatataatgaaaatatagataaatatcctttcataaggttactatgaaaagataagatctaataaattaaaaatgatgagttagtaagtaaagctaaaaatacttttatggaaagattgcaaaaaacttatgaattaaaaagaccaaatatagtgtgtaaagtagataaaatagaacaaacaaattatgaagaatatatgaatatgatatcaaatgattctgtaattgttgaacatgcagtacagcctttagttcagggacttatatatcaattagataaaagtgtcgccctttcatttatagatttaatacttggtggagatggtgaatttggtgatgacaaaagagaacttactgaagttgatagagaattaatatcatatatagcaggtaagtttttaacaaaaatgtatatctttgaaggttgtaaatctagagaagtttctaatatttatacaaatgtaggttcaagtaagaaatatccagtaagtgagtctgttgttgtttctcatatgaagatgatggatgggaataaagaagtaggtaaaatgagtttttgtaatccatatagttgcttagaaccagtattagaacaattagaacctaaaaggcttttcaaaagcaaaacaaatgaatatgattttgaatttacaaatgcgatatacaataaaatttgtagtacaagtactgagatggtcgctatattaggaaaaacagaaataagtgtagaagaattggtaagtctaaaattaggggatattataactttagatactaaaacagatggagatatggaacttcatgtaggaggatcaagagcatttaaatgtaaacctggtcttattaagaataaaaaaggtgttgttataacagattatgtaaagaaggaagtgtagacatatgagcgaaaattttgacagagtattagatatagaacttaaagttagcgtagtacttgggagaacaaagatacctctaaaagatatctttgaattatctaaggggtcattaatagaattagatacttttgaagatcaagaagttgagatacatgtaaacggtagaaaaattggttatggacaagttgtaatagtagatgataattttggtgtaagaataacacgtatattaggtgaagaagaattagcaaaaactttagggtaatctaagtatatgtgtaaataaaatttaaatatataataatattaaaaaagacagataaatttatttatctgtcttttttaatattaattattttggtgttctgtaggtacagtattttcattagaagtattagtttcgttgttgtcaacagtattgtttttttctacattttgaactgaatcatctaatgtgtttgtagaatcctgagattgaccttgttctttatcttctaaattattttcagaattattattttcaactttatctgaattagagttaaataatcctgtaaaccaattccaaattttagtaaagaaaccttctgcttcagtacttgatggtaaatttatagcgtctttatcagtagccgttatctgagcatttttaccaagtacactatcatcagttttttctaatatacctaaatttttatcatttccaccaaatagattagaaacccaatttcctataccttcaaaccaaccttttacagtatctaatatacctgaattatttacactttcacctatagcatttaagttttcatttacagtattagatatgctgtttaaagcatctttcatgtctttgtaatcataattttgttcagatattttagtcattaaatcttttacttgcttttgctgttcaggtgataaagtaacattatagttattagttatattatttatagtgtttgctatttgattagtgtcactagtattattttttataatctctgttttaacatcattgattatacctgttgctttatcttgacctatatcttggcctaatttaccagatactactaactcttctgttgcaatttcttttttattttcatctaatggtttaccagttgcatcttcataagccttcataactccagtaagtgcacctgttccacttacaggaaagttagcagctataacacagttagcatcagttatacctaaacttgcaagagtacttgctatcatagctgaagtaacccatgttatattagctgttttgacatttattccacttccagatttagtaggctcaacataagcacatgaataagttttagttcctatttgagaattaggtgctataccttctaaatattttctttcttctttattgttaacttctaatattacggcatcattttcatttacgccgaagtattttaacatagtttttctttgctcaggtgataaatttgcacccaatgtaacaactcttgctgaatcagcaaatactaaactcatacttcctaaaaccatagtacaacatataacaattgaagttattttcttttttaaactcataattaatctcctttaaaacaatttaaatagatactaatataataaaacattttatagattctgacgattacaaaattataacatttttaaagcatgaactcaaatactatatttatattagataatacttagaaaatataacctaaaatttagattatataatgagtaagatttaggataaatggaaaaaatgtttttattaaacgtatttaaataaaattataaaaggagtaataggatgttaaagctattatataatttaaaaaggtatagctataaaataatgataatagttttattagtatttatacaggcgttgtgtgacgtatctttaccaaacttaatgtcaaatatcgttgatataggaattataaataatgatattaattatatatttaaaattggatttataatgataggtataacattaataggagtaggtgccactattttggctagttattttggagctaaagtagctatggggtttggtagagatattagagaaaatgtatttaaaaaagttgagtcattttcattaaaagaagtaaatgaacttggagtagcatctttgataactagaactactaatgatgtaaatcagatgcaacaagttttaatgataatgcttagaatgatgctttatgctcctatggtggctgtaggggctactataatggctattagaaaggattcaaagcttgcgttaataatattagtatctattccaatactggttattagcatatacttgatatctagaaaagccataccactttttaagaaaatgcaaaaaaatgtagataatttaaatagagtattaagagaaaatttaacagggataagagtcataagggtatttaataaaattaatatagagagaaagagatttaaagatgcaagtttacagctaagtgatgtagccattaaagcaaatagaactataacattattaatgccacttatgatgttattagttaatttatcaataattgcagttgtatggtttggaggtattagaatagataagggaaatatggaagttggagatttaatagcatttattcaatacttatctcagataatgtttgctcttatgatgctatcaatgatgtttgttatgatacctagagcatcggcatcagcacaaagaataaatgaagtattagaaactaactccaatatatataataaaactaattccataaaggaaaccaagttaagaggctatgtagaatttaaaaatgtaagttttatttatgatggaagtagtgaaaaggtattagataatataagttttaaaagtagtcctggagaaactacagctataatagggggtacaggatctggaaaatctaccatcgtaaaattaataccaagattacttgaagctacacaaggtgaaatattaatagatggagttgatataaaagatatagatattaatttattaagagataaaataggatatgttccgcaaaaggctgttttatttactgggactataagagacaatataagttatggaaaagaaaatgctagtgattatgatataaaaaaagctatagaagtatcacaatctagtgaattcgtactaagtaaaaaagatagtattgattcatatatagcacaaggtggagttaatgtatcaggggggcaaaagcaaagactatcaatagctagggcacttataaaaaagccagagatttatatatttgatgatagtttttcagcactagattttaaaactgataaaaaacttagagacgctttagagtcagaagttaaaaatgcaacagttataattgttgctcaaagagttagtactataaaaaatgcagataaaataatagttttagatgagggtaaagttatacaaattggaacacataaagaacttttaaaatcttgtgaggtatataaagaaatagtatcttcgcagctttctaaggaggagatataatatgagtaaaaataatcaagctccaataggaccaagagtgtcaactcagaaagctaaggattttagtggtactttaaaacgattgattagttatttaaatacttacaaattaaacattatattagttattataacggctataattagtgcgttattttctataataagccctaagatacttggaaaagctacaactaagatatttgaaggcgtagtacttaaaatgagaggtcaaggtgaaatagaatttaattttatagggaaattacttatattattaattgtattatatataattagttctatttttaattatatgcaacaatatatagtagtttcagtagcacaaaaaactgtatatgatatgagaaaagatatatatgaaaaactaaataaattgccaattagctattttgatactcacacatatggagaaatattaagtaaagtaactaatgatatagataatataagttctacacttcaacaaagtataactcaattaataacatctgttataactataataggagttgtaataatgatgttaactataagtcctcttatgacaatagttacagtgtttactattcctatgggaatagtatttgtaaaacctattatatcaaaatcccaaggttattttataaagcagcaaaacataataggcaagcttaatggacatgttgaagaaatgtatacaggacatgaaattataaaatcatttaatagagaaaatgaatctatagaagcttttaaatacataaacactaaactatacgaaagtggatggaaagctcagttcatgtctggaatggtaatgccaataatgaattttgtaagcaatattggatatgtattagtatctgttataggggcaatatttgtaactagaggacgtatacaaattggagatatacaagcgtttattcaatatactaagcaatttagtcaacctataagtcaaactgcaaatatagctaatataattcagtcaacagtagcatctgcagaaagagtttttgaattattagatgaaaaagaagtaatttcagataataaaaaaaataaagtaatagaaaatccaaaaggcaaagttgtatttaatcatgtaaaatttggatatgatgaaaataaaattctaataaaagatatgaatttagaagttaagcctgggcaaaaaattgctatcgtaggaccaactggagcaggaaaaacaactcttataaacttattgcttagattttacgaactaaatgatgggaaaatacttatagatgatatagatataaaagatatgaaacgttctgatttaaggaaaatatttggaatggtactacaagatacgtggctatttaaaggaagtataaaagaaaatatagcttatggaaaagaaggtgcaagtgataaagaaataatagatgcagctaagtctgcaaaggcaaatcactttataaaaactttacctaaaggatatgatacaataataaatgaagagggatctaatatatctcaaggtcaaaagcagttattaactatagcaagagctatgatatcaaatcctaaaatattaatacttgatgaagctactagtagtatagatactagaaccgagattaacatacaaaaagctatggataagatgatgatgggcaaaactagttttataatagctcataggttatcgacaattaaagatgctgatgtaatattggttatgaaagatggaaatgtaatagaaagtggaaatcatgaagaattaataaaagaaaatagattttatgctgaactttataatagtcaatttaataattaattaaacaaaaaggtatagtttataactatacctttttttaatgcaatttgattatcttcctatgaacatttgagtccagtatatagatgatccatttgatgctatacctacacctaactcagtgaaatcagggtttaatatgttttttctgtggccaggtgaattcatccatgaattcattacttcttttggtgttttttgtcccatagctatattttcaccagctgcacgatagcttattccaaattgcttcatcatatcaaaaggagaaccataagttggagatgtatgatcaaagtaatttctatctatcatatcttgagattttttagtagctacatttgacaattcattattaaatttaagtggttgtaaacctctgttagttctttctacatttactaaatctaaaacttctttttggaaacttgagaaatttcctgatggagtagaaactttattctcagtaggagtagtttcaggtttagactctgatttttttgatgaagtatttgctgattcattttgagaattacttttatctatagtattagtagatgttttattctcagtagaaatagttttagaattagactccctattagagtatgtagtatcttctacctttttatttgaagtagtatctatattattagataaattaactttactacattttaaattaccgtttattaaatcttgaattaaatagtttaaaggttttactggagcagaacaatcttttcctttaacatatatacatatatattctttatgtccagatttttcgcaatacagttttttattgattgtttcgtttgatgctgcattaataggaagtgtagcacaagcacttaatacagacactacacctaatgataacaatgtttttaatcttttgttcatgtaagtcacctcttctgaaatatttataaatgaattttctaaaaatgttactattttgtaacctatgaagtatggttaccccttggatatttattatcataacatagatctcaactcataggtaatgtaaagttatgtaaacaatatatataaattacaattatgtaataaaatagggtataaatttaaaataaagagtaaaaaatatattgatgggtataaggttaataaatcttataaattagataaaataagcaagatatctagttatttaattcaaataactaaaaatatgttatactataaaaaggtaataatggtaaaagatgaaaggagaaaaattatgtcaaaagaattagtaaaagacagagttataaaatacttaatggaagatttatatgttccacaagagatgatagatacagatgtagcattatcagagtttgaagaaggtgcacaaggtgttatagatataatggtaaatgtaaaagatagagaagatttttatgcgccagttatgataataaaatgtttagatgaagagactccacttcaaggagaagaagcacaagaagcagtaaacttcttagaagatgtagacaatataactttagcaggaagagctgttttaactaatggaaatgaaatgatgtatgcaaattggacaggtgaagagtatgatacagaagaagctcttccagaatacgatgttatggtaaaagagtttttcgacatggaagaacaaataaaagaacatgaggcaagtcatgaatgtggatgcggacatgatcacagtcatggtgatgaccatgagtgttgtggtggaagctgcggatgtggacacgatcataaataataaaaattgtcttaaatttatgatgataaaggggattagcttgactaaccccttttattaatggtattataaatttgttataatctcattaatattttaccgtaatttaggggcaagtttattattggatttattaattgggatttaactttgtcgttcgaggataaaagactgcacaatgtgcagtcttttgttctttttatggataaattaagataatataatattattttaaaaaaatataaaaaaaatcaagggttttgcaaggtagatgtagaataatagatacaggaatttgttgacaagtaaaaagtatttttttaatagtgattacatactattaacatgaggatgaaactataggaatttttttaacttgattaacaaattattagagatagaaggggtagattatgggggctaagagagaaaatacttatgaaaattatatttatagtgactcatcaaattcatcaaatgctatgaaaatgtacttaaaagagattgaagagtacaagatgttgtccgcagtagaagagattgagttagcaaaaaagatagatgaatcatttataggagctaaagaagaatttattaatgcaaactatagactagttgttagtattgctaaaaaatatagaaaagaaaatattgatatgctggatttgattcaagcaggaaatataggacttataaaagctgtagaaaaatatgattataaaaaaggatataagttcagtacttatgctacatggtggataaaacaaagtataactagatatatagatgattgcgaaaatactattagaatacctgttcaccttcatcaaagaattaactttgttaaaagaaaaaaacaagagctatcgttagaacttcaaagagagccaaatctagaagaactagcaattgcatgtgatatagaacttgaaaaaattatagatttacttaaaagagataaaaatataatatcactagatacccctatcaaagaagatgaggatagtagtttagttgagtttataccatcagatgcatattttggggatgtagttatgcatgaggtagaacaacataatctaagagaaaaaatagatgaactgttaacaggacttagtgaacaagaacaaaaagttttaaggatgagatttgggttagatgatgatatacctaaaactctagaggaaataggaaaagtatttggagttactagagagagaataaggcaaatagaggcaaaagccataagaaagttgagacatccaagtagattaaagcaattaaagcatttttattaaaatttattaaaagcatgtatataatttttatttaaattatatacatgcttttttatacctaaaataattatatataaattattaaactaacttttcaactaaataaatcataaaaactgatatgtcattaatataattatgtatataaaataaactcattttcgagggttgataatatgaattattcaaatagagataaagtttatgaagaaatagtttacaatattgaattactaaatcataatataaaaaatataaagatacaaatttttagcaaatcaagtcaaacttatgaacttacaactataattgaaaaagaaattaatgaaactttcaaaaatataaaagaacttaaaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgatgatgatagttttcagagttttagctatgaaaaaggaaatgaaatactaaaaaatgaagaaattaaatctaaagattcaaaaatttttgcaaaaaacgaatttcaaaaatataaaaatggcaaaaatttaaaaattgaagaattaaagttatataaaaaatatctagaagataagtatttatacaaatcaaatatatcagaagtcagacactatataaataaggaaggtatattaaatgaatttataatagtagatactccaggtttaaatcagaatttattaaaaaatactaaaaaacgcatgatagattattataaacgagcagatggagttatttgggttttagatagtcaaaatatagtctcgaaatcgagtaatgacttgctaaatgaattaaaagaaaattatttaatacataataaaaacaataacataatctgcgtagttaataaaattgatattataaaaaagaaagaaaatgatttatttaaagttaaagataaaataaataagctatattttaattattttaaagatatagttttaatatcatctaaagaagctataaaaggatatataaaaaatgataaaaatcttatagaatctagtaatataaagggtttaaaagatagtatagatataaatttcaaacgatattctgaggatatgcaaataagattgttcaaatggttactttcttaggaaaattaataacaggtaatttaccaggtggattactcctaatggatattttaaagattttataccatataataatagtaaagacttaggatttagtacttataaagaagatggatatacatttagagaacttaaatttaatgtggcagggtatactatacagataataaggaatatagattcagaaatggtattactaaatagattactagctgttttttttgtaggagtaatttttgcaataatcattacgtatttcattgctttataccttacaaaaaaagcattagtacctattgagagaacttggaacaatcaagttaagtttattcaagatgcatcacatgaacttagaactcctataactataatttcttccaagttagaaagtattttaaagcatcctcaaaattctataagtgatgaagtagaaactatagcagatgctatgaaagaaaatagaagattaaaaaagatggtaaatgatttattacatttaactaaagaagaaagtattacaaatttacaaatagaagagtttgatataaatgatcttataaaggacataagcaatgattatatagaaatagctgatatgtatgataaagaatttagttatgatttttatgaaagtaatagtattataattactgataaagctaaattaagacagcttatattgatatttatagataatgcatttaaatatacaaatgaaggagattatattaatataagtgtaagtgatagagataataattttattatatctataaaggatagtggtataggaataaaggattatgaagtaaatttaatatttgatagattttttagaagtgaaaatgtcagagataaggatatcgatggatctggaattgggcttagcatagctaaaatgattgtaaatagtttaaaaggaaatataaaggtatattctaaaataaataaaggtacaacatttgatatagctttacctaaaaagataaaaaataattgatttgaagcatatcgcttgggtataattaaaacatagcaataaatggtataaagcttacaaaaatatagtaagatactttatagcatataataaagaatgcaaatataattaatatatattaggagggtaatactatggctaaaatagtaaatacaggaagtttcagaggagcagtagaagaaaataaaggagtagtagttgtagacttttttgcaacttggtgtggaccttgtaaaatgctagctccagtatttgaaagtgtttcagaagaattaaatgatgctaaattcgttaaagttgatatagatgaaagtttagaattagctcaaaaattcggaatatcaacagttccaactatgatgatatttaaagacggtaaagttgtagatactttagtaggatttatgccaaaagatagcttaaaagctaaagtagaagctcatttataagaaatttcatttagggtgctaaattattagcaccctaaactacatatattttgatttataaataaataaagaaggtgaaaaaatatgagatatgatatagctataatcggtagtggaccagcgggtatatcagctgctataaatgctactataagaaataaaaaaataatattatttggaaatgatgatttaagtgcaaaattagtcaaagcaccatcaatagataattatttaggtttttatgatataagcggaaaagatttaagagataaatttaaaactcatttagatgaaatgaaaatagaaataactaaagctaaaataaataatgtatattcaatgggcgattactttagtttaatggcaggggatgagatgtttgaatctagtgcagttataatagctacaggagttgagtatggtaagcctataaaaggagaagaagagtttttaggtaaaggtgtcggatattgtgcaacttgtgatgctcctttatacagagataagaaagttgcagtaataggttataatcatgaagcagaagaagatgcaaactttttaagtgaaatagcatctaaaacttattttatacctatgcacaaaaatgaacttaacttaaatgaaaacatagaagttataaaagatttcccacttgaaataaaaggtgataaattagttaataaactacaattaagaaatcaagagttagatgttgatggtgtttttgttatgaaggatagtgcatcaccaaaagctttagttccgggaattgaaacagaaggtgttcatataaaagttaatataaatatggaaactaatataccaggatgttttgcatgtggtgattgtgctggtaagccatatcagtatttgaaatcagcaggtcaaggacaaatagcagcacttaatgctgttagctacttagataagaaaaaaatagaagagaaaatgaaaaataaataagtatgtaaaaagttatttttaataataaattattattaaaaataactttttttatttttataatcaataaaaatatagaaagtaaataaaaaatatgatatagtattagtatcaggtgataataattaataataaaaatattttaaaaatcaatgcggaggattgaatgaataatataaagctaatatgtgatagtctatcagatatacctaaggagctaatagataaatatgatatacatgtagtaccattaacagttatatttgatggtaaggaatatatagatggtatagatttaagtaaacaagaattttacaaaatgttaagaaatagtgaagatatgccaaagacatctcaatgtacatatatacaatttagagatgcatttaaaagatatttaaataaaggaaatgatatattatatataggaggttcttctgttgcatcaggaacttttcaaagtgctatgatggctaaaaatgatttagatggtaatatatatatggtagatactcaaaatctatctataggtagtggttgtcttttattatcagcagctgaaatgttagaaagaaaagcagatataaaagatatattaaatcatttagagaatttaaaagaaagtgtaaaagtattatttacagtagatacactagagtacttacaaaaaggtggaagaatatctcttgctaaagcaactatcggaaacatgttgaatataaaaccagtactttctatagaagaaggacttgttaaacctataaatcaagtaagaggtaaaaaacaagttgtaagtaaaatattatcattaattaaagaaaattttggagaagatttaactaaaaagagaattatacttgggtttggagataataataaagaatttaattcttttgtagagaaattaaaagaagattttaaaatagatgaaattataagtgtcaatgtaagtacttgcatatgtgcacattcaggtcctggaataataggaatagcttgttgtgataaataaaaatagactgtcttaaaaatttaagacagtctatttttatttattatatattaagctataccaaatagtttaaatatacaagtagttccaaagcatactataaatgctatagctgtaggcattaaaaatccaacagcagtccatttattactaccagtttctttttttatagttagtaaagttgtagcacaaggccaatgaagtaaactaaataacatggtatttatagcagttaaataagtccatccattatcttttaaaacttcacctagagcagataaactatcaaattcaatcatagaaccagtcgctagataagacattaaaagtattggtattactatttcatttgcagggaatcctagtataaatgcaagtaatataaagccatcaagtcctataacttttgctattggatctaaaaatcctgcaacgtgtgataatatactagtatccccaacgtatatatttgcaaatatccatgttatgatacctgctggaattgcaacaacaattgcacgagataaaacaaatatagttctatcaattatagaagtatatataactctacctattttaggggttctatatggtggcagttctagtgtgaaagttgaaggaactccttttagaaaagttttagatagtatataagatactgctagcgtagttaaaataccaaacactatagttaaagctatacaaagagcaactataacactactagcaaaggaattttgtataaaatatgtgaaaaagattgtagctatagctattagtgttggaaaacgaccattacaaggaacgaagttattagtaagaatagctattaatctttcccttggtgaatctattattctacaacctataacaccagctgcgttacaaccaaatcccatgcacatagttaaacattgtttaccatgacaacaagcttttttaaacatatgatctaaattaaaagctactctaggaagataccctaaatcttcaagaagagtaaataaagggaaaaatattgccataggaggaagcataacagatacaacccatgcaagtgttctatacattccgtaactaatcatttcatttaaccataaaggacaatttaaattcgataaaaagtcatataaaataggttcaaatttaaataaaaaatcagataacattccagatggaacattagcaccttctatagtaatccaaagtatcatgcataacattaataacattaatggtaaaccaaactttttagaagttaatactttatctattttttcatctctattgaatttatttttattttgaattgtaacacttttatcatataattcttttgcatatgaatatattgacatattcatactatctctaatattagttttatctatatctaaaggtaattttaatttaatttcatctacagtttttttataatcactacctatatacttactcatagaatcatatatactttcatcaccatctataagtctaagacctaaccatctagattttatataaggtatgtttttagataaatctggctcaattgtattaagtagttgttctatactattctcatattttataattttatttttgtaattatatgatttagatacaactaaatctaatgtatcaagtaattcattcataccttcaccatttctagctgctgttaacactactggtattcctaattctttttctattaagtttttatctatagatatacatttttttctggcttcgtcaattaaatttatacaaagtataacattatctgtaagttccataatttgaaatactaaatttaagtttctttctaacgatgtagcatcagcaactactataactgcatcaggtctaccgaagcaagcaaaatcacgagccaccaattcttcttgagaagctgcaaataaagaataagttccaggtaaatctataagagcaaaatctttattattatgtttaaaatctcctctagctgtacaaaccgttttaccaggccagtttccagtatgttgtctaagtcctgtcagataattaaatacagtacttttaccggtatttggatttcctgcaagagctataacaaattgatcgtcttttttatcgatattaaacatatcttttaatgatttaattttagtagaatcataagttaaccccataaatgtccccccatttaatgctatagatatgaaactattattttttcgccttcttcttttctaagtgctatcatggcacctcttatgttataaaccgtaagattatctttaggtccacggcgtaaaacatctattaaagcaccattagttaaacctaaggctaacattctttctcttagataaccatctgataaaagtccttctacctttacggtgctacatatatctacatcagcaagtttaaccatgaaaaatacctccaattttttatattacaaggtaagttttagcttaagctaaatttcttacaatagatattatgaaaaaaatcatatatttgttacataaaatcagaatatatgagataaaaataaaatatattaaatataagaggttattagggggaggcgatttattgaaaaaccttaatcagttttatacatttaatgaatatatgaaaagtaataatttaagccccaatgaagaagattatatagagatgatttatagactacacagcgatacaaaagatgttaagattagcgatttatctaagtcattaaatataaagccttcatcagtaagtaatatggtaaaaaaattacaacaaaagaatatattaaaacatgaaaagtatggctctattactttaaataaaacaggagaagtaataggggagagattattgtataggcataacgtagtggaagaatttttagaattaataggtgtaaaagattgtttacatgaagaaactgaaaaaatagagcatactataagtatagaaacactagttaaaattagcaatttaataaattttttcaaagaaaatgacgaattaatatctaagttaaaagagtacaaataattaaattgggggagttatatatgaaaacaaagtataaatcattgattaaaatttctttaatatgtatattatttttaatatttacaactccaaatagtatttttaaagaaaaattttatgtaaataaagtagattcaagtgaagcaatttataaaaaatatttaaatatgagtgaagattttgaaggagtaagtataattaataacaatagtgacaaaaataaattaatgaaagatgagtatgcatatgtaatttttaaaaatcatgatgggaaatattacaataatgtaactataaaagaagaaaacaatggtataattatcacatatcaagaagctaatgaaaacgataattataaaaatgaaacatataatagtaaagtagataaaatgatgcttctaagaatcaaatctaatgaagaaataagtagtttaagattgttaaatcattaataaaaaatcacaataaagtcatacaaaattcatatgaaaaaactacaattagagttaagaaggaagtgattaaatatggctatagttttaataactgcagctttagtagctgtaatgtatgggttatatgtagctgcgtatatatctgaaaattcaactgaggaaagcttaatttatgaaaaataatatatggatataaaaagaaaggaactatctcgatacagaggctagttcctttttaatttaattacttttgcattttttacaaattccatgaagtataatattacaagatgttatttttatatcaagttcatttgaaatagtagaaggaatatctttaagtatattagaatgaacatcttgtatacttccgcaaacatcacaaataagatgattgtgctcaactatgttagcatcaaacctatcaggaaatccaggtatgctaacttttttaatatagccatggcttacaagttgagataaatttctatatacagttcctaagcttaaattaggattatctttttttaagtattcatatataaaatctgcagtaggatgaacggtattatcttttacagcatttaatataagttctctttgttttgaaaatttcaaaataccacctcctattaaaacttttttataataaatatacccaaaacagcatatctataatcaaattatattataagttatacgtttaaatcaaatttaactttaaattttattttaaaaagctatgaatataaaaacagagtagtctagaaaagtagactactctttattttaaaagtattaaaaattacttagtaaaatgtctttctaataatcctaagaatgctttaccatgtctagcttcatctttacacatttcatgaactgtatcatgtatagcatctaatcctagttctttagctcttttagctaattttaattttccatcagttgccccatattcagcttcaactctagcttttaagttagcttgagtatcagcagcaacaacttcgcctaataattcagcgaatttagcagcgtgctcagcttcttcaaatgctattcttttataagcttcagctacttctggataaccttctctatcagcttgacgactcatagctaagtacattcctacttctgtacattcaccaacaaaattagctcttaatccttcaacaacttcaggatcaactccttttgcaacacctattctatgttcatcagcccaaaccatttcaccttttaactcatcgaatttgtcagccccaactttacatactggacaaatttctggagcagtttctccttcgtgtatatacccacatactgtacaaacaaactttttcatattcataccctcctaaaataaaactagtaatcattactattattattacaatttaataatatactaaaaatattatcatgtcaataattaaattgattaaaattaaaatctatcataataatattaaaatgattagattaatataacaaaaataaattaataataaatataatggggataatatagtttgaaaaggagtgattgtgtggaaacttcaaaaaaatcaagtacaaataaagtaaaagtcattccattaggagggctaggagaaataggaaaaaatataacagcaatagaatataatgatgagataatagtaatagatggaggattatcttttccagatgaagatatgtatggagtagatttattaattccagatataacttatttattagataataaggataaagttaaaggtatgtttgttactcatggacatgaagaccatataggagctataccgtatatattaaagcaattaaatatacctgtatatggaactaaacttactataggcttaattgaaaataagttaaaagaacacaatatactagatatatgtaatttaaaaccaatagaggatagacaagcagttcagttagataatataaaagtagaatttataagtgttacccatagtatagcagatgcttgtgcattagcaatatatacacctatggggataatcttgcatacaggagattttaaagtagattatactcctatagatggaagaagaatggatttagaaaccatatcaaaattagggaaaaaaggagttttgttattattagcagatagtacaaatgtagagagaaagggtcactctttatctgaaaaaacaataggagagacattagatagagtttttactggacaaaaaggtaggattatagtagctacgtttgcttctaatatacataggatgcaacaaattgttaatgcttcagtaactaataatagaaaagttgtatttagtggtcgtagtatggagaatgtatctagtgtagctatagaacttggatatttaaatatacctgatggatataagataagcatagatgaaatggaaaactttaataatgatgagataactataataactacaggtagtcaaggtgaagctatggctggacttgctagaattgcttttgatacacataaaaaaattaaaatacaaaacaatgatttatttataatatcagcatctccaataccaggaaatgataagcttatatctagagttataaatcaattatataaaaaaggtgcagatgttatttataaagatttagaagctatacatgtttcaggacatgcatatcaagaggaattaaaactactacatacattagttcatcctaagttttttatgcctgtccatggagagtatagacatttagtgcatcataaaaatcttgcagttaaacttggaatgaataaagaaaatgtatttatcttagaaaatggagaagttttagaactaactaaaaaagaagctaagaaagatggaaaggttagagtaggtactgtatatgttgatggtataggtgtgggggatgtaggaaatatagtcttaagagatagaaagtacttagctgaaaatggaatgatgacaatagtaatagctattgataaaatcagttttagtatagttgcaggaccagatattataactagaggatttatatatgcaagagaagctacagatttaatagatgaagttaaagatattgtaacttacgaagtagaaaattgcttaaatagaaacatattagaatggagtgttattaaatctaaggttaaaaaatctgtggatagatatttatataataaattaaaaagaggtactagtatattccctataatagtagaagtttaaagttacagattgataacaataaaattaaatttattgtataaatcaatatgtgtatttataattatataaaatatacaattaaaggggaaataaaatgaaaaagtaaatagaattaaaataaatatagacatatataccccccaaaagttttctaaatacatattcctataattaaattgtacaaccaataatataaaaattcaaaacattatgaaatacaatatctgactaaaatttatataaaattcaatcaaacaacataaaacacgaaatataaggaatttgaactttttatttaataaataaataagtatattgatgaatttactattattgtgatattataataaaatacagtactgtttaaaacatagtagtgtgttaatttaattataagaggtgaagaggatggatttaaagttattaatagaagagtttattgtaaattatgggctaataagtatttttataatagtagctctagagtatgcaaatcttcctctacctagtgaattagttttaccgttaataggtatatttgcatttgaatacgatatgaattttacacaagttttaactgtatctgtattaggaggacttagtgggtctataataaactattacttaggattaaaattaggtaaacctttaatagatatgttaggaactagatttccaagtactaaaaagtctattagagcatcatattcatggataaaaaaatatgataaatcatctattatgatatcgaggttaataccagttgcaagaacttttatttcaataattgctggtgtcataaaaatgaatgtaatagcttttataatatattcaactataggaataagtttatggaatttaatattaatatcagcaggatatatattaggtgataaattacatataataataccaatattaaaaagatattctttatttgtaattattttgataattattattttaggattttatatattaaagaataaattaaatatgaaaaagaatagttaaaaggcacgatagtgtctttttttataaaaataaattgataaaaatttaattatataataactatttaaataaaacttaaacatattataaattatggtataattctacataaaattaaatattttcaaataggagataatattatgcgtaaatttaaaaagaaaattaccataccacacacatttactattatatttttacttatagtaataatagcaatcctaacatatattattccaagtggagaatttaaaaggatcgatgtagatggaagaatggtagtaaagcctggaacataccatcaagtagattctaaccctcaaggtatacaagatgtatttatggcacctattaatggttttgtagatgcagcagaagttgttggatttgtattactagtcggaggcgcttttgggatagtcaataaaactggagctatagaatctggtataaaccacatagtaagaaagcttaaaggattgcaggttttgataatacctgtatctatgatactatttggattaggaggttctacatttggtatgaatgaagaaacccttcctttttatatgatatttataccacttatgacaaatttagggtatgattcattaactgcaataagtacagtatttttaggttcaggaactggagttatagcatccactataaatccattttcagtaggaatagctcaggcattagctgatatagtgccaggagcaggtatattatatagagcaattatatttatagtacttatgactatatctataacatttttaatggtatatgctaataaaattaaaaaagatcctaaaaaatcactagtatatgagttagatgcaaataacaaaaaagattttataatggatgattcaactataaagccatttacaattaaagaagttattgttttagtgatatttattagtggaatgagtatgatggtttatggagttttaaatatggactggtatatacctgaaatagctatgatattttgtatgataggtgttttttctgggatatttggagggcttaagcaagatgagatagtagattcatttttaacaggagcttctgatttagtatctgcagcacttgccatagcattagctcgtggaattgttatagtcgcacaaaatggacatataatagatacattattaaattactctgctgatgctttaagtaagttgccaaagtttatatttataaatttatcttttttacttgagtcattattatcatttttaataccatcatcttcaggactcgcatcacttactatacctgtgttagcaccactttctgatttagtaggagtttctagtcaattaataataactgcttatcagtttggtacagggcttataaatttaataactccaacatctggagtattaatgggtgcattggcttttgcgaaaataccatggtctaagtgggtaagatttttagcacctttatttgggattatgataatagtatgtattatgtttttaactattggactgtatataggagtttaaaatgtatttaaattattaggtaaacgatattttaaaatatattaaataaatgtttattagtattaacaaaagtttaatagtgtgataaaattagtataataaatataaaaatgggggactaaacaatgaatagtatagaacaaatattacattctatggatttgcaatatcatgagaagagagcaaatttggcaagattagcagaagactctttatctcctttaaaaataagtgatgaaactaaatcgtatttagatagaaaaatattatgtgatatgaacgaaggaacaagaccttatagaccaagatacatattaccggattatgttaaatttataaatcaaggtagtgaatatttagatatagagccaccaaaggatttatatgaagcagttaatgcattaatgatactttatagatatgttccttctataacaggatatccagtatatgttgggcaaatagatgatgtacttgaaccttttatggacactgttagtgaaaaggaagcatataacttaataaagatgttgcttataaatatagatagaaatttaccagatgcttttgtccatatgaatataggaccaaaagatactagagttggtagattggtaatacaaatagagagagaacttagaaaaactatacctaatgttactttaaaatgtagtgaagaaactccagatgatcttataaaatatgggatagaatcagctcttgaaaatataaaaccgtattttgtaaatcacagtttaatgactaatgatttaggggaagactatggagttgttagttgttataattcactaagaataggtggaggagcacatactttaacaagacttaatttaaaagctttagcgatggaaagtgaaaattatgaagactttatgaataataaacttccaaaagcagtgaaagcattatgtgagcttactaatgcaagaataaaatatttagtagaagatgtaaaattctttgaaagttcatttttagcaaaagaggggttaatagatttaaataaatttacatcaatgccagccatatatggaacatttgaatgtgttgaaatatttacaggaaaacaaatgggacatgatgaaaaagctaatgatgtagctgaagaaatatgtaagaaatttgctgaattagtaaaaaatgaagaagctatatattgtggaggaactaatggtaagcatggagtacatgcacaagggggattagaatcggatacggatacaacaccagctgtaagaataaaatatggatgtgaacctaatatatttgatcatataaatttatcagcaagacttcataagtattttgatacaggatgtagtgatatatatttatttgatgaaacagctaaaaataatatagatggaatgttaagagttgtaaaaggtgctcttgaaagtggtataagagttttatctataaatagtgattcttcagagtttgttagaataactggatatctagtaaaaaagagtgatataaagaaatttaatgaaggtgaaaacttaagagaagattctgttttattaggagcattaactatgaaaaatggaatagaggaaagaaaggttagaaatatttaatgaaagctcctgtaaataaaattattaacatgagttttatagatggtccaggatgtagaataagtgtatttttacaaggttgtaatatgaaatgtatatattgccataacccagagactcaaaatatatgtatttcttgtaaaaaatgcttagaagtgtgtaaggtaggagctattaagtttaatgatcaaattatttatgataaaaagatttgcataaattgtgatgagtgtatagggatatgtaaaaattatgcatcacctaaaattacttattatacaccaaatgagctttttgattatataaataaatataaaaactttatagacggaataaccttctctggaggagaatgtactttgtatagtgattttataatagaatttactaatatagtgcataaaaaaactaaccttaatgtatttgtagatactaatggatatataaatgaaaatgatattaaccatcttatagattgcgtagatggatttatgtttgacttgaaagctttcgataataacatacacatgaaagtgacaggtgtagaaaataacttagttttaaataatatcaataaatgttctaagtctaataaactttatgaaataagaacagttttattagaaaatataaatgataatgaaaatatattttttaaagaacttaattatataaaaaacttaaataattatactaaatttaaattaataccatttagaagatatggagttaaaggagaactttctaattttagagattatccgaaagaaaaatacatgaaatattatgagaaagcgaaagaagtattaaaagatagaatgctaaatcctataatctaataaaataagtatatatgtaaccctaggtaacaaaatgttagctagggtttttttatgcaagaatatagagtacgaaagacagaaaatatcaaaggacatatatttatagaaatagaaagctaaatacataaataaatatatggggtgattatattgaaagataaaattataaataaaactattgaatggataaaagttataacattagctatatgtatgggacttatagtaacttattttgttgtaccaactgtagttagtggagagtccatgtatcctacattaaacacagaagactatctaataataaataagtttgcttataaaaaagatatgccaaatagaggagatatagtagtttttaaaactgaattaaaagataataaaggcggtaaaaaaagtttaattaaaagaattataggtttaccaaatgaacatttgattatagaagatggaaaagtctatataaatgataaattaattaatgaaagttatataaatgatgactatacttcaggtgatgtagatattgttataccgaatgactgttattttgctatgggagataatagattattaagtaaagatagtagagataaagaagttggactagtaaataaaagtgatattataggagaagtcagtgttaggctatttccatttaaagaagttggattagtaaattaaaattaaatatttaattttttcaaaaatatagggtattcaaatgagtaccctatatttttatggaactaaaaattttaatgaaacaggaaaaatttaatttaaataatactgaaatacagaaaaagtaaaaaattttactattaaaaatagtctgtcactatatataaataaaaaacatacgtcaaatacttaacaaaaaataaccttaaaaaaaaatatgctaaaaaaatataaaaaaatactaaaaatgctttagaaattaaataaagcagtatataatataagcgaggtaaaatttatattgggtatatatttttatttaggagtgtgaggatatagtgagtcagttaaaaataactgaaacagcattaagagatgggcatcagtctttaattgctacaaggttaactacagaagaaatactacctatattagaaactatggataaggtaggatatcactctatggaagtttggggtggagcgacatttgatgcatgcatacgttttttaaacgaagatccatgggaaagattaagagaaataagaaaaagagttaaaaatactaaattgcaaatgcttttgaggggacaaaatcttttaggatatagaaactatgctgatgacttggttgataagtttattaaactttcactggaaaacggtatcgacataataagagtatttgatgctttaaatgatgtaagaaatatagaagcatctatgaaagctataaaaaaatatggtggacattgccaatgtgcaatatcatatacaacaagtgatgttcatactacagagtattatttaaaactattaaaaactatggaatctatgggggctgattctatatgcataaaagatatggcaggagttttaacaccatataatgcttatgatttagtaaaaaaaatgaaagaaataactaatttacctatagaactacatacgcactgtacaagtggtatagctgatatgatatatatgaaggccgtagaagctggagttgatataatagatactgcaatatctccattttcaggagggacatctcagcctccaactgagtctttagcagtaacatttagcgaaatggatagaaatccaaatttaaatatggaagctttattagaagttgcagagtattttaaacctataagagataagtatatggaaaacggtaccttaaatcctaaggtattgttgacagaacctcaaactttaaactacaaggttccaggtggtatgttatcaaacttactatctcaattaaaacaacaaaatgcaacagaaaaatatgaagatgttttaagagaagttccaagagtgagagcagatcttggatatccaccattagttacacctatgagtcaaatggtaggaactcaagcattatttaatgtattaactggagaaagatataaattagtaccaaaagaaattaaagattatgtaaaaggacaatatggaaaagcaccagcacctattgatgaagaaataaagaaaaagataataggggaagaagaagttataactataagacctgcagatcttttagaaccagaatttgaaaagataaaactagaagcgggagaattagttaaatgtgatgaagatgcattaacatatgcattattcccacaagtagcaccaaattttttagaaaataagtacaatccaaaaaaagaagaagtattaagtgaagaaaataaaattcactatataacagtaactatgtagaaaatgggtgataattaatgtttggtaatgaaataagtataatggaagccattaatataactatatctagtatgactatagtatttttgactttgatattaatatcttttgtactatcttcatttaaatatatatttaaaacaaaaccaaaagttaaagaagaattagtaaaaagagatttaccagtgagtcaaaatagtacttacgacgatgatgaagaagataaaatagtagttgcacttgcagcatctataatggcaggagagggaaaaataaatcctaatcttcatgtaaagaaaataactagaataaaataaattatttatataaatagataataaaatatttgagggagagataaaaatgagcgctaagacatatcatataaaattaaatggaaaagtttacgaagttgaaatagaagaagttcaaaagggagaaaatccaaagcctacagttcaaaatgtagcacaacaacctaaaaaagaggtagtatctactggttcaggagaatcaatagatgcaccaatgccaggaactatagtaaatataatggttaaaaatggggattcagttaagaaaggtcaagtagtagctatacttgaagctatgaagatggaaaatgaaatagtagctccgatagatggaacagttgtttctgttgatgtagaaaaaggtcaaaatgtaaaccttggagatagcttagtacaaataggataatcgtataataaatagggggcgttgatgtgttagaaatgttacagactttctttgcaaatacgggatttgcaatggtagattatagacaaataataatgattttaatagcttgtgtatttttatatttagctatagctaaaggatatgaaccatatcttttaataccaatatctataggtatgttacttgctaatatgccaggtgttgatttaatgaaagcagctacagactctgaaagcggagggttattatattacttatatcaaggaactaaactaggaatatatccaccactaatatttttatgtataggggcgagtacagattttggaccaataattgcaaatcctaagactcttttattaggagcagcagctcaatttggagtattttttgcatttataggggctatacttttacaatttacaggaccagaggcagcatctataggaataataggtggagcagatggaccgacagcaatatttttaacaggaaaattagcaccacatttgctaggaacaatagcattagcagcttattcatatatggcattagttccagttatacagccaccgataataagagctttaactactaaagaagagcgtatggttaaaatggaacaattaagaccagtatctaaaactgagaaaatagtatttcctatagttataatgattttagttatagggttattaccaactgcagcaccacttataggaatgcttatgtttgggaacttaataaaagaaagtggagtagttccaaaattagttgaaactgctacaggaccattattgtatattataactataatacttggtttaacagttggagctacagctaatgcaaaaactttcttaacgcctcaaacattaggagtaacagctatgggacttgttgcattttcagtaggaacagcagcaggcgtactatttggtaaattaatgtataaggttactaaaggcaaggttaacccaatgataggtgcagcaggggtttctgcagttcctatggcagctagagtggttcaaaaggtaggacaagaagaaaatccttcaaatttcttacttatgcatgctatgggaccaaacgttgctggagttataggttcagcagtagcagcaggagtacttttacaattatttgttaaatagaaatttataaagctattttaaattaaacttaagtaatgatgattatttagagtttatttgaaatagcttttttagttaactttacaaatgaaaaggttgacatatgtgagtatacatcgttacaattaaaatgtaaactaaaaaaataaaaaaggttaactaaagggggattcaatgaaactaagtactagaggtttaataatttgtgcaatatttgcaagtataactgctattttagctcaaatttctataccacttccattttcaacagttccacttacaatgcaagtttttgcagtaactataagcggtataatattaggagctaagaaaggtcttatatcacaattaatatacgttacactaggagctataggaatgcctgtatttgctggtatgagtggaggaatgggtatggtttttgggtatactggaggctttataatttcatttccaataatggcattagttataggttatgtaagtgaaagaagcgataaagtttattgtataattatttctatgattttagcattagttataaattattcaataggaactttatggtattcatttgtagcaggtgttggaattgtacaaggatttacggtttgtgtagcaccatttttaattgcagacataataaagatatgtttagctactactataggcataagtgttaaaagtagaataaaaaaagaggtatactcatgttaaaaataagaccacatcactttttatgtatgaaagcttttataggaagaggatatagtaaagattttacagaaaatatgataaatacgataaatattttaaaagaaaacaaaaatcaaaagatagaggttgtagttgatttagataaattatgttcaaaatgtcctaacaatattaaaagtaaaatatgtaatactaatgaaagtgtaattcaaatggataaaaaggtgatggactattttaatataaaaactggaatatatgaatatgaagaaattataaatttaatatataataatataaatgaagatataataaaagatatatgtggaaataaagcatttaaaatagtttgtacaaatattgttcccattattatcaaagttgaatttattaaatatcttttcattaagtatacacaatttgatttgtttttctttttaatttcatatattgcttcaaataaatatttaaaagatatcaatgctaaaatcaacattcccggtaatactacaacaaatttaataagtgttattagtactattttaaatgaacttaatttcatggctattataaaactatttatagtatatcctatagatagcccttttattgcaaaaactataatagcaattggagatagtataacagtcattgttcctattgccataattaataaaaaacttaaatccattttaaggtttgatattaatatttcttttaaattcacatctgaattatagtaatttgcagtatatgatactttctcacttatgacatcactatactgaggaaaaaatttatttaatagtgatcctataattacaaataccataaataaactagatataaatattatctccttattaattttgtctaacatatttcttttgtttaatcttctcaaaaattacaaccccctcttttgtacttacataatttttatgcaagataagaggaggttattccaatttataaaagttcttttgtaagtaaaagccctatagatgtcttagcatcttctatatcatttttattaatcatttcataaacttcttctaaatctacttcttgaacatctaaaaattcatcgtcttctaagctagcttctcctgcttctaaatctgtagctaaataaatatatattttttgatttgaaaagccagccgaagtataaaacttatgtattagctttatattattagcagtatatcctgtttcttctttcaattctcttattgcacaatctcttggattttcaccttgttctaattttcctgcaggtatttcccatattgctttttctatagcttttctatattgtttaactaatacaactttattttcattagttatagccactatacctaccgctcctggatgttcaattatttctcttttttgatatccttttctaggaacttctactgtatccacttttaaacttataacttttccagtatatatcctatcactacttactgtctgttcctctattatcataacaaacctccattaagtaatatgctgcattgcttgctgcatcaaaaaattcactatcttgttcataatttctgcccatgcttttaacttttaatccatagtaacttaagtcatcaaaagtattacctggtttgatatatactatattatgtttttcctgtaaattatttttttctatctgtttatttacatattcaagtttatctttatcttcaatacctattggtatattaacatttacatttacaatttcacttaatacagtaatactatggtgactaattcctacatgtctatcccttttatcagcaaagctaattctaggtatagcaattggatttccacctaattttttaactgcatctaatataggtccttgttctattcctgtaaatccatatttagttcctgtacctgctattccaggtcccatacttacaaatacagcatcagcatttaaaacttctttagctgttattaaagctgagtaaatatttatgcactcataatctccaccaaatgcattgcctattgttatagtatcgtctattaatttcttattttttaagttttctacatttttacttaagtatataggtaaagaagctccatctgtcattatatagacaagctttttatttggattatgtcttttatatgaagctgcaaatggagtcagcatactatgtagtgttcctactactacaggaaggttctctaagcttttaaattcatttattttatcatgtaatttactatcttgttcttcaactgaatctacttttacttgcataggtgtatatcttaacttcattatatgtccaccaggagtcatattagactctagtttatttaagtttaatataacaaagtgatatccacctgttccaagacttaattcaactgcagtagtatttaatactacttcatttcctatatctacacttcctgtcatttttggataattgtatgcttttgctatatctccattaacatttacagttatttcttctaaattttctgatttacttattatagattctaccaacccaatctttttacttatcataagattaccttcctagtttatcaataaagtttaaaactttattattttctattattttagttaaagaatatttttcagttagcatatgtataaatattaaaaatactaaccatgatattcttataggcatatcatatcccattgatataagtatacctatagatattcctaaaacatttgatccagtatcacccatcatagctctagcttttaaatcatctataaagtatacacatacacttggtaataatataagtagtaatgctttaggatatcctaccaatgttaaaaataaagttatagatataactaaatatacctttatagctcttcctggtcttaaatctaataaattcattaaatttgtagataaggctattattaatgtatttataactatatcagttaaatttttagatatcgctacagatataataagtcctacaaatcctccaaataatgccttaaatccaccagttgtcagatttccttttaataaacttttaaaatgaccttttaatccacttacatccctatttccaacaatatcatctaatatacctgctaagcacattgccattaatccaaacatatacataaatatataagctatattttcataacttttagtaaaatatgctaatataattccatttataactattgtaggtaaaaatactaaccccatacttactggtatcatatcttttttgtaattaggtcttattacatcacttgaaattaacatatttttaaaaaatggtataacgatatatgttactaatatacctgctagtagcattattatatataatatagatgtattcaataacactacctccattctttctttttcttattaactattttttttatgtgataaaattgcttacctctatgtataaatccttttaagtctcttccagtttcactatgagtcatattaactagaacttcttttatagaatatccatgttttaatatatctatagtcatgcctacttcaacaccatatccataaggtatttctttaaatttttctaaaacttctcttttaaatattctctgacctgatattgtagcatctaattcaacacctgtcatttctaaaacggattctttagccaatctttttacaaagcccattcctccttttttcttagcaggtgggaatttagctatagttacatccacttcattatttataacaggttttataagttttatagtttcactagatgaactacctaaatctccatctaaaaaacctattatatttgcatttttcatggctatatcaagtccatagtttaatgcgtatcctttacctctatttttatctaatttaaaaacttttactttatcattgtttactgatttagccatcttttctgtgttatcactagatccatcatctacaactattatttcatttatttcgtctatatttactattcctaaaagtgtatcttttatttttttctcttcattgtatgctggtactattatactaacataaggattcataattaaatctcctttatttttacttaaatggtattatagaatctgcactttctcctctaccaaaattgccttgttccgtagagtctttaagtgtataaactaaagataattttcctaatccttcttctgaattatttatagtaggtatttttgattttttatacatatctatatatgaaaatcctacatcacttttttgagtagctactatgtacttatcttctgattttaatttacttattaagtttttatcaatatcttcaaactttttagaatcttcattgttatttcctgaagctatgactacttgtgaataatctacataattatcagctatagaattaacttttatcatatctaatttttcaagttgttgtagcttctcaatcgcatttgattcttttaaagagtcaattaaataatttattacatctttactagattttaattctaaattttgagaactagaaagttcttttattttatcattattagttataccatcttttaatattatattaaatgatacttgtccacttgcatctgttattgtattagctacatcttgagtataatcataattttctgtagttgaaattattcctatatgtctatctcgaagttcatcttttattaatttggcataattatcatttacatattcaactaacttattatattcatttttattttttgataatttcttttctaaatccttgtttgttgtttttatttcctcaaatttgttatctaaatcacctattatcgaggcttgttgcttgctaagtgcttggtcataatttaagttaaaacctactaacattcctatgcctaatgcaataaatatagcacctatcgtaactatgtaatacttcatatttatatgcatgttaatcctcctcaactaattacatctgtaataataatttaatttttaattccatcaaatgcataaactgctgaacacttggtaaaatcgaagcaagtattattactgggaataatgctgtagctattaacgcccatatatactttaattttaatttgcttctatataataaatttacaccttttgcatctataagtttagaacctatcttaagtctaactaaaaatgtactagccataccaggtcttcctttttctaagaaatctatcatattagaatgagtacctacagctactattagttcagctttatattcataagctgtaagcatagctatatcttcactagttcctggcgcagggaaaactatagcatctaatcctaagtcttgaactcttttaagccccggagctctaccatccgtatatgcatgcacaactatttcttttgtcttttttaaagcctcatcacttacactatccatatctcctactattacatctggagtatatccaaattctaaaagagcatcagccccaccatctacaccgactaatataggcttcatttcttctatgtaagatattattgtgcttaaatcttgcttataatcctggcctcttacaacgattaatacatgtttattcttatagtttgtgtttacctttggtatttcaacttcaccaagtataaatcctttttcttttttagcataatctatagtattatctataaacctatctaattctacagataaattttcatatgctaattttatcttgttatcaacttcatttttatctaatacttccccttggcctaataattcaccatctctatagattttaccatctataacctctatcacttggccttcttgtagattgttgaataactcttctcctacattatctacaataagtatatttttatctacaagtataccaggtcctttatttggatatcttccacttatagactgggctgcatttataacaagttttatctttccttctactaatgaattagcagcaacttcatctatgtctttatgatttataactgctatttctccgccagtaagtcgctttgcaagccttttagtttttctgtctaccttaataggggcttcgactctcatacttaaaacctccacttttcgtttttgaaatcacattacattatagcattattttataacaatttaaataattaaaattggtcaacaaacttatacgtccctaataatgctaattaaatctattttattgttaatttctggattttctataacattttttaataagtagtcaagtttttgtcctatatcttttccagcataccctaaagctcttaaatcacttccatctatggccagtttatctagagaataacactctttatttcgttctatgtcatttatcatttcataaatctcgtcataatcttcattaaaaaattcttttttaagaatttttttaatatataataaataacttaaattttccttaccaatcttatttaaatataattttatgcatactttatcagctattattttgttgtctaaattatctaatataatactacattgttttttaattttatttgaatatctaaatatattgagtatatttttgctttcttcaatatatcctgttatatatgtaaacatagataatcttataattaaatctttttttgatttttttatatattttaattcatttttatttattttcacactattaaaatttaaaacatcaaacattcctgcttgataaagtatatataaattttcaggactatcactaagtagtattttattaaattcattttgtattctttcaatacttacattttttattaaatttatatttttataaatacttgttaatgtatctttttctatatcaaatcctaatttacagctaaatctaacagctcttattattcttaatccatcttcattaaacctctcatcagcttttccaactgtttttattatctttttgcgaatatcacctattccatcaaaggtatcaactataccaattctatggttatatgctatagcatttattgtgaaatctcttctttgtaaatctttatttatgtcatttgtaaattctacaaaatctggtcttctattatcattatattctccatctatcctgtacgttgtaatttcatactcaataccattttttattaaagtaacagttccatgtttaattccagtttcaattattttttcatttttaaatatattcataatttcgtttggttttgcactagtagttatatcgtaatcattaggttttaatcctattatagaatctcttacacaccctccaacaataaaggcctcatacccattatcatatattttattaattatgtattctacatcttttggtatttgtaatttcatattctcacctctactaaattaactattatatattttatacatttagataaaaaaataaagcctccattttattgaagactttattttatctattacttaaccatactgtgttctaatcttaatttgtcagctatcatagctataaactctgaattagttggctttcctttagtattgtgtactgtatatccaaataattgatttatagtatcaactttacctctgctccaagcaacttctatagcgtgtcttatagctctttcaactctacttggtgtagtgttaaacttcttagctatacttgggtataactcttttgtaacagctcctaataattctacattatctataaccatctttatagcttctcttaaatataagtaaccctttatatgtgctggaacccctatttcatgtattatattagtaatttcagtttctatgttgcctacattttttacaaaatcagtcttagtcatttttatatccatattccccctagatttagactctacaactgtatttttatttgaaactaaacctcttattctatttataaatattacaaaatcaaaaggtttaactatataataatctgctcctaaattaattgcgctttgagttattttatcttgacctactgcagataaaactatgatcttaggcattttgtctaagttcatagaatttaatttttctattacccctaatccatcaagatgtggcattataacatctaaaactaatacatctggttgtgttctagaaactaaatctaatgcttcaatcccatcttttgcaatccctaatatttctatatcatcttcattagataaatactcttttaatacttgacaaaagtccctattatcatcagctaaaactatctttattttttcgttcattatttttccccccatagaatttataatttattaaaaatattatctttatttttcactaattaacttattcgacatttaatatttataatccttctacttattttatttttatacatataattatattatcatcttatctataaaaattccatatcctattttagagttatctagaaaaacatgtgttagtgcaccgattattttattattttgtattataggtgctccactcataccctggattattcctccagtataatctattagtctatcatctactatctcaactatcatatccttaccatattttctgtctttattatttattttttttattactaccttatattcttctattattccatctttattttgaaataatatactagctggaccagctctcacatcctttttatcacttacttctaatattttatgttttccaccattatcatatgtcgttaattttccatttataccaaaatcatcattattattaaaattacctatagatttatcaacattaaaattagcctttatttgcccaacacatccatcatctccctttataatttctatatctttagcattatatatgtttccgtttttaacctttatcaactcattagtatctatatcttttatcgcatgtcctatagctgaaaacgtattatcttcaggattgtaaaatgtcatagtacctattccagaaattttatctctaatccataatcctaatttatattcatttccatttttttttaacttaacctctttttgtatgtaatcgccatctctatctactaaaacatctacgaaatctttattacagtgatttataattttttttacatccttgctgctgtacacccgttttccttctatactaacaatgttgtcacctgattttattccatctatataatcttcctcattttccaaaaccaatattccatctgtgttagctcttatacctacaatattacctaatggaattaaatgcttaacttcttttttttcactactatttactcttgctatccctaatataaacatagatatagttataattgataataaataaaattttttcattttctattccatgtcccttctaatatattcatatacatatagtttcaatttttctatttttttatccatcacaaatataaaataaaaaaggtacctaattaggtacctttttagcaagctctattatttcactagcatgttccattgttttttcagttatattacttccagctataagtctagctatttcattttttcgttcttcatcatttaatctacttattacagtaaatgttctatctgtagaggtctttttctctatacaataatgagtgtctgcattagcagcaatttgaggaagatgagttatacaaagtatttgctttttcttagctataaccgataatttttctcctacaatttgtgctgctattccacttatacctgtatctatttcatcaaataccaaagtgtctatctcatctatatcagctagtatagttttaaaagctaacataaatcttgacatttctcctccagaagctactttgtatataggcttaatgtcttctcctaagttaaaagaaatcataaattctatatcatcttgaccttttaaattaaaattacttttattaaaagcaacttcaaatactatatttttcatatttaaacttttaagttcatatagtaatttttcttggaggtccttagctacatcttttcttttttcagttagtttgtctgccttagattttaatactacttctatatcctgaagttttgattttaatttttcaaccttttcatctctattaagtatttcatctaatctagtagaaattttatttttgtacattaaaatttcatctatagtatctccatactttcttcttaatgtgtttatttcatctactctttgttctatttgatctaattcatatggagaaaaatctatactgtctttataacttctaatatctctagatatatcttgaagttcatacattattctttctattgtttcattatattcatttaatctatcatcatactttgctatagaacttaaatctcctagtgatttagatataagatctacagaatttatacttccatcgtataaatttgagtatgcattatttaagtttgtatatattttttcacttgtactattttttagtatatcaattattttagcttgtcttttacttaaaatatattccaaaattatcaacccttatctaaattgtttataatttttattttactatatacattgttattctttcaattattaaagcctttaagttaaatttattaaaatattacaaatttttaagttttaaattttaatatttaatggtatactcattaaatattaatcaaaccaaaaatttaaaggaggatacatgaaaaaatatttagatgaattttcaaaatccataagatatataattcctgttgtagtgttttttataggatttattatctatcaaaatttcaataatatattgaaatttattacaactaatgtccaaataatttctggggttttaactccatttgttattggttttttaattgcttacatacttaataaacctatggtttatcttcaaaaaaagtttaaacttggtcgtggtgttagtgtagcaataatttatggaatattattggctatgttagtttttgtatggatatatatagttccaattattcaaaaaaatatagcagatttatattcatttatgcctcatgatatgaaagaagttgaaagtataattaattctacactttcaaaatttaaaataaatgtaaaaaatcctacttctgctttacaagtaaaagattttatgtcaaattcagtaatcccaacagttacatctattgcaggactacttagtcaaacacttttagagttgataggtttaatagtaacttatactgtaaatatattcttaggaatagtaatttctatatatttattattatctaaggaaaaaagcattaaaatagctgatgatttatgtgaatgtatttttggtaagttttacttaaaatcaaaagaattcggtagaattcttgataagaatataggttcttatataattgccaagtttttagattctttaatttatggtactgtttgtactataatacttgttttattaaattctcattatccagtatttgtggggataatagttggtataacaaatatgattccattctttgggccaattataggtactatagttgcaacttttataaatctattcttctcttttgaaaaagcggttatagttttaattgttatgattgtcgttcaacaattagaaagtgcaatacttgaacctcattttgttggaaaacaagttggagtaccacctatacttacaatacttgcagtaacacttgcaggacaatatacaggttttcttggaatgatgttatctgttcctattatgggagttgttataatctatgttaatagatttatcgaaaagaaaaaatcaaatattatacaatctgaaaaataaataaattaaaaagagcctttatataaggctcttttttaatttaatccctttataagcaacttgtatgctctatcttttgcatcttcaattatttttttgtcttcatttttaatacatattgtatgcccaaatccaacaactacactttcaaataccataatctgataatctttatcttcttgttcttttatgatattttctgaaactccaattaataataattcgtttataactttttttaataaatcatatcttttattaatataatctttatttttttctaatatttccttaaattcataatgacttaaattagaaaatagtatattgctaaaagaactataatctgttgtacttttttcaactatatccaatataatataaaatttatctttaaagttatctccaaattttattttttctatgttttcataaagctctatatccatattataaagaaaggctttttctaaaatttcttctttagatttaaagtaatcataaatagttccttttccaattccagcctcttttgcaatatcagctacttttactgtgtggagcttaattccttcatgtaaaagtttatttactgcattaaaaattaatatttctttttcagagtgagtgttatttgccactacatctcctcctcatcaattatgtttggttttaattcttttttattaagtatatcatacatagcaggaactacaaataatgttaaaactgttgcatagctaagtcctccgattgtaactattgccattggctgaatcatatcagctcctgtacctattcccattgctaaagttaaaagcccaagtattgttgtaagtgctgtcataagtattggtcttattcttgtttttccagctaatattaatgcactttttttgtcaacaccattaagtcttaactggttaacatagtcaataaagactataccattattaacaactactcctgcaagcattaaaaatcctagcattgatatcatacttagttcaaagtttgttattaaaagacctaaaaatcctcctgtaaatgcaagtggaattgtaaataatactataaatggtgataacaatgactgaaattgtgcaaccattattaagtaaataaatactattgccagagaaatcatttttattaaatcaccaaaagcactatccatagattctttttctccacccatttctatgctatatccatcaggtaatttataatcttttaatttagattcaatttctttacttacaagccctatattatgcttatcatctattgatgatgttactgaaatatttcttacttggttttcacgatttattgagttaagactttctacttcttcaatacttgctatatcacttaacttaacttctacttctttattatctttagttccttttattttataatttgttaagctttctctacttaatgtatcttttttatcatctactacaattactggatattcatttgaaccaacatttaatgtagttgaagtattttcattttttaatttgtttgatacttcttgataaacttgtgcaactgttaaagagtaattcatagctttttgtttatcaactatgatttttgtttctttattgttttctcctagaccattatttacttcagttgtgccttctattttttctaatattttagctacatctttagctatattttttaatttatctaagttatctccttttactattacatttattcccgaaccacctaatgctgacatatccatatttgaggaattaacttttatttttgcatttaaatcttttgttttttcagttattatatttgcaacttctttacttgataatttcttatcttcttttaacaatacataaaaagatacattgtttttgccttgactaaacataaagctttctccactactttgaagtgctcctacagtttctacatcttttatttctgtaattttatcaattatggtttcactcatatctcttgtatctttttttgttgatttttttggcatttctaaacttacagatagctgtgtactatcaatttcaggcattaatatagttcctttagatataattaaaaatccacttcctaaaaataatactaatgacccaaataatactataaacttatgtttaagacttactttaagtaatttttcatataaattaacgaatttatcaaataatttatgttcttttttagtgtttacattaagcatttttgatgacattgctggaactaatgtaagtgctactattaaacttgccagtaatgagtaggcaatagtaagtcccatatcctcaaacaattgacgagatagtccatgtgtaaatactattggtaaaaatacacatactgttgtaagtgtagatgcaaatattgctcctgcaacttggtttgcacctattactgatgcttttttagcactcattccttcatttcttagtctatatatattttcaataacaactatactgttatcaaccaacattccaactcctaatgctagtcctgataaagatataatattcattgttacattactaaaatacatcatagtaattgcaaataaaacacttataggtatactaaatgctattactatagttggtttaatactttttaagaatacaaataatataactattgaaagtattccacctaatataagattacttaaaaccgattgtataactatatcaatataaacaccttgatcttgtaaaggcgttatatgcatatctttattttgattagtcagttcttttatagtttcatttattttctttgaaacttctgatgttgatgctgtactttgtttttggaaagataatattattccatcatttccatttatttttgcatacattttatctttattatttgcaagttcaacatttgctacatcttcaacttttacttttcctaatccatcaatattaagtagttctaagtcttttaaatcttctatactacttactttatcacctattttaactatgtattgttcttcaccttcatttatgtaacctgctggcatagcaaagttttgagcagataaaattttacttaaattttcttttgttatgtttttacctaaatctgcatttttataagcttcttcttttgctttttcaagttctttagatgatttttcaatttcagcttcactacttgaaagtgattgtgatgctttgtttagttctgaatttagtgtagcttttccagcttctaattgtttttctttatcatttaattcttttaattggttatttaaagatgactcctgattattaatttcactaagcttttcatcaaaagttttaataccagattcaagtaaagttaaaccttctttttgctcatcacttactggtatattgttttcttcttgatttttaatcatttgttctagttcatcttttttgtttaataattcacttttttgattttctaattcattttttccacttgataattgactaattgcgctttgaagttgtgattttcctgtttttatagcactacttccttcattaatttctttacttttttcttcactttgctttttaagctcagcttttccttttgctatttcagcttttgctttgtttaattcatcttgtgaagatttcatttttgaatcaatagaactttttaacttattattaagtttttcaatcttactatcatctaaagtcatttttatgctttcttctaatattcccattgtatcaactgaagctactccatcaattctttcaaaacttggaattacttctttttttactattttagatgtttcttttatgtctttgttattaatatcgatactagctaccattataggcatcatatttggattcattttcataagtgttggtgtagatacttcatcggctaattgaccttttactaagtctacttttccacttaaatcaatcattgcactgtccatattcatgtcttgactaaattcaagcataatcatacttgagttttcacttgatacactattaatattttcaatcccattagatgttgctaaaaccttttccaaaggtttagtaacagattcttctactttttctggacttgctcctggatatgttgtcattactataacgtaaggcaagtctatttttggaagtaaatctgttgtcatttctgtaaaggatactccccctaaaataattactagtattaccgatacaaaaactgtaaatggcctttttacactaaattttgaaaacatatataattctccccatatttataatgaccgaccagtcggtcggcaatttaaagtgtagcatttacaactacttttcgcaatatttttaactttttattttaaaataaaaaagcaaaaactaattaatataattttataacaaattaaaagtaggtgtgaacctaatcacacctacttttgatttatctattagtatggaatgttctatttataatgtctaattgttgctctcttgtaagttttgtaaagtgtactgcataaccagaaactcttattgttaatcgaggatattcttctggtctttccattgcatcttcaagcatagctctatcaaatacgtttacatttaagtgatgtgctccttgtccaaaatatccatctaacattgcagttaggttgaaaactctttcttgtgcatcctttcctaaagctgctggaattatagagaaagtattagatattccgtcttgagaatactcataaggcaatttagcaacagatgataatgaagccaatgcaccactaatatctcttccatgcatagggttagctcctggtgcaaatggctctcctgcttttctaccatcaggagtatttccagttttctttccataaacaacattagaagtaattgttagtattgattgagtaggatatgaatttctataagtcttattttgttttaatttattcataaagtttttcactaaatctatagctatatcatctactctatcatcattattaccatacttagggtaatctccttctacttcaaaatctacagcaataccttgctcatttcttattggcttaacttttgcatatttaattgctgatagagagtcaacacatacagataaccctgctattccacaagccatagttctaaatacatctctatcgtgtaatgccatttgtaaagcttcatatgaatatttatcatgcatatagtgaattacattaagagtgtttatatataaattagctaaccaatcagtaaacaagtcaaacttttcaattacttcttcataatctagatactctgaagttatcggttcaaatttaggtcctacttgagtacctaatttttcatcaactccaccatttattgaataaagaagtgttttcgctaagttcactctagctccaaagaattgcatttgctttcctattctcatggcagaaacacaacatgctattccataatcgtcaccccaatatggtctcataagatcgtcattttcatattgtatagagcttgtatctattgaaactttagcacagaaatctttaaatccttttggtaaagaatttgaccataaaacagttaagtttggctctggagatggtcctagagtatataatgtgtgtaaaactctaaaagagttttttgtaactaatgttctaccatctattcccatacctcctattgattctgttacccatgttgggtcacctgaaaataaatcattgtactctggagttctaagaaacttaaccattcttagcttcattacaaaatgatccattaattcttgaacttcttcttctgttatttcaccattttttaaatctctctcaaaatatatatctaagaatgtactagttctacctaaactcattgccgctccattttggtcttttatagctcctagataagcaaaatataacgactgaactgcttctctagagttctttgcaggtttagatatatcaaatccataactttcagccattgtttttaaagcttctaatgcttttatttgatctgaaatttcttctcttaatcttatagtgtcctcatctattacatttacatctaaactatttttttgacaaattttatcttcaattaatctatcaactccatataatgcaactcttctataatctcctattattctacctcttccgtatgcatctggtaatccagttataatacctgatcttcttgctgctctcatttcatcagtataggcatcaaatacaccttgattatgtgtttttctatatttagtaaaaatttcttttacatctttatctaactcaaagccataagccttacaagatgattctaccattcttattccaccataaggcattatagctctttttaaaggttcatcagtttgaaatcctacaacaacctctttttctttatccatatagcctggtttataagcatctattgctgatacagttttcgtatctacgtctaaagttcctccattgtctctttccttcttaaataaatccatcatctcatctattaatgagtttgtgttttctgttgctttagctaaaaaagaatcatcgccttcatatggagtatagtttaattgtataaagcttctaacatctatttccttactccatttaccttctttaaagtttttccaagctgtattgttcatttagttacctcctatatagatttcatatatcttataaactcatttactttattacttaccgttataatagaatttatactgtacatatttgttttggaataatttgattgttttatcctgtcaattattaatataattggtcgtttttaaccaactttttaaatacaaattttcataatttattttgtttttaaaaataaataaagcaaggtattttccattaatatttgaaaaataccttgctttaatttatattttaatctaacaatactaacttaattgatgactttcttcttttaattttttaactttcattgaaaataatatagtaaataatattgctactaatactcctataatatttgatattcctgcatgtaatctaaatccttctggtgcttgcattatatatgaaactgttacagctgtcataaatattgcaggtactgtacttataaagtgatttttgttttcttttgctaagtatgctgaccctgtccataacattatcattgctaatgtttgattagcccaagagaagtatctccatattatattaaaatctataaatgttaatgcaacaccaactataaatagtggtatagatatcataaatctattttttatactactttgatctatcttcatagcatctgctattgtaagtcttgcacttctaaatgctgtatctccacttgttataggacaaactacaactccaagtactgcaaggaatccacctattggtcccattaaagtattagatattgtatttactactgttgcaggtcctcctgctgataaaataacatcaagttgtggtactccaccaaagaatgccatagctgctgctgcccatattaaagctatgattccttctgcaaccattgaaccataaaatactcttctagtttcactttctttttcaacacatctagccatcataggtgattgtgtagcatggaatcctgatattgctccacatgctattgttataaataagaatgggaacagtggttgaccttctggatgtagattttgaagagttatatctggtatatgataaccttggaaaataagtcctcctgcaacccctactgccattattaaaagtgctgctccaaataatggatatattttacctataactgtatctactggtaaaactgttgctgctatataataaattactattattgcaacccaaacttttgcatctaatgatgttaatgttgtaagtagtgctgctggacctgtcataaatacagtaccaactaatactaaaagtacaacagtaaatactctcattactgtttttgttgaatttcctaaatatctaccaactaattctgatgctgaatcccctttgtttttcattgataaatatcctgataagaagtcatgaactcctcctgcaaagatacatccaaatactatccataaaaatgctgctggtccaaatagtgctccttgtatagcaccaaatattggtccaagtcctgctatgtttagaaattgtattagaaatatctttctccatttcattggaacatagtctacaccatcttccatagtaatagctggagtttgtatttcatcgtttattccaaacgttttttctacaaacttaccataagtataatacccaattataagtaatgctattgaccctaagaaacttaccatatcagtctcactccctttaattaaatatagatgattactttttatattattctttctactttaataatagaccttatcgacatttttttgtttcttattgaactaaatgtatatatttatgaataaaatgcataaattcatacatcaaatgcatttttattaatttaattaaaaaagaaactatcattttttagatagttcctttttaatattactatacttcttttgctatggattttgatataaacttagaattaattatattttcttttaattcaataacatctactaatatcaacttactaagtttatcttctaatttatcaaaataatttttaatatcttataaaggctagaaatgaaatttataatatatatgaagatataaaaattaattataaaatatatattttatttatgtaaatttagtacattttttattataatccattagaatgggtattaaataatatataaaaaaatattataaaatttttaaaaaaagaagctatctctaaaccgtagtgttgaggcagtttcttttatatttttgggctaaaaggtaaaaaattgaaaaatttatcagcttgaatatataccatatatggtatagaatgtactatgtgattactacatatggtataaaaatttattgttatgtacaatattaaattataaaagtcaatacttttgtagaataaaatttaatcaatcaagatgtattagacaaaaggagagttttatgaaaaaacaactaaatattatcaaaagggatggaagtattgtagaatttcaaaaggttaaaatagaaaatgcaatacttaaagcaatgaaatatggaagtgggatatatgaagaagaaatagctaaagaaatagctagtgaaatagaaaacaaatgtattgaagaactactttcaccaactgtttatcaagttgaggacatggtttataaaaatttaatagaacataagcatgaattaacagctaaagcttacgaagggtatagagctgtacaatcttttaaaagagaaaataatactacggatgaaagtatattaggtcttttagataatagtaatgaagatgttataaatgaaaattcaaataagaatggattattagcatctacacaaagagatttaattgctggagaagtatcaaaagatattgctagaagaaaattaattccagctcatatagcgcatgcgcatgacgaaggagtattacattatcatgatatggattatgcaatacaacctattcataactgtatgcttataaatttagaagatatgttaaacaacggaactgtaataagtaataaattagtagaatcgcctaaatcatttactacagcatgcacagttactactcaaataatagctcaaatagctagtgggcaatatggtgggaactctataactataaaacatatagcaccatttttaagagtatcatacgataagtactataataaatatataaaaaaatattcagaagaaatagctaaagaattagcagaagatagaatgatggaagagttaaaaagcggaatacaaactataagatatcaactatctacgttatacacaagtaatggtcaatctccattttcaactatatacctagaaattgaagaaggtaatgaatatgaaagggagatggctttaatatgcgaagaaatgatacttcaaagattagaaggaatgaaaaactataaaggacaagaagtaggagaagaattccctaaattagtttatttattagatgaacacaactgcttagaaggtggaaaatatgattatatcactaagttagcagctaagtgtaataccaagagattagttccagattatcaaagtgctaaattaatgagaaaaaattatgaaggaaatacattccctccaatgggttgtagaagtcatttatctccatggaaagatgaaaatggaaattataaatggtatggaagatttaatcaaggagttatatctcttaacttagttcaagtagcattaacagcgaataaagatatggataagttttgggagatcctagatgaaagattagaactttgtagagaagctttaatggttagacataacttattaaagggtgtaatatcagatgtttcacctatacattggcaacatggaggaattgcaagacttaagaaaggagaaaaaatagatcatttactagaaaatggctattcaactctttctttaggttatgttggtgtttatgaaatgacacaagcaatgttaggggtaagccatacaacaaaagagggagaacaatttgcacttaaagttatgcatcatttaaatgatgcatgtcaaaagtggaaagaagaaacaggtcttggatttggattatatggaactcctggtgaaagtttaacttcaagattttgtagaatagacaagcaaaagtttggagaaataaaaaatgtaacggatagaatgtattatactaactcatatcatgttcatgtaagcgaagaaatagatgctttttcaaaacttaaatttgaaagtcaattccatgatataagtttaggtggatgtataagttatatagaagttccagatatgagcaaaaacttacaagctgtagaacaaataataaactatatatatcataatatacaatatgctgaaataaacacaaaaccagatatttgttatacttgtggatttacaggtgagataaaactagacaaagatttagaatggtattgtcctaactgtggaaatagagataaaaatgagatgcaagtcatgagaagaacttgtggatatataggagcaaatatgtggggtaaaggccgtactcaagaaataggagaaagagtattacatctataggtttggagtgataagtatgagattttctaagataaaagataatgatatagccaatggattaggtataacaatgtctttttggactcaaggatgtccacatcattgtaaaggatgttttaataaagaaacttggaattttgaagatggagaggaatttacacaagaagatctaaaatatattatagaaagtattaataaaaataatataaaacgagatttatctatattaggtggagaaccattatgtcctgaaaatgttgaaggagtaataactttatgtaaagaatttaaacgtcattatccagaaaaacttatatacttatggacaggctatactatagaaaattttgatgatattcaaaaagaaattttaaattatatagatatattaatagatggtaagtttgaagaagatagaaaaaacttatctataaaattaagaggttcatctaatcaaagagttatagatgtaaaaagatatctagaagatgatgctgtgatattatataaattaagttaattataaaaataaaagctaatcaaatactttaataagtgtaagattagcttttattataaaatttatatgaaaatgatatttattttcatttacaaaataaaattactatgttatacttatttcagatggagaaattgcttagtttctctacgaattgatgaagcactaaaattctaaaattcagcacgcaaataatattttaaagtaaaatgtccgttacttaaagtataaaacatttagaatttttattgccaaattatttacactcataatttaatctaaaaaattaataaaaatttttaaaaaaggtcacaaaattatttgtgaccttttttgatgataatgaaattcatttacaaaaaacaaaatttatgatatattatatacaggcttaaaattatcgcggcaaatttctgattttataggagatgataattatggcaaaaatgatgggacctagatttaaacaatgtagaagactaggactaaacgtatgtggacatccaaaagcgatggatagagcagttagaggtacttctagagctgacaaaaaactttcaccttatggactacaattacttgagaaacaaagattaagagcttattacggagtattagaaaaacaattttcaaattacgtaaaaaaagctatgaaatctgatgaagctacaggtactgtattagttcaattactagaatgtagattagataacttagtttatagattaggattagctagttctataagacaagctcgtcaaatggttgttcatggacacattttagtaaatggaaaaaaagttgatagaccttcttatggagtttcagtaggagaggttatatctttaagagaaaaatctcaaaagaactctatgtttaaagctagtttcgaacaaaatgctactagccaatacccatacttaagtaaagatatagagaatttctcaggtactcttactaaaatacctgaaagaaatgaagttccaatagagataaatgatattttagttgtagaattttattctaagcttaagtaattataatataaatataaactcaattagtctatatttatatttaaagtgtagacaagaaattgtctacacttttttatattatattaaaaaattcataaattaataatgataaaaaggaaatatattaaattatattctttttttattttgttaaaaataaatacaaggtaaattgtaaaaaggtaataatattattataacctagttacaaataagtaactaattgttatagatataaaatattgatatattaaatttacaaaaataagtaaactaaggagaaaaaataatgagcagaataataaatacagaagaatttgtaaatgaagtagaaaattcaaaagaaacaacagtggtagacttttttgcaacttggtgtggaccatgcaaaatgctatctccagttttcgaagaactaggtaaagatatggaagataatgcaaagtttttaaaggtagatatagatcaaagtttagagttagctagaaaatttgaagtaagtactgttcctacagttatagttttcaaagatggaaaagaagctgaaagattagtaggatttataccgaagcaaaagttagaagatatggtaaaggcacatatataaacctagaaaggaatgacgaaatatgaggtatgatattgctatagttggtgatgggcctgcaggtttagcagcttcaataaatgctaaaataagaaacaaaaatataatactatttggaagcggaagtgataaacttgctaaagcaccatctatagataattatttaggtatttatgatgtaagtggagcacaattaaaagataaatttatacatcatataactgaaatgggtatagaaataacctatgaaagagtaaataatgtttatagcatgggtgattattttgctttagcagttggagataaaacctatgaagcaacaactgttattatggctacaggtgtacaatatggcaagatgataaaaggggaagaagaatatctaggaaaaggtgtagggtattgtgctacatgtgatgcaggattatatagagataaaatcgttgcgataataggttataatcatgaaggtgaagaagatgcaaatttcttaagtgaaatagcatcaaaggtgtactatataccaatgtacaatttagataataagttagattcttctatagaaataataaatgataaacctgtagaaatacaaggagaaaaattagttaacaaactaattttaaaagaaagagaactggatgtagatggagtattcattatgaaagatagcgtttcaccaagctatatggttccaggattagaggttgaaggaccacatataaaaactgatagagaaatgagaacaaatatagatggattatatgcagcaggagactgtgcaggtaagccgtatcaataccttaagtcagctggacaaggtcaaatggcagtatctagtgctatatctcaattagataaattgagaataaataaaatgaaatcaaagaaataataataaaaaaataatcctataaagtgaggttaaagtaaaacttactttaaggggttatttttttgttattaagtattgaaaaaaactatagttaaatatttgtatataaaattcataataatcaaaattggacaaaataatttcgatattataatctagtatataaactataaatagtatattaacgttacaaactcaggaggatagatttgtgcataatgtgagtaatatgacgtgtaattgtccaatagaaaaattatttaatatattaggaaaaaaatgggtagctaaaatagtgtggtcaataaatgataagaagataagatttggagaactccaaagaagtatagatggatgtagtaagaagatgttgattcaacaattagatttattgatagaacataagcttgttataaatgagaaaaaattaataaacaataacatagaatcaacttactatttaagtaaatcaggattaatgttattaaatgttatgacaaaaatgatagattggagtaaagaaaatgctatatacactgaagattaaatggagttaccaaaaagtgactagttgatatgcatataattgcttgttatattatataaacaagcaaagcctttaactttgcaaaaagtataaggaggaagacatgaattacacatttttttcagaatttattatgataacaaactggttgacagtgttatcaataggaatcttagtagggctattctttatagtcaacaagctaagcaaaaagttaaattttactaaattgatgattttatcaatagtaatgggaattggattaggactaataattcaatatatagtaggattcccaagtgatcctacaaaagtaacttggctaacagaagtatctaagtggtatggactatttggatatggatttatggatcttttaaaaatgctagtagtaccactagtatttgtatcaattgtaagagtaataatgaatttaaaagatggtgagaacttaggaaagttaaccgttagaacagtaataatgttacttggtactacagctatagctgcaacagtagctataatagttgggaacttgtttaaattaggtgtaggacaagaagttttaaaccatactgacaagatgagagaggtaactcctatagttgatactctaagaggattactaccatcaaatccagtagatgctatggctaaagctaatgtagttgctatagttatatttgctacatttataggaatagcaataaaaagacttagtaaaaaacatgctgatacaattaagccatttgtggatttaattgaagcattttataaaataataataagtgtatctataacagttataaaattaatgccttatgcagtagttgcgttgatggcgacatctataatagatagaggtatatcttcaatattaggtgttttagattttatattagcattatatataagtgtagctataatgtttgttatacatttaataataatatcaataaatggtataaatccaataaaatatttaaagaatgtatctaaacctcttatattagcatttacatcaagatcaagtttaggtactttaccagttactatagaagcacttacagataatttaaaagtagaacaaggaatagcaagttttgttggtagcttaggtgccaacatgggaatgaatggatgtgcaggtatatatccagcattaatggcagtaactgtagccaatatgtcaggaactacaatgaattttagcttttatgtaatgttattaatagtaataactataagttctttaggtatagctggtatacctgggacagctacaatgtcagtttcagtagttatatcaggtatgggaatgggagcatactttcctttattgggaggtatacttgcaatagatcctatattagatatggggcgtactatgcttaatgtaaatggaagtatggcttcaactatagcagttgcaaattcttttaatgagatagataaagatgctatagagtaatttataaaaatagactagaataattattctagtctattttcatgtaaatatgtaaatttaaaaaatggtatttaaataaatttaaatatcatttttcaaacacttattagaaaaatacaatatagcgagacctgctattgctgtaacagatgatattactatatccatatcaactgaatatttaaatacataagaacatgcattatctagtgcatgaaataatatgcataaccaaatgctattagtttgagtatatataaaggtcaaaacaaatgatgatgctaaacaacttaaagcaaatggtatgaagttcaaatgttgttgtggtgaaccaactataaaccataaaggcaaatgccaaactgaccaaattatacttatgattaatgaactttttatagaagaatatttaagcaatagttttggaagtaaaaatcctctccatcctatctcctctagtccaccacctaaaatcataataggagttagccaacttaaaaatattaatgaatagtttaaaagtatatacttatcacgaaaaaaatttacgacgatatatggtatagtccaaaggattaaagctgtgaatataacatataaatattctctaaaactttttttgatatttatacagcttaaaatgaattttttaaaatctgattttgaacaaaacttctttttaactaacaagccagcaatcgcaggagaatatccagataagccgtaaaatatcataaatataggagatccgtactttagtacgtgtaattgagtacacggtatagtgatactaaaagatatagtacaaatgattattattattgaaaaaaagtatttagtttctttggatataatcattttagtaacctccaaatttatataaatgtataaattatattgtaataataccaatatatatagtacaatacaatgtcaaatgaatttgtttaaatttaaaaaacattaaaaatatatttacatatatattaaaaatatatccttcatattattaacaaatagtttaatagatattacagtgtttatatatgaaaagcatataaatagcctcaaaaatatatattaaatttttaattatatatttttaatagaaaagatatgataagaattgatagtgaagatataaaaatgcctagaatatattctaggcatttttattaaaaactattaagtaagaaaaatatggtttagtacagctagtataaatgaacaagacagtattatagatacaacaataatatgacgttttttgttcattactactatagctatatattctcttattaacgcattaggaatgaaatataaagcagttttgcaagctaagccctgactttttaaacctgccattttagcataaagaccagccctaaataaatgataattattagtgacaaaaatgctattgtatccattaggcattaagttatccattatattcttagaaaatttcatgttttgcaaagtattagttgaattatcttcagcaatggtatcttcagcaggtattcctttttttattgcataattctgcatagctatagattcggcaatttcttcatctggacctttacccccagaaaatataatttttggagggttactaactttagattgtttgttataaaattcaattgctttatctattctgttagcaagtagtggaggaaccctatcgcctattactctgcttccaagtactattatgaaatcttgatttgtttttggcttactaaatgtatacaagaaagaaatcattaagaaattaaaaatgctaaatacataataaatttcaattaaagcaaacccttgtaagaatacatttacatcacttgaaaagaatcttgaaggagaaactatagtccaaattacatgtatgacaagagctaaacctaaaaacaaagttaataaattagataaacttttgctttctcttttcataacaattcttgcatttataaataaaacaataataagtacgtagattccaaataccaaaattatcaaaaatagtacaaaagtcaatgataaaaagattagtaaaattatatttcctgtagatatagcaatataagctatatctaaaatagctacgaatataactatattaaataataaaccatttataagtcttcttttatcgcttatataagaaattataaacacagaaaaactaagtatggttaaaattaaaaaaaataaatacatattacacctctaaatattttatatttataaataatgattttaaattatgtcatatttattgtcatatttattgtcatattcattatagtattccatggataataacctctcctattttattatttttatagtaaaattaagaagtgtgctaaacttaatttagtttctatcttgaaaattactataatactatatatggagaaacgtatataaatgtgatgctttataaaaaaaatatataaaagataataatatagatataaatataagtacttaaatatgatataatatgtagaacatagaggaggaagagcgtatgaatatagagaaaaataaattaactcctatgatgaggcaatattttgaagttaaagatagatataaagattgtataatgttttttagacttggagatttttatgaaatgttttttgaagatgcaatagtagcttcaaagactttagaaatagctctaacaggaagagaatgtggtatgagtgagagagcacctatgtgtggagtaccatttcattcatctcaaaactatatatcaaggttagttgaaaatggatataaagtagctatctgtgaacaagttgaagatgtaagtgcatcaaagggaatagtcaaaagagatgttgtaagagttataacaccagggactgtacttgaagggaatttactagaaaataaaaaaaataactacttattagcgatgtatactaaaaatgacaaaataggaatttcttatactgatataagtactggagaagttaactcaacttacttaaatgaagataaattagtagaagaaatagctaaaatacatccaacagagataatagctaatgatgttaatacaatagaacaaataagaaatatagctagtttaagtaatatatatataaatgaaaactttgatgaaagttacctaaatgaaaatatattaggtaagtattttaataaagaatacttagaaaaattaaatatggatgaatatggacttataagttcaagtttatgtataatcctaaattatatatataacactcaaaagcaagtaacatctaatataaacaatataaatatatataactcacaagaatacatgatattagatatgttcactagaaataatctagagttaacttcaactataagaggtaatgctaaaaagggttcattacttcatgttctagataaaacttctacagctatgggtggtagaatgcttagaaagtatgtagaagagccattagtaaataaagtgaaaatagaaaaaagacttaatgtaatagaagaattaaaagaagattttatgttaagagaagatttaatagatgtattaaaaaatgtatatgatatagaaagaatatgtggaaaaatagcatttgaaaaagttactcctaaggaaatgatacatttaaaaaattctgtagaaaaacttccaatgcttaaaaatataataaattcatcaaatgcagatatacttaaaaagtatatatcaaatatggatgatttaaatgatatatattctttaatagatagtgccatacttgaagacccatctataactataaaagatgggaatataataaaatctgaatttaatgatgaactaaatgatttaagagatatctctaaaaatggagcctttatgataaaggaaattgaaaatagagaaaaagaaaaaacaggagttaaatcattaaaggtaggatttaacaaagtatttggttattatatagaaataactaaagctaatttagctagtgcaaatatagatgatagttatataagaaaacaaacgttaagtaatgcagaaagatatataactagtgaattaaaagaaatagaagataaaattttaaatgctgaagaaaaaataaaaagcttagagtatgagatatttgtaaatataagaaataatatatacgaaaatatagatagaatacaatcagtagcaaaaactatagctaatatagatgtatttgtttcattagctactgttgcttatataaataattatgtaaaacctataataaatgaagataataaacttgatataaaaaatggtcgtcatcctgtggttgaaagcattgtaggagaagaaaacttcgttccaaatgacacatatttaaatcaaggtgaaaatattataaatataataacaggtccaaatatggcagggaaatctacttatatgagacaaactgcagttatagctttgatggctcatattggttcatttgttccagcagagtatgcaaatattccaatattagatagaatatttactagagttggagctagtgatgatttatctcagggtcaatctacatttatggttgagatgacagaagtttctcagatacttaaaaatgcaacagataaaagtttagtaatccttgatgaaatcggtcgtggaactagtacttatgatggtataagtttagcttggtctatagttgaatatatacaaaaaaatattaaatgtaaaactttatttgcaacacactatcatgaattagtagaacttgaagatgaatttagtgatgttaaaaattattcagttgcagtgtgtgaaaataatgatggaatagtatttttaagaaaaattatagaaggtggagcggataaaagttacggtatatatgttgcagaacttgctaagttaccacaagaagttataaaaaggtcaaaagaaatactaatagatttagagaaaaatcatatacaaaataatttaaaagaaagtagtaacgataaagatttatcaaatagtacaaatttaaacgtatctgtaaataacaacgaatttaaatcagatgttatagataaagaattatatgatagtttaaaattagaatatgataatttaaaagataaaataaatcaaaaagaagaaaaatatattttagatattgaaaaactagaaagtgaagtaaataaacttaaaaaagaaaattctaacacagatgaagttgctataacacaaatatcatttgacacaatttatgataatgatttaattaatgatattaaaaatttagatattttaaatatgacaccattagatgctatgaatgctttatataatttacaaagtaaagctaaaaaaattaagtaaatttataaataataaggattatagctaactatagtccttattataattttaaaaattaaataaaagtaaatttcaatataaagtgaggtgaatatatggctagaattaatatattagacgaagctactataaatcaattacaagctggggaggttgtagaaagaccttcttctgttgttaaagaacttgtagaaaattcagtagatgcaggtagcaaaaaaataatagttgagattgaagatggtggtaagaaatttattagaataaccgacaatggtagtgggatagattctagtgaagttgaaaaaagttttttaagacatgctacaagtaaaattaataaaattgatgatttatacgatttatattctttaggatttagaggtgaggctctagcttccatagcttctgtggctaaaatagaaatgattactagacctaaagatgagcctgtaggaactaaaattttagttgaaggtggaaatataaaactaaaagaaccagtaggtacgaacaatgggacaactattatggttcgagatttattttttaatactcctgttagacaaaagtttttaaaatcaactcatgctgaaactataaatataagtgacttaataaacaagttagcaataggaaatcctaatgtcagtataaaatatgtaaataataaaaaaactatgttaaattcaccaggtgatggtaaacttataaacactataagaagtatttatggaaaagatataactgaaaatttaatagagttaaaccatgaaagtcagttttttaagataagtggttatataggaaataataatgtgtatagagcaaataaaaatcttcaacacatatatataaataaaagatatgtaaaaagtaaagttatattagacgctataagtgaaggatataaatcacttatacctataaataaacatgcagtttgttttttaaatatagaaatagatccatctaaaatagatgttaatatacatccaactaagcttgaacttaaatttgaaaatgaacaacaaatatatgtagagcttaaagagtatataagaagttctttaataaggtctaacttaataggtaagtatgaaacttttgataaaaaggaaaatctaatatcaaagcctataactagtcctaaaaaaatagaaaataaaagtgagcaaattaatgttgataacttaaatcaaggaatactaaataacttagaaaaagaatataaaaatcaaacatataattttgaagaactagaagagagaaataagcttgaaaaagaatttaaagaatctaaaaatacaataaatcaattaaaaactgatgaagttatagttttagatgaagctatagatttaaataaagtatatagttttaatgatttactagaacttgaaaaaaaagaggaagcaaaaaaattagatgatgatatttataaaaaaaataatgagatatatacacaatctaataatttagaaaatcaaagtataaatgaagatagtatatcttatgaaaaaaatatgcatcaacctgaatttattgaagataaaaaacatcagttttgtcttaatgaatatatagttatagggataatatttaaaacttatataatacttcaaagaggaagcaatatgtatttactagatcagcatgcagcacatgaaagagtattatatgaaagatatatggacaagttttataatatggatataaatatgcaaatgttacttgatcctatagttttagaactatctacaacagatatgttaaaaattgaaaagaacatagatttatttatgaaattcgggtttgaaatagagatatttggtaaaaatcatataatgataagatgtgtaccaacaatatttggaactccagaatcagaaaaatttatcttagatataattgataatatagatgagataaataacaattatgaacttaaaggtgaaaaatttgcatctatggcttgtaaatcagctataaaggctaatgatactatatatgaagaagaaataaatagtttattaaaacaaatagaaatgtgtaaaaacccttttacatgtccgcatggtagaccaatatttgtagagatatcaaagacagaaatagaaaaaatgtttaaaagaattatgtaagaaagaaggggagagcatgaagaaaatacctttagttatactaacagggccaacagcagttggtaagacgaacttatcaatacaactagcaaagaaacttaatatggatattatatcagctgattctatgcaaatatataaatatatggatataggaagtgccaaggtaacgactaatgagatgcaaggaattaaacattatttaatagatgaagttaatcctgattttagtttttctgtttcagagtttcaaaaaagggctaataattatatagatgaaatagtaaaaaataataaaattcctttagtaactgggggtacaggactttatttaaattcacttatatataatatggattttgcaaaatctgatgcagataataaactaagggaatctttaagattagaacttgaagaaaaaggtatagattatatgcataataagttaaaagaattagacgaagaggcagcaaatagaattcataaaaataatactaaaagagttataagagcacttgaagtttgtttaagcgggaaaaaaatgagtgattttagtaatgatcttaaactaaatgaaaaatatgaacctataataatagtattaaatagagatagaagtcatttgtataaaagaatagatatgcgtgttgatttaatgattaaagaaggtttggaagatgaagttaaaaaattaatatctatgggatatacaaaagatttaatatctatgcaaggtataggatataaagaaataataaaatatttagatggcgagtatagctatgatgaagctatagaaattataaaacgcgattcaagaagatatgctaaaagacaattgacatggtttagaagatataaagatgcaatgtggtttgacttagatgaatataaggatgaaaaaatacttttaaatgatgtaattacttatattgaaaaaaaggtaaatcttgtgtaatatagaatataatatatataaaataaattaaatatgataaatcattttggagggtattaaactaatgaaaagtacagttttaaatttacaggacttattcctaaataatgcaagaaaagaaagaatacctgtaacaatttttttaatgaatggagttcaagttaagggatacgttaagggatttgatagctatatagtattattagaaggtgaaaataagcaacaaaatcttatatataagcatgcagtatctactataataccaggaaaacctatgaattttaataataacaataataacaataatcaaggatacaacaaaaattacaacgaaaataaataattaataagatatatttaaattgaaaatcttgaaagcttatagctttcaagatttttttatttaaaaattttttatattataaaacataaaatgtttaattaacaaaatataaagttatattaataatctttaatttatataatttattagattatataaagagagaagtgataatatgaattatttaagttatttaaatataagaaactttagaggagttaaaaacctagaacttaatgatttatcaactataaatataatagtaggagataataatagtgggaaaacttctcttttagaagctatatctcttttagaaaatccagatagtataaggcatatgcttgttaatgcatcgaaaagagatagtaataacacatcaaaatttgaactttttttagagatgtttcctaaaaaccaagatgaaaataaaggtatacatataaattcaattataaataaatgcgaaaatgaattggagataaaaggtaatttaagtgatattatagactttaatgaaaatgatgcaaattttgactgtaaagtatttgaaggtatcgttaggttaaagcaaaatgatgaagagttaataaataaagaaatatatattcaagaaaataagcaactaagatctagtggaagttattatcttataaaaatagtatatgtaactccatatgatcactttagagaaaatgtgttaaataatacaatagaagttataaaagatggagacaaagataaattaatcaaattacttaaaatatttgatgaaaatattttaagttttgaggttttccctaatagatatatgaataattcatctatttatataaatcataaaaaatataaattaatgcctttatctagttttggagatggtgtaaaaaaagtaataacactagcttcagcaatagttagtgctaaagatggaattttattaatagatgaaatagaaacagctatttacaaagatatggtaagtgaggtttttagatggtttgtaaaagcttgtatagaatataaggttcaattgatttcaactactcatagtttagaagtaatagatgcaatgattgaaggtataggtaataaactagatgatttaacatgttttagaatagaatctattaatgataatatatatacaactagattttcaggtagtaaattaaaagatataagaactattctagggcaggatgtgaggtaatgaagaatatattatttttcgttgaaggagtacatgatgctaattgtatagctaagatattagatattaataattttaaagaaataaagagtattgataagttacctgatatatggaaaaggaaaatacctagaacatatccctttgtaaaagataggttagatagatatatacctataccgacatattttaaaaataaaaatattatagtagtaattatttgtgcaaatggagaaagtaggcttataaaggaaatagatttatacattagcaatatgaataaatctgaacttggtcagataaaaagtatatgtgcaatttttgatgcagaccaaaatcttgcaaagcaaagctttgaagaaaaatttaaaataaatatgaatgatatgattataaaaaagagtgattttataaaaggaaatattaatataaagggagaagatataagtttatataattatttttttccaaacaatgaccaaaaaggaactttagaagatttgctactagaaggagctgaaattgtttataaagatttattagatgaagtaaattgttacataagtagtattgaagataagtataaatacaattggagtatatctagtgaaaataaggtaagagttgggtgtatagcaaatgtatttcaacctggaagtgcaaatcaaaattctataagacatgatgattggataagtgataaaagtatatcttatagtaaatctattaatactttttataaatttattgttgatataataaataattaaaaagtattttaaaatttatataatataaaactaaaaaaattaattttatatgttttaaattttaattattgggtatatataaaatgaaaaaagtaactatataaaaattattttatacatatttagataataatgaaaaaagtaaacaaatgaaaagtgaggttataacaatgggaagctgtaattcatgtccttcaaaaggaaattgcaataaacaagaaacatgcaatatagaaaataatcctaataataaaataaaaaaaattataggtgtaatgagtggtaaaggtggagttggaaaatctactgtaacggcacttatagctaaaaagttaaataaaatgggctataaagtaggtatactagatgcagatataactggaccaagcataccaagacttatgggagttcaagatgaaagagcaacttctccaaatggaaaagatatatatcctataataactaaagataatataaaaacaatgtctataaactttatggtaggagatgaaaatcaggccatagtatggaaaggtcctataataagcaatactgttaaacaattttataaagatgtaatgtgggaagaattagattatttactaatagatatgcctccaggaacaggagatgttcctttaacagttatgcaaaatatacctataaatggtgttgttatggtgtcagttccacaagatatgatatctatgatagttgcaaaagctgtaaacatggctaaaatgcttgatgttaaagtattaggtgtagttgaaaatatgagttatattcaatgcccagattgtaataaaaagatacatttatttgatggggaagaaactgaaaaattcttaaaagaaatgaacttagatcttttaggagaacttcctatgacaaaggaaatagttaatataactcataatggagttgacaatataagctcagaattagatggagttttaaattctatagttgaaaaaataaaataaacttatttaaataaaataaaaaaactaccttaaatttaaggtagtttttttattttagtcaaaggtggaagtacagtaatgtatgtagcttattgatactaatagatcgaggacttgaccaagattatttaatctagtaaatgttattcagtttttagagtactaactctaactaaatagatattaatctattaaagattatgtggttattatagcaaagaggatacacctgttcccattccgaacacagaagttaagctctttagcgccgatggtacttggtgggaagctgcctgggagagtaggacgtagccgcgtaatcttttttatttattacgaaaaagattacatattcataaacccttatacatatcttttattaaagatattaaaggggggtaggttaaatgaaatttagcattcaaatgtgtagaggtaacattctagatattattaatttagcagataataataatttaattatagagtctatagaacaaggacctataaatgatgatatttcaaatataaaagttgctttttcaggaaatagtaatattcatgatatagataaatttgttagtgatataaataattgtaattcatttaattcttgcgaaacaatataaaaactatgcatatatgcatagttttttttgtgataaaaaattcaaattaaatttataaaacgttgaaaaatgaagtataatgtttaaaaactttgtaaaaagatatataataacttgatataactaaatattatgtaaattaaggaggttgattatatgatggtgggatctacatcgcaagtatctcagcaaacagtagagacattttttcatgcggttaaaaatagtgggcctaaattaatatatgcgattatacttttaatcatagggttatacgcatgtaaaatggtaaaaaaatatagtaaaaattttatattaaaatataatgttgaaagaggggtcgctaactttatttcctatggtatttatgtaacagggatagtaatggtagttatgacgtgtttggagattattaactttccggtacaatcagtaatgactgtaatggtttctttattaggagtaatcgggttatcattaggtttagcattcaaggaaatactatctaatttaggatcaggaatgattatattattcttccaaccatttaaaacgggagattatatatgtggatctggagttgaaggaacagtttctgatatacaaatttttagtactgtattaaagacaccagacaataaagctataatagttccaaactttaaattgactagtgacaatataattaactatactcatcaagataaaagaagaatagatttttcatttgatgtttcatatgatagtgatataaaatttgtaaaaaatgttttagataaaatctttaaagaagataaaagaatattaaaagatccaaagccaattataggacttagtacattagcagatagctctatgaaaatagttgcaagaccatgggttaagactgatgattactggagtgtatactttgatattatggaaaaagttaaagaaaaatttgatgaaaataatattgaaataccattcccttcaagagttatatactataaaaatacagaagatgattctaaaaactaataaaaaaataataaaatttttgaatattagtattgaaagttgataatatatataatataatgattaacaaatagaacaaccaataaagctatgaaggaaaatagtaaaaagcaagtttgtattcagagagtgagtggctggtgagaactcattgcaatggtttttgaatccattccggagctactaatcggaattaacagtaagattagtcgtatacctacgttacaggatttaagaggtttatatttttataatataaacaactagggtggcaacgcggataacaagactttcgtcccttttttgagggtacgaaggtctttttttgtatacagaaatacaagaactatctgtaataaaattgccgtaatatcaacagggttaacgttattttcatgaaaataaatataaaaaatattaaaaacaggaggaagaaaaaatgctagatataaaaagaatcagagaaaatttagatgaaataaaaaaagcaatgcaagtaagaggagaaaaagaatttgaccttgatgctgtagttgaattagacaatagaagaagagaattacttcaagaagttgaagttatgaaaaatgaattaaatgtagaatctaaaaaaatacctcaattaataaaagaaggtgtagatgtaactgaagcaaaggctaagttaaaagaattatctgacaagataaaaggtgtagatgaaaaagttaaagaggtagaaggggaattagaatatagattaatgagaatacctaacgttcctcaccctgatgttccacaaggaacaactgatgaagataatgttgaaataagaacttggggagaacctactaagtttgattatgaaaacaaagctcactgggatataggaacaggattaggaatattagattttgaaactgcaggaaaaataacaggatcaagatttactttatataaaggattaggagctagacttgaaagagctttaataaacttcttcttaaatactcatactgaaaagcatggatacactgaagtattacctcctttcatggcaaatagagcaagctttataggaactggacaacttccaaaatttgaagaagatatgttcaaattagaaggacttgactacttcttaataccaacagcagaagtaccagtaacaaatatacatagagatgaaatattatcagtagatcaattaccaataaaatactgtgcatacacaccatgctttagatcagaagcaggttctgcaggtagagatacaagaggattagttagacaacatcaattcaataaagttgaattagttaaatttgttaaacctgaagaatcttatgaagagttagaaaaattaacaaatgatgcagaaactatgttacaaatgttaggattaccatatagagtagttagaatatgtacaggagacttaggatttacagctgcatttaaatatgacttagaagtttggatgccaagttataacagatatgttgaaatatcttcttgttcaaactttgaagatttccaagctagaagagctggtataagattcaagagagataaaaaagctaaagctgaatatgttcatacattaaatggatctggattagcagtaggaagatgtctagctgctatattagaaaactatcaacaaccagatggatctgtagtagttccagaagtattaagaccatatatgggtgttgatgttatcaaaaaagaagaattataatattaaatattaaaaatatatttaagtaaggagcttaaaaatttaagctccttattgttttataagatataaacttaatataatttagattaaattctagtaagaatttgtaatattatagaagaatatgaatttaaatttgagttgaattataaatttaattatggtaatattaaatatgttataagttttaggaggaagcatggataagtcgttttatatgaatgaagcaataaaagaagcatataaagcttatgaaaaaggcgaaacgcctataggtgccgtaatagtaaaagatggagaaataatagctagggcacacaatttaactgaaacattaaatgatccaactgcccatgcggaaatcttagctataagagaagcttcagaatacttaggtggatggagacttataaattgtgacttgtatgtaactatggaaccgtgtataatgtgtagtggagctatagttcagtcaagaataaaaaaacttatagtaggaactaagcatattaaaaatttaaatatagaaaaacaacatgaatttaaaatagattattttaacacttgtaatatagatgtaacatttggtatattaaaagaggaatgttcaagtgtattacaaaagttttttaaggaattaagaaagcgacagtagggagagatggtcgagtcggtcgaaggcgctcgcctggaaagtgagtatacggctaaaaccgtatcgtgggttcgaatcccactctctccgccaaaaaacttaattatggttataagtttgctgtgctagacgggaaggtagcggtgtcctgtaacctgcaatccgctatagcagggttgaattccatctagaggcttatatattgtagggctgccctaaataagtggtgttgacacttaggtcctgcgcaacggaagctcataaaccccgccagatccggaaggaagcaacggtaagtgatcactttcgtgtgccgcgggggtgcctaagtcgagctaactgtttaggtaacgcctatgatagtaagtcaatagatggtgcacagctttaatatataaaataagaatcccttatagttaagggatttttttaatataaagatatatatttagtttttatgttagatatagataaaattattatatattggtatataataatatatcggtattttagaattaaggagagataaatttatgcataaggcactttatagagcctatagacctcaaacatttaaagacgttgtaggacaagaacatataattaaaactttaaaaaatcagatacaaaataataatgtaggacacgcctacttattttgtggtactagaggtacaggtaaaacttctacagctaaaatatttgcaagagctgtcaattgtgaagatagcgttaatgaggaaccttgtaatgaatgtgaggtttgcaaggatatattaaatgacaataatatggatgtcatagagatagatgcagcatcaaacaatagcgttgatgatataagagaaattagagaaaacgtaaagtatactccagctaaatgtaagtacaaagtatatataatagatgaggttcatatgttatctcaaggagcatttaatgctttgttaaaaactctagaagagccaccatcatatgtaatatttatattagctacaacagaaccgcataaaatccctgctactatactttctagatgtcaaagatttgattttaagagagtaactgttaaagatatgagttctagaatgaaagaaatatgtgaagatgttaatgtagaggtagatgatagagctctaaacttaatagcaagaaattctcaaggagctctaagagatgctcttagtatattagatcagtgtatgtcttttagtgaaaataagatagagtataaagatgttgtagatttattaggaactgtaaatgtagaacaattatttgaaatggcagattatgttataaaagaagatacaaaaaagtgtctagaaattttaaatgaatttgtaatatggggtaaagacataaaaaatttaattgatgatttaattgatcattttagaaacttaatggtatgtaaagtatctaatgatttagatgaaataatatctttaccagaggagataatagatcagttaaaatctcaagcagaaacaatagagactaatgagattataagaatactaaatatactatctattactcaagatgatattaaagcatcatctaatcctagagttttggcagaggttagtataatgaaattatcccaacctatgtttgatgatagtaaggaagccttattaaagcgaatatctaacttagaagaagttataagaagtggaaatataactgtaaataataatcaagataaaaaagaacaggttgtaacgcaagaagaagaaaagtatgaagaaaaagaagagatatactacgaagaagttaaaagtgaagatgttaaattagtagaaaagtcttgggaaaatatacttaccaatataaaaaaagatagaaatatgcctgtatatgcaatactaagagaagctaaagactttaatgttaattcaaatactttatatataatttttgatgataaatttgcatttgctaagaataaattaagtgatgttaagacactatcttatatagaaggtgtggttagggatacgattaatagaagttttggtataaaaataatattaaagtcagaatctaaaaatataaaactagaaatagaaaaagaggaaaaggataaaggagaacaaatactagaagaagtatttcctaaagagatattagatataaagcaaagtgtaagtgaaaatgaaattaaataataaatactattatgatataataatagcataaattaaataataaagataattaaggaggattttacatatggctaaaaagggattcccaggaatgatgcctggaaatatgaatcaattattaaaacaagctcaaaaaatgcaaagtgatatgcaaaaaatgcaagaagagttagaatctaaggaaatagaaacttctgttggaggaggagctgttactgtaaaagttaatggtaaaaaagaagttgtagatatacaaataaaacctgaagttgtagatccagatgatatagaaatgcttcaagacttagtattaagtgcaattaatgaagcattaagaaacgttgatgatatgcaatcttcacaaatgaacaaattaactggaggaatgaatatcccaggattattctagtaggtgataagatgcaaacttattcaggaccaatatcagcactgatagaagaattttctaaactaccaggtgtaggaagaaaaacagcgcagagattagcttttcatgtaattaatatgaatatgaatgatgtagaagctttatcaaaagctatattagaagctaaaaaagaaattaaatattgttctatttgttacaatataacagataaagatccatgtagtatgtgttctaataaaaatagagatagtagcgttatatgcgtcgttgaagatcctagagatgtggctgccatggaaagaactaaagaatttaatggtcaatatcatgtgctaaatggagttatatcacctatggatggtataggaccagacatgataaggataaaagaacttattcaaagattaggaaatcaagatgtaagggaaattataatggccacaaacccaactatagaaggagaagctactgctatgtatatagctagacttttaaaaccaatgggaataaaagtaacaagaatagctcatggacttcctgtaggtggagatttagagtatgcagatgaagttacaatttcaaaagcattagaaggcagaagagaaatataaaaaatcgaggtttgattctcgatttttttattttttcatagagttatgtcatattttaaaagaatttttgatatgaaaattacagtacaaatattgaagtagaaatggttgtattgtataatctgatttataatttattaaaaaatttaataggggtgcaaaatgaaatcagcaatgaattttgaagagcataaagctatgaaagagaagcgaaataagaaaatgaaatcatcaaaaattaaaggtaaatatagtgaatctgatgatatgagtcttcttataaaaaagaagagtaagaaatctttaaaatcaaaagaaagtaattttagaaataactacaagcattaccaatatgattatgaagaagatttttatgagccaagatactaggctattaaaagataaataaaaaaaatctgtagatatctacagattttttttatttatctttcaataagtctgactcaaccaaatttgctatattttgtgaagagttaaactttcgaattgattttatattctttttaagtatttccaatctagatgaatcatctataagaacttttaataaaacagataaagagtattttttagttgttcttaatgctgatccacagttacataagaaatctaaattttcttcttcttgtccaggaatgtaataaggtacaatcataggaacatcttttaataaagcttcagtagttgtaagacctcctggttttgttacaagaacatcaattgaagctaatatgtcattcattttatttgtaaaacctaaaattttaacgttcttatcaatatgatgagactcaagatttttttctaacttttctttaagagattcatttcttccagttataactaatatttgaaaatctctatcaatactaagcatctcagttaatgtttctttaatatttccagcaccaaagctaccacccattaaaagtactgttagtttatctttatcaaaacctagctcagataatactgtttctctatccctattttgtaaaaatgatttttcaacaggtattcctaatggtttaattttattaccatctacaccctcagaaattaacaattctttaacatattcatgtcctacaacataataatctaattcattttgaatccaagtagaatgagttgtgtaatcggttaaaacagatataagtgttggaaatgattcagtattaaagtgtttaataaaattatcattaaaactagtatgaaacaatgtatgactactagaatctgtacattgtttttttaaagtactaagtgctatcatagggaatggatgagtacctattattacatcaggctgttcatctaaaagcaattttctaaatttttttgccataaaatttgtaatcatattatctttaaattcgtttttagaagctataccagattccgaaaatctataaactttaccatacgcgtaaggagtatagatcgctgatttttcataacccctagagattattttatccatagtagtattaacaagttttaagctatctatgattttacattctatattttctccatcaattgtttttttgattaattcttctttaatagctctagctgctctattatgcccaccaccggtagaagcagacataattaatacttttttgctcatatttagaatcctcctaaaattggctttataaataaattgtatatatgtattaactaaaaataacattatttacttaaatagtagtattgacatatttcatttaatatttaatactaatctaatatatgtttataaaaaatacaagtagggtgtttttaaatttaaagaagataaggtgtgatgaaaatgaaaaaagtagaagtttttagtagcaatacatgcaagaattgtgtagatttaaagaactatttaaaagcaaataacatagaatatacagagtataatatatctaaagatcaagaagctagaaaaaatcttattcagttaggatatatgtctgttccagtaacacttatagatggagaacatgtattaggctttgatagaataagaatagatcaattattaaataaaaataactaaaaatatatgcctaaatttaggcatatatgaataaaaattaatgttaattggaaagcttaattacatgaataagtttataaaaataaaaaaataaaaaaagttttaaaaaagtattgacgatattaaaatgagatggtatagtattacttgtccttgagaaaagggcaaacgcgaaagacaaaatgaactttgaaaattaaacagtaggttaattataaaaattctttttaaagaattaataaaaaaatgtaaaaatatatatgaaaatgtataaaaatagtttttaggtgaaaaattataaggagggatttgttaaatgaataagcataaattgctaaaatggataaaaataatttttgccttagcaattttcattatagtaatgaaagaatttaaaaatatatttacatcttttgatattgaagtatttaaaagatatgcagataaattaactatatggaatatgctaattatagctattttaggtatggtttcttatctaccattaagtttttatgattttatacttaaaaaaagggttggaataaaattaagtaatattaaactatataaatactcatggatagcgagttctatagctagtatagctggatttggaggtagtacagctatagctttaaaaactaatttctataaagaccatgttaaagatacgaagctattagtaaaagagatatctaaaatagtagcattaaacttaacagggttttctatggtttgttttgtttatgtaataacaaattttagtagtttaagaataaatgagtttgtaagtataatgacagtcttaataagtacttattttcctattttatcaatatatttagtagttaaatatgttaaatcaactcaagaagaaaaagtagatataatagatgctgttaaaataatgattatatcagctttagagtgggctactactatattcttaatttatagtataatgaggattttaggagaaccagttccaatttctaaattcttgcctatatttgtagtagcgatagtggcagctattgtaagtatggcacctggaggaataggttcatttgatataactcttttattaggtttacaagctttaaatatctcatctgagaaagtattactagcaatatttttatatcgtgtgtcttactatataataccattggctatagggctgatattatatggacaagaatactttataaatctagatgaagatgtaaaagatataataacaacaatcttatctaagattgcacatataggtattatgttactagttttaatatcaggagtaactttattaatatcagaagcaactccagacttagctagaaaatttaatattgtaaataaattttcgtatttttctatagttcatattccacagagaatatctataataataggatttttattaatagcaatttctaggataatgagttataagtcaaagggaatatacaaaataactttaggattaataattggagctgtattattaactttagttatagatcctaattactatagaagtatatatctagtcatagttgcaatacttatatgggttagtaaaaaacaattctatcgagaaagttttgtaatgagatggggagtatttttacaggatataatcttgttactatctttccaaattttatatatatacacagtatatgcgaatttaagtggtaaaataggaaaacttcctattgctaactataaaattcaatctattaaacattatggagcatcattattaggatttagtataagtggatttataatagctatatttttaatatggatattatataaaataaataacgataatgattttcctcgcaagaagttagaagaatgtgaagatcaggttaaagaaataatcgagaagtttggtggatcaccagtaatacattatgtatatttacatgataaatatgtatatataaatgaatctaaagatgtattattacaatatcaaatatcggcagataaaattgtaatacttggaaatcctgtaggtaataaagaaaaaatatttgaaactatacaagaattttataatttagctgataagtatggatatgttccagtattttgtgcaatagataaaactatgatgccaaatttacatgaaacaggatatgaattcttaaagctaggagaagatgctttagtagatttaacgaagtttactttagaaggaagaaaaatgaaaagtgtaagaaatgcactatctagagtagaaaaagaaggttatagctttgagattgtaaaaccaccttttacagatgagtttttaaatgagctaaaatcagtttcagatgaatggctatcaggtaggcaagaaaagggattttatataggcttttttgataaagaatatttaagtagacagcctattgctatagttaagaataaagataatgaaataaaaggttttagtaacttaatgcctatgtacgataataaaaagacactatctatagatttaatgagattctctcatgacacttgtaacggtataatggattttatatttgtaaatctgtttaaatggggtcaagaagagggttattctagatttaatatgggtatggcaccattatctaatgtaggtagatctaaatactcattcttatcagaaaaagtagcatcacagatatattcacatggacaaaacttttattcttttaaaggattaaagagatttaaagaaaaatattgtgatatatgggaaggtaagtatatggcatatagaaagaaaacatctatacttacaacagctttacaaatcataatagtagctgaaaaaccaatagataaaataaagtaaataaaaactcctctgattagaggagttttttatttattattttatagattttaatacttctaataagtatttccaagtattttcagttgaagatatacttaaatgttcatttggagtatgcacatcatacatattaggtccaaatgatatagcttcagcattaggtattttgtctagtaataaaccacactcaagacctgcatgtaaagccattattataggttcttttccagtaaggtttttataagcttctatacatactttctctaaattagaatctttagcatattcccaagctggatagtcacttattaattcaaggtttccgccaagatcagttactaaaagttccattctagctgttatatcttctttaagagattttacagaacttctaactgcacattcaaaagtaactgtagaatctgtagttctaagaacccctaagttagttgaactttcaactaagttttctatatccatgctcatagtttgtataccattaggtattaaattaagcatttttataaccttatctttagaagctgaattaagaattaattcaggagtagcagtttcagaacatgctatttcaagtcctgggtcagaagttcttaattcatgtttaaatatattagttatatcttttaactgagttgtaaatgcatctatttgatcgttattaaccattattacacaatcggcttcacgagggatagcgttattttttgaaccgccttcaaccttagcgatatcaaaatcaacatttaataaatttaaaagtcttcctaatatcttattagcattacctctttgttttattatatccataccagagtgtccacctaataatccttttatctctaaaagataagcttttttagtagcttctggttttacaaattcaacaggtaaagttgatagggcagttacaccaccagcacaacttactaaaaggtaaccttcttcttcagaatctaagtttagtatatatttaccttttactaagcttccatctaatgccatagcaccagtcattccagcttcttcatctacagttacaagaagttctaaagcagggtgagctatatcattagaagcaagtattgcaagtcccatagcaacagctataccattgtcagcacctaaagttgtatcagttgcatatacataatctccatctattcttagttttattgggtctttcataaagtcatgatttgtacttttatttttttcacataccatatccatgtgaccttgaagtactacaccaggtgcattttcatatccaggagttgctggctttctgattattatatttaaactctcatcttgtatagtttctaagcctaagctttcaccaaagttacgtaagtaatcacttatacctttttcattttttgatcctcttggtatttgagagatctcttcaaaatacttaaaaactaaactaggttgtaaatcatttaaaactctgttcataaaaaacatctccttaataaaaattaaattagattaaattatattacaaaatagtattgattatgtataatatataaatagtatagtacaaatttacataaaatacacttaaaatttatataaaaaatttacttaaggaggaagcatgaataaaaaatcattaaaagctttagaatttgataagataatagcactactaaaagaaaaggcttcatcttctttaggattaagatatatcaatgagttagagcctagttctgactatgaagaagtaaaatatatgttagaagaaactagtgaagcacaatctatacttataaaaaagggcggagtaaatttacaaggtttatatgatatagaagataaggttaaaagaactaaagtaggagcctctatagatgcaggaagtttactaatgatagctgatactcttagagttgctagaattttaaataatactttatcatcatctgaagaagaggattttaattatccgataatacaatctctatctaattcattatatatacatagagatattgaagataaaatatttaattctatagttagtgaagttgaaatatcagataatgcttcaagcgaactaagaggattaagaagaaaaattatacaaaaaaatcaatccataagatctaaattaaatggaataataagttcatcaacatatcaaaaatatttacaagatgcaattatatcaataagaggagatagatttgttattccagtaaaggctgagtatagatctcaagtttcaggtattgtacatgatcaatcatcatcaggagctactttgtttatagaacctatgagtatagtagaaatgaacaatgagcttagacaacttagattaaaggaaaaagaagaaatagaaagaatattaagtgagctatcatctcttgtgggagatataagtgatgatttattaagtaaccaagaaattttaggaaaaatagattttgcttttgcaaaaggtaagttatctatacaactaaaaggtgtagaaccaaaattaaataaagaaaagtatataaatataaaaaatggtagacacccattattaaatgctagctctgtagtaggaaatgatattcggttaggtgaagaatttcatacattagttataactggacctaatactggtggtaagactgtaactataaaaactgttggattatttgcacttatgatacaaagtggattacatataccagcggattatggaactagtatgggagttttcgataatgtatttgcagatataggggatgaacaaagtatagaacagagtttatctacattctcttctcatatgactaatatagtatcaatattaaaagatgttacgcaagattcattagttatatttgatgaattaggagcaggaacagatcctgtagaaggagctggacttgcaatagctatacttgaagatgtaaatatggcaggagcaaaatgtatagcaacaacacactatagtgaaataaaacactatgcacttacgaaagatggtgtagaaaatgcagcagtagagtttgatttagaaaatctaagacctacatatagattatttataggtgttccaggaaaatctaatgcttttgctatatcaaagagattaggattaagtgaatatgtaataaatagagcaaaagaatttatagatacggatactatagctgttgaagatgttattcatagcttagaaaaatctagagtagaagcagttgaagaaaaagaagaagcaacaagacttagaaaagaaattcaaacactaaaagaagaatatgatgaaaaattaagcaaaatatcaattcaaagagaaagattattagaagaagcaagacaagaagcttttagaattactagacaagctaaagaagaaactgagttagttataaaagaacttagaagattagaacaagaaagtatgtctaaagaaaagaatagaaaaattgaggaattaagaaaagaaatttcgagttctatgggagcattacaaccaagtgttaaaagcatgatagttcctaaaactgcatcaaaagaagttaaagatttaaaacctggagatgaagtaaaagttataactttaaatcaacaaggttcagtaatatctgcagataataagaaaaaagaagctgtagttcaaattggtataatgaaaatgacattaccatataaatcattacaaaaggcaaagaaagatgcaaaatcaacagttactaaagcaaccagaaatgtcattaaatccaaatcaggtagagtcaaaagtgaagtggacttaagaggaatgacattagaagaagcaagagaagaagttgataaataccttgatgatgcttgtttagctggattagaaaatgtaacagttattcatggtatagggacaggtgtattaaaaactggaattacagaaatgctaaaaagacataaacatgtaaaatctcaaagacctggacaatatggtgaaggtggaatgggagttacgatagtaactttaaaataattaaggggatgaaaaaaatgatattagtatcagcttgtttattaggcataaactgtaaatatgatggcgataataacaatcatgaaggagttaagaattatctaagggacaaacaatttatattagtttgtcctgagcaattaggtggattatcaactccaagaattccttgtgaaatagtcaatggaacaggtaatgaagttttaaataataaatgtaaggtgaaaaataaacaaggtatggatatgacagaaaatttcttaaagggagcttatgaaaccttaaaaatagcaaaattatatggttgtaaaaaagctattttaaaagaaggtagtccatcttgtggaagtaacaaaatatatgatggaacatttcaaggaaacaagattaatggattaggagttacagcttcaattttaaaaaatgaaggaatagatatcattagtgagaagcaattagaaaagtagacatatacttgaaaaaaaatacaatttgttttatcataaagtgttataagaataaggaaggagcactaatatgcaagattttaaaatagaagtagctaaatctttaaaagagaaaatagaagatttaacattagaagaaatagttggattaatagaagtaccgccaaatagtgaaatgggagattatgcattcccatgctttagattagcaaaagtatttagaaaagcacctaatatgatagcagctgatatagcacaaagtatagaagctaatgaagctatatcaaaagttgaaccagcaggaggatatgttaactttttcgttaacaaatctcaattagctaagactgttataaatgatgttttaactaaaggaaaagactatggacacagtgatttaggaaaagataaaactgtagtaatagatttctcatctcctaacatagctaagccattccacataggacacataagaactacagttataggtaatgctttatacaaaatatatgattctcaaggatataatactataagagtaaatcatcttggagattatggaactcaatttggtaagcttatagttgcatttaaaaaatggggaagcaaggaagctgttgaagctaacccaatacctgagttattaaaattatacatacaattccatgatgaagctgaaaaacatccagaaatggaagatgaagctagagcttggtttacaaaattagaaaataaagataaagaagctgttgatttatggcaatggtttagagatgaaagtttaaaagaattctctagagtttatgatttactagatatagaatttgattcatatgcaggagaaagtttctactcagataaaatggatagagtaatagatataataaaagataaggatttattaaaagaatctgaaggaactaatatagttgatttagaagaatacaatatgcctccagcacttataactaaaaaagatggatctacattatatatgactagagacttagctgctgcattatacagaaaagaaaactacgattttgaaaaatgtatatatgtagttggatctcaacaaagtttacacttccaacaattatttaaagttttagaattagttggatttgattgggctaaagatatggtacatgttccatttggtatggttgcattagaagaaggtactatgtctacaagaaaaggtagagtagttttcttagaagatgttttaaaacaagctatagaaaaaacaaaagaaacaatgcttgctaaaaatcctaatgctaagaatgtagatgaaatagctaaacaagttggggttggagcagtagtattccaagaattatctaatagtagaataaaagattatacattctcttgggagagaactttaagttttgagggtgaaacaggaccatatgtacaatatacacatgctagatgttgttcagttttaagaaaagctaatatggaagtaagtacagatatagattacaatttattaactgatgctgatagttcggaagtaataaaattaatagcatcatttaataaaaatatattagtagcattaagaaaaaatgaaccacatatagtaacaagatttgtgttagatttagctcaagcatttaataaattctatcatgaaaatccaatattagttgacgatatagaagttaaaaaagctagagtagctttagttgcagctactaaacaaactatagaaaatgctcttgcattattaggtatgggtgcaccagaaagaatgtaatatatcttatatacatttgtcgaaaaataatgctttacatctaaatttcggttattgtataattatattaagaaatagctcgatagttgagctaataaaaatcaaaagagatatatggaagtagagtatcaatagtattctactccccccctacatttacggcagctaacagctgcctattttttttaaaaagtatactaagttaattaattgataaaactataaagtagtttatacgttaggaaggtagtactgatgaaagaggatttattaaagaaagcatatataaatgcatttggtatagaggataaatatattaaagacatgattattttaaatacgaagtctttagttgatgatataactcaaagatatgtaaaaatagataaaaatagattaaaagatgaattattatattataaattttatggacaaaaattaaaagatttaaacataataaacattgtacttccaattgttatatcaaatacaaatatgaaaaaaagtgaattagaagtattaaaggttatgaaatatcatgttttatataataaggctaatgagtatatgaatgattacatattagcgagcatatataaatagaagtgttgaaatagctaaaatcgcacctttaataaatcagataaaccagacaatatagttttaagagataataaggttatagaaaaatctatacaagttgagcataaccttcctaagtttatgaaagattactgcatctatttaaaaggatctgtatcagttactactagacttgcttatttagaagatatacagttcttttgtaattatttattagaaactaaggaagttacgatagctgatgaaataaaagacattacacttgatgaatttaataaaattaaagcaagagatgttaatttattcttaggagattattgtacacgttattacaaacaaactgataaaagtactcttatttatgagaataacaatcgtgctttagctcgtaaaaagtcatccttgtctactctatttaagtttctttatagaaattcacaacttgaaaataacataactgatggatttaatcctattaagcttcctaagcctcaaccagatgcaattaagcgtcttgaaatagatgaagttgctaagatgttagaagctgttgaaactggatatggacttactgataaagaaaaagtttattggaaaaagactaagcttcgagataaagctatactagcattatttgttacttatggtcttagattaaatgagcttcgtgaacttaatatttcttcatttaacttttctagaggtgaattcaagatttacagaaaacgaggtaaagaagttttaatgcctataaacaaaacttgtgaattggttattaaagactatatattaaatgaaagacctaaaagtgaaatacttaatgaagatgttgaagatgctttattcttatcccttcaaaataaaagaatggatcctaagtcaataagacagttagttaaaaaatatacatcaatttctatggagacatctagagataatggatatagtcctcataagttaagagccacagctgctacgtctttaattcaaaatggtttttctatatatgacgttcaaaacctattagatcatgataatgtcacaacaactcagttatatgcagcacataagaaaaatgttaaacgagatatagtaaataattttgagtggatagatgaatcagacgataataatgagtaatttaaactctaagaacaaatgtttgtataaaagtacttgatatgataatatatatagtataagaataaattaaattaatattagaaatgagatgataacatgtatctagatttaactaataaacaaataatgatacttgagtttataaaagaccaattaactcaaaagggatatccaccttcagtaagagaaatatgtgctgcggtagatttaagatcaacatctactgtacattcccacttaaataaacttgaaaaattaggttacataagaagagatgctacaaaacctagagcaattgaagtattagattcaaataaaggtgaaggtattaatggacttaatcaggaagtactacacttacctgttataggtcaaataacagcaggtgagccaatttttgctgaacaaaatatagaagaatacataccccttcctgcaaatcttgttataggtaaagaaaatttcatattaaaagttaaaggtgaaagtatgataaactctggaatattagatggtgattacgttatagtagataaagctagcactgcttctaattcacaaatagtagttgctttagttggtcaagatagtgctactgttaagcgttttttcagagaagaaaatcatataagattacaaccagaaaatgactttatggaacctataatactggatccatcagaagttaatataataggtcatgtaaaaggagtttttagagtaataaaataaagagatatgtgtaggttcacatatctctttattttttatactaacttaattacatattataccacttttttcatctatatatggatttatataataaaatgacgtattaaataagttaacatttttatataaatatactataatattaacatatagaatttatagatttttcagttaatttgcaggagggagattatgagaagaaattctgaaaagatagctatatttatacttatccctatgctcttgtttactttattcatgactcttagcaatatgtaatatatagataaatgagctatatattttatatagctcatttattttttattaatacttatattaagtttttatattgttttaaaaaatcttttatagcttgtgtaattatttcttgtttagaatacttagagttactacataatctttcaaactcttcccatgtagatttttctacttgtaccctagtcgcctttaaattgttcatattacatttttctatagtaatatcttttttagttttagggtttagagattttatatcttttacacttaaataccagtcataaacctcacatagcttatctaagtcttctgcactaacatttactctagcaggtttagatttataaaccttattagtttttgtatgaattttttttgcttcttttttagtatctatagatttatctttatttgtattttttttatcaacttttttgccagaatctatagtgagttccaattgtttaatattattagaactattgtcttcttcttttttaacatattttcctttaactgacttataaccatgtttatttaaaaaacgtcttaaaggtctaacttcacagttcaattcaatagcaatctcatctattgtcattcctttatcttgtaactttagaaacttatctaatttttgtttttctgtcacttttcatccctccaaactaatcaatataaattataccatgtatttggtattaaatacaaaaaaactccaaacatacattcggagtttaattaacattaacttcatattttatttctactcttctagatttatttctatctatacttccatttttactttctattagttcagctttagatctacctacagctattatatcattggttagcttatctttatatctataatcccctatttcttctccaacaatataattaactacactaaaagctcttctttgtgataaatcaagattatatatatatgtacctacatcatctgtatgaccttctacaactatcttagatatgtagtctccatagtccttatatatagtttcaacatactttggaacaaatatttttaatatttctttagcttctggttttaactcatagctatctgtatcaaataaagctgtttctccaaatgttacttctccactttccttatcaatctctaccggaattccattttcttttaaggttgtttttactgactcattaatactattggcaataccttgttctaccccaccaaccatactttcagaactaattaaaagcattataacaaccattaaaacagttgctaataaatctgtaaaagtaggccaaaaattgctatgttcttcttctttatttacagttcttttatatttatttatcatatcttaattcctcaacttgatctaattcctcttcatctaactcatctaaatcaaaagtttggttgggattttctaattcatttgattgatctgcttcatttgtattatcatattgataagttttgttagcttctaatgattttgaaatatctaaagcttctttgtataggtctatatacttaaatacaagttctaattgacttgttattgacttagcttgttcatcaatagtcttagttagaatttttatatcatcttttaaattagtattaacttcgttcatattcttctgttttaaaagtaaattattttcatgagatattaatttcatcataagatcttgtatatttctttcatataaagcaaaacctgcattaacatctcttatatattcttttatagtaatttgactttgatttacagatttaatataattagatgattcttttatatttaaaataatttcattgtaaatttcactttgagactcatatgtatcaaatagcttaacaaattttaaattaagtatactaaattgcttatctaattttcttacactttgatcaaaattctttatagaatcatgagatccatttaacattattcctagcttttctatagaagatataaaatcatcattaaaatcatgtaaatctttagatattttatcaaacctttctatggcacttatagctttacttatatcttttatacaaacttttatttcattaagcttagattctagtacttctcctttatcattactagatttaactgtcattatattttctaacttaagcattaattgaagtaatacattttcacagtttttaaattttatatatgaattaataagtatagagcatattatacccactatactagtagcaaaggctatttgcatacttcctatagctaatgtcattgaattaactatatcacttttatcaatacttgcaagagttatagtaagacctacaaatgtacctaaaacccctaataaaatacaaagtgatggtgaatgcttaattgcttttatctcgtctattattattttcttatcttttgaaaaatcagatattacctcttcaacaaatgtattcatatttatttgtgagtaaggatacgatgctttataattttcatatttactattagctatttttaatatgctactttcctcttgatttaagttcagttcttttagcttctcatttataaagctataaatattattatttttaattatatttagtactgaatataataatgttatacctataaagattaatgttataggatttgtaaatatagatgcaaataaattaattattatattgaccatattaacctccttaattgtattttaataatatatatgtacaaatttataaaaatagacaaaaattaaggagatgacttaaatataaattaagcacatctcctaagataaatactatttttatactcattctacttctgatgaatttatgggttttatctacattaattaagataacttagaagctaaaatttaatgtagtgagtatttttaatagttaaatatttaatcttaataaatattatgtattttttatttaatatgttacttatttatagtataaaaaaattatttcagtaaataatactattagttagatttgaagttggaaaggctccaatgctctacttaggatttaagtaatgatgagagatgcaggataaagctgccctgccaaatctaatttagatagaagagtacctatttgggtgctcttcatttatttaaaattgtataaactagacattgacataaatttctatattatgtaaaatgttaaaggaattgaataaactttatttgctcttgttgagggagtagctagcacaaaatgtgtgattagatcaacataatgactatctaaagtctggtctaatcttaaatagcgagactcatacacgatttatttcgtgtataagtctcgttttttttgtgcatattaaaaaaagttaaggaggaataaatttatgagtttagtatcaattttattaacttcatttgctctatctatggatgcatttgcagtatcggtaacaaaaggtataacaataaaaaatataactaaaaaaactgcatttaagattgcatttttctttggattatttcaaggtgggatgcctttaatcggatggtcacttggtataaaatttgaaggatacataaaggcttttgatcactggatagcactaattctactttcatttttaggaatcaagatgatttatgaatctataaaagatagtaaagaacacaatagcaatgataatttggaaattgcaatggacgtagacaaatctattaatcatgatattaatatgaaagatttaattgctttatctatagctactagtatagatgcacttgctgttggagttagttttgcatttttaagcattaatataacaccagttgttatcacaatagctgttataacatttataatgtgttttataggtgttttaataggaaataaaataggttataagctaaaagattatgcaggaattgtaggtggcgtgatactcataattataggatttaacatttttaatgaacatactggatttttatttgatttatttaagtaaaaatctgtataaatgcataaaaaaggctataagaacatatgttcttataaccttttttatgcattattttgttaatccaaatttataattagtagtttgtatatatttttcacctttttttagaatagaattttttaaaaaagtttggttatatcctattggaggattttgagtttcaaaacaaattccataccttgtattatttttagtattattatataaaagttctccattagtaaaattcatactatatataactacataattttgatttgttgttattttcatataccttcctgaatcaatatctttcatacatataatatcttgtgttttattgtcttttaatacaaaaggatgatcatagccatttgctaactttatttggttatgattagaatctatcctatcccctattttagttatttttctaaaatcaaaaggggtattagatacatcaagttgtttacctgttggaactcctgtttcatctatttctaatatataatcactgtcaatttttaaaatttgatttgttataggattttttaagtttccacttaaattaaagtatgtatgattagtcatgttaactaaagtatcttcatcactagtagcttcgtaaactatacttaaattattattgttatctagtgtataagtaaccaccatatctaaattacctggatatccttcttccatatgataacttttagatttaagttgtaaagaaattttatccttatattttacaacatttaaatcccatacttttttatcaaaccctatatttcctccatgtccttgattattttcatagtttttagatagtatatacgtatttttgtttaatttaaattcacctttatatattctacctgctgttcttcctattatagctccaaaataagatggattttttatataatccttaatatctttaaatcccactactatgttttcaaattttttatttttatcaggagttaatattctagttattattcctccgtaattaagaacagatatacttatttcgttatcatttttaattgtatataaatatatatctgattctttgtattttaatacaaactctttataaacctctatagttatcccccctaaataaattacttagttatattatcaacattaaattctaaaaatccatctacaatcatgttatgtaatttttcttcatatagattacttaaattttcatctatatataatatatactttggaacatactcatcttcctcttctaatttattatctataacttcaaaaggagtaagtagtatttgatcaaaatttaaaattagttctggtaacttatcaaatacttctttactgttatcatagtcttcatctgctaatttttcataagtctcataactctttttataatataagcttgctaacatatactggcattttttatttccaagcttagcaccttctttaaaatatttctcagcctctaaatcttcatttaactttaaacttaattgtcctaagttaaatattgattctatacattcttttaatcttggcttttcataccagtacttagcacttacataatctttataataaatactatatattatacctaacatatgctgtgaatagatattatcttcatttgcaggaacttcaaacatctttttagcaagttcataatcttcattttcaaaagcaatttttcctaaatgtattctagcatttatatgttcattattaactgctttttcatagaaattactagcttcttcatagttttctaaattttcatatataacacctaacctatacaatgattctacgtcattattgtcagatgcttttttataaaattttatagcattatcataatcttttaaatcctcgtatatattcgctaatttaatttgtaccgataaaaaatcatctatttttaaataatattttatagctttgtctagttcattagtttgagcatataaatctcccatattttctatggcttcaattatgccaccttctatagctttttcatataattttatagcttcttcataattcttctcttcaaataaaattccagctaagttatttgtagcctgaattatattattttctgatgcttctttatagtatttcttagcttcttctaaattactatctttattgtatatatttgctaatttataacctgctaacttattatttttttcataagcatttttataatattttatagcatcttcataatgctcttgttcatcatatatataagccaatctgtaattgcaatctatatttcctttttctgcaccttttttataataaattttagcttcatctaaatcattatcctcttctagtaatagccctaaattaaaacatgctttttcatatcctattttatatagttgcttgtagtaagatatagcttccttataatcatcatgttcttgataaattaaagctagattatattttgcataagtatttcctaatatagctcctcttttataactatcaaaagctttatcacaatcatttagagtctcatataatatccctaaattataaaatgcatctgatagtttaccttcactagcttcctttaaccattttaaagatctattataatctcctagtttatagtgcactacacctaaattgttttgtgcttttaaatgccctaatatagctactttttcataccagtatatagaatattcataagcatttagcttataatacatattacctaagtcataagcagcttcttctatcccgtttttaaaagctgtcttaaaccatttttcagattcttcaagattaccttcatctttatatattttagctaaattatattgagctttattataatcacttacagaagcttgagttagtaactcgatagcttcatttagttttcctaatttaatatagaaatttgccttagtatataaaaccttagggtctgttggtatatttttaattttttttattgaaaatttaatattattcataagctactccatacctacctttaaaatttatacttatacaatattttaccataatacctatatattatattagttaaagtttgtatataggtattttttattgatattttggtataatcttatatagtattagtaggaggattattatgaatttagatttattatttaagatattagttgctggttttttgggttagtattattacttccaatatacactattactttatatatgattatcaaaaagaaatattcaataataaataaagattataaaaagctattaaatataactaaggatattgcaaatggaaatttaaatactaatctagaagaagatttaggtacatttaatttattaaagaatgaaataggtaatattcaaatcggatttaaaaaagctgtagatgaagaagtaaaaagtcaaaaaatgaaaacagagttaatatctaatgttagtcatgatttaaaaactcctttaacatctataataacctatgtagatttattaaaggatgaaaacttaagtgatgaaaaacgtaagttgtatatagatacattagatagaaaatctgaaaggttaagagttttaatagaagatttatttgaagttagtaaagctaacagtggaaatgtaagtttaaatattgtagatgtagatatagtttctcttatgaaacaaacattacttgaagttgaggataaaatgaaatcttcaaatttaacactaagaaataatttcccagatgaaaaagtaatacttaagttagatagtcagcgtatgtttagagtatttgagaatttattaattaatataactaaatacgctatgccaaactctagagtatatattgatataatagataaaactaataaagttgaaataagttttaagaatatgacagctgaagagattacttttaatgtgaatgaattagttgaaagatttgtaagaggggataaagctagaaatacagaaggaagtggacttgggcttgctatagctaagagctttgtagaacttcaaggtggaagcattgatgttagcattgatggagatttatttaaagttgttatagttttaaaaaaataaattatttaataaatttaaaccttgttaaaataatgaaattaaaaaatgatttaaacggtaaaataaaaagaagatataatatattatatcttcttttatattatgaaaaaatatttataaacattattatagtagggagtgccactaagtctattaagaaagcgcacactataggaattgtgaaaaatgctctttgagaatatccatatctactacatattgaatttaaatttgcaagtgcatttggagtagcgccaagttcatgacctataaatccaccaaccataacagctgaatcataatctttacctaataatttaaacattacaaatacagtaaacaatactataaataacacttgcattaaaactataattaacattggaagtccaagtgtttctaattcccaaagtttaatactcataagtgccatagttaaaaatagttttaaactaacattacctaaaagttcaaaatatgagtaatcgactttaacaactttaaatacatcattagtatttctaaatatcatagctactataataccaccaacatattctggcagcacatatcctgtaagtgtagttaaaaatccactaatcatatatccaatagtcatacaagtacttattataaataaatgctttataaattctgatgtatctaatttagatgcagttggaagtgatgcatctgaatctgtaacctcactatgtataccttcttcatcaggaattccttcatgaaaatttacaacaggttcttctttaggttttaacttatatttttctattaaaaatctagaagttggagcaccaactaatcctccagatataagacctaaagttgcagcagcaagccctattgtattagcacctgtaattcccattgcttctagtgttggaccaaaagtggcacttgtaccatgaccaccacccattgatatggccccacacataagaccaagtaatggttcaattcctgttaaaaacgcacctaataatccgatgatattttgagcaaatataagtattatacaaaatatccaatatgtaaatactgactttccgcctttttttataagtgtgaaacttgcatctatacctacagttgagaaaaaggcgaccataaatgtagattgaagactagtgtctaatacaatatttaatatattaaattgcttaagtaaaaatactaaaattgaaaatagtatacctcctataacaggacctggtatacagagtttatctattatcgaaatacgttttctaataaacctaccaagtatcattaagaaacaagctagtgatatggtagcgacaatatttaaattaagggtaaagattcctttgacataactaaattccattaaatcactcctttattttgttaaattgtgtaattagatatctaactattataacataaaattataaaaaagtaaaatgttataattttatttttaaataaatttaattttttagttaattattatataagctatattaatttataccaaaaaatgattatatatacagatacgtagtcttttatattaattaataaatctacgtaaatataattatttttatattgtaaatttaatattaaagattagtaggtttataaattattagcttatttttgatattttaaccaataatagatactcataaaattagaagattatataaaactcaaagttaagattattttctaaaatcgcctaaattaggataggatttaagttataaaacttaagttcagattctattttatttagtggactcaatctagaaatcaaataataataatcattatcaaatattatgcgaaatgtattgaaaacgattattaattatgataagataattacagtttggagagtaaggagaaaataaaaatgaataaaattaaaaagtatatatatgtaacagtaggattattatcatttgcaataggagcaataggagtgatactaccaatacttcctacaacgccatttttattattagcgtccttttgttttgttagaggttctgaaaaatttgatagatggtttaaatcaactaagatgtataaaaagcatctagaaagctttgtaaatgaaaaagctatgacaatgaaacaaaaggtaattatattattatttgtaaacataatgttagcaataccaattatattagtagataacttacatatgagattgtttttattaggactaatttgcattaagctatattattttatatttaaaataaaaacaataaagccttgtagcgttaatgagtagagattaagtaatattaggtaggttatttgtaaatattaattgataataataatcatatgcatgaatgggatattaaaaatttttaattttaaaataagaaagaagtaaaaggagatttaaatgttacacagattaggatcaatattttttttattagctataataactagtttttttaagtattttaaatttataaacaacaaattaagtttaaagctacatcttgcaacaggtaccataggtgcactagcaatgattatttattcattagtagattttgttaaggataaagaaattacaattttactagtaggtctaactagtatattaataatattatctggaactaacaaggtgagaaaaaaatataaatggttgcatttaatatcagttataggttttgcaggagcacttgcatttcacataatcagttaatataaaaggaggaattatttatgataaacaaaagattgctttcgcttagtaaagaatctcaaaaatatgtatatcttacagttttaatgaactggatatctataatatgtaatatcggaatagtactatttgtaggtaatataatagataaattacataataatgatttaagctttaatacaggagtttatgtactttacttaggttcattaatattaataagatttgtatgcaattatatgtcaggaagattttcttattattcatcagcaaatgtaagaacatctattagagaaagcatctataagaaattattaaaattaggtgtgaattacaatgatacaatatcaacttcttcaattgttcaaatagcagtagatggagtagaagcacttgaaatttattttggtagatacttacctcaattattttacagcttattagcaccacttactttatttttagttattgcacctataagttttaaagccgcaatagtacttttaatatgtgtgccactaatacccatatcaatagcagctgtaatgaaatttgctaaaaaacttttaagtaaatattggggtatatacactaacttaggagattctttcctagaaaatcttcaaggtcttacaactttaaaaatatttgatttagatgaagaaaaaaatcaagagatgaataaagaagcagaaacttttagaaatataacaatgaaagttttatcaatgcaattaaattctataacaataatggacttaatagcatttgggggttcagcaataggtatattaatagctgttactgaattttacaatgggaacattacaataggatcaacagttgtaataatactattatcatcagaattttttataccaatgagacttttaggatcatttttccatgtagctatgaatggattagctgcagctgataagatttttgatttacttgatactaaggttgaagctgaaaaagaattatctgataaggataaagaaaagttagagaatatttctatatcaataaagaatgttgattttagctatgataatgaaagaaaagttttacataatgtcaatgtagatataaaaaataagtctatggttgctttagtaggagaaagtggatgtggaaaaagtacaataactaatttacttttaaaattaaataaagttgataaaggggagattttattaaatggaataaatctaaacaatataccatttgatgaattaagaaaaaaggttagttttataagccatagctcatatatatttaattctacaatagaagaaaacttaagaatgggcaatgaatgtgcaactgaagaagaattatatagtgcccttaaaaaagcaaatttatatgaatttgtaatgggattagagaaaaaattacaaactccagttggagaaaatggatcattcttatctggaggtcaaaagcagagattagctttagccagaatgatacttacaaacccagaagtttatatatttgatgaagctacatcaaatgtagatgttgaaagtgaagattcaatacttgaaacaatatatgcactatctaaagaaaaaacagtagtagtcatatcacatagattagctaatataaagaatgcagataaaatatatgtattagaaaaagggtatatagttgagagtggaaatcatgataatttaatgaagaataattcagtgtatgctaatttatacacaaatcaagaaaaattagaagatatatacaaagaagatgtaactagggaggtggctataagtgaataaggaaagaaagaggttatctggtggaaagataatgcttagacttataaaaatattaaagccattagtgcctgtaatgatgataacaataagttttggagtattaggatttttagcagctatagctataactacttttggagcagtagctatgggaaatattataggtttggatatgggatatactttacaaacttgtgtaaaaataataattgtatgtggagttattagaggaatactaagatacatagagcaatattcaggtcattatatagcattcaaaatacttgctatacttagagataaggtgtataaagctttaaggaagttagctcctgctaagcttgaaagtaaggaaaaaggaaatctaatatcagttataacaagtgatatcgagttacttgaagtattttatgctcataccatagcaccaatagcaatagctataattacatcagctataatagcagtatttttatataatataaatccatactttggaataataggagtagttttttatataatagtaggatatataataccagttttatcttctaagttgggaagtgaagcaggatttgattatagaaatgaatttggaaaaactaatagtttcctgttagattcattaaaagggataaaagaaatactattatttgggcaaggaaacaatagattaaactcaataaacgaaaatagtaataaattaaatgaaaagatgaaggtcataaaaggccatgaaggtttaataagagctttaactgatataacgataatgatagcaatacttacaacactttatgcaggtgttacattatacaaatctcaatctataaacctaggacaattagtagtagctttagttttactttctagttcatttggtcctactgtggcactaagtaacttatcaaacaacttaatgcatacatttgcttgtgcacaaagattatttgatatactagatgaagtacctgctgtttgtgaggtagctggaaatgatgatttagaaatgaataatactaatataaataatttagaatttaagtatttagatagagaagaagtactacttaaagatgtaaatcttaatattaaaaaaggtgataagattgcaataatcggtgaaagtggatgtggaaagagtacacttttaaaacttatgatgagattttgggatgtagataagggaagtattgaaatagacaataaaaatataaaaactattccaacaaagtctttaagaaaatcacaatcattagtaagtcaagagacgtttttatttaatgatacaattgaaaacaacctaaagattgggaaaaaagatgcaactcgtgaagaaataataagtgcttgtaaaaaagcatctatacatgagtttatagaaacattaccaaagggatatgaaactaatgttggagaaataggttcaaacctttcatcaggagaaagacaaagattaggtatagcaagagcatttttacataatccacaagttttaattcttgatgaaccaactagcaatttagatactcttaatgaagctcaaatattaagaagtataaaagaagaatcagatgataagacaataataatggtatcacatagaaaatcaagtacatctatatgtgataaaaaagtttatgtaaaagataatacacttaagtttaactattaaaagtataatcttgattaattagaaaattgtgagtataactctaaaagatattgattaaaatcaatatctttttttatgtaaattttattttagacatgtaaatcttataaatagaagattttgaaatgaaatatattgagtgtaggattattaactatattgatgaaaaatataaaagataacaaatttcaataaaattataaaatattaaaaatattataatgtagacaatatgtgtcaacattatttactattatctaaatatagcttatctaaatatcaataagtttaatatatagattaaaaggggtaagaaataaaacttaattcaattgatgaattaatatatcaaatatgtaaaagaataaattaaaatctaaaaataaagaaggtagagttatgaataagtttatagaacaagctaagttaataaaagaagatatgatagtttatagaagaactattcatagtaatcctgagattggatctaaattacctaaaacaaaaacttatgtgatggataaattaagaaaattaggatatgatcctaaggaaatatgtgaaagtggtatagtagccacaattaaaggagataaaccaggaaaaacttttttattaagagcagatatggatgcattaccaatgaaggaagaaactgaatgtgattttaaatcaactaatggatgtatgcattcatgtggtcatgatatgcatacggcaatgcttttaggtgcagctaagttactaaaacaaaatcaaaatcaaatagaaggtactattaaattagtattccaaccagatgaagaaggatttacaggtgctaagaagatgatacaagcaggtatccttgaaaatcctaaagttgatgcagctatggcaatgcatgttcactctggtacaccttcaaatacaatattatgtggcttaggaactagcatagcaggatgtaatagatttagaattgttgtaaaaggatctggatgtcatggagctatgcctgaaacaggagtagatcccataaatatagctgctcatatttacttgtctttacaagaaataataagtagagaaatatcagctactaagccggctgttgtgacgataggtaaatttgttggaggagatgcaccaaatataataccagaagaggttattatggaaggtactatcagaagtttagataaagaagtgggagaatttatatttaacagaataaatgatatagttatatctactgctaaaatgtttagaggcaaagctgagttaatagagttatcttcagtaccaccattaattaacgataataatttagctcatgaaattactaattatatgaaagatttagtaggggaacaatcagttatcttatttgaatctggaggaatgggatcagaagattttgcttcttattcgtatgaagttccaagcttatatattatgctaggtgcaggttcaaaacaagagaatactttatttggacaaccaatgcataatgagaaggttgtatttaatgaagatatattacctacaggagcatctatttatgcgtatagtgcaataatgtggttaaaaaataataagtaaatatataattagtagattgaaaggaagtattaatgagattattagatattttattttatctattaaggtgtaattctaaagttacaattaaggatctatctgaaatttttaatgtatctacgaaaacaataagaagggatttagataaactatcaatactaggaatacctataattatatatagaggtgtaaacggaggagtagagattgataaaaactatataatatcaaagtatatactaaaatatagtgattatgaatccttaatatttgcattgtatataggtgaaaaaataagtaaggatataagtgaatcttttttaattgataaatttaagctcgtagataatgatagatgttctaaagttttaagtaagaagagtttgacactaaaaatgaaatatgcaaagaaattgatagatgtttagataataagtcctttatacaattagagataaaaggcaataaatttgaagtatatccaatttcttatgtactaagaaaagaaggtttgtgtttatattgctatagagaagagtatatgattattttaattaataaaatatctaatgctatgatgtgtaataaaagttatgaaggtactataatcagctatactgaaaataaagataaaataaaatgatttatctatttttatttcatctacattataattttttatataatttatagaattaaatcctttaccaaaatcatctatagatatttttatccctgtactttttatttcgtttattatatcatttatttttataatatcttctatattttcactctcagttaattctagtttcaataagttaaatttaaaatttattttatttatactgtttatcaaatctttaataaaaaattcattatctagttgatttggggatatattaacggatagatctatttctgtattcaatatctcatttaaatattttatatcttcacaagctttttccaatatccatttcccaagtatatttatatatccatattcttcagaaaaagctattagtttttctggatttatatatccatgttcaaagctaaaccaccttatcaaggcttctactccaactatctctccattttgcaaatcaacttttggttgataatataattgtatttcttctttttttatagcttcttctatagattttatacttatataatcatcatatctttcattataaatctcaaatccacttcttttttttgacaaactagacatgcaaacttccaatttactggtagcatcttctatatttaaatctttgtctttatatataacagctgcaatattaaattgaatatatatcttatacttattttcaactttatctaacaatgtagccattatattattcataatttttttaatatatacttcatttacatttggtgtatatatagcaaatgcaaaatttgatagtctagctaaaatcatatctttacatttataacttaaatttttagctataaattttattatcttattacctttttcaactccataattaatatttataaagtttattccatcaatttcaactcttattatagttccatttgacttccattttatataattacaaaaatactttttattatatacacctgtaagattgtcttttcttggtatacgcaaaaatatatttttcttaattttttttagttgtctttttttcatattttttctccataaataaggaacatacatactactatatataggttaaataaaattttagcctttgtaatatttcattactttaggaacatatttttgagtttcttttggcattaaatatatatcctctaaagatttaactccccttctcatcattctagtgggacctccattatatgccattaaagccatctcaacattaccatgatatctatctaaatattctttaatgtgccttgttccaccatctatattttgctcaatatcaaatggatctgtaattcctaaatctctacaattttccggcataagctgcattaatcctttagctcctgctgaagattcagtttttggattaaagtctgattcaacttttattattgactttatcaatttttcatcaacaccatacttttttgatgctacagatatagcattttctattttagtgtttatatcttcatttttagaagatatctttaatttatggctattatgtatagagtttaccgtatctaactctttagctaaattacaactttccccagatttgcttatattaccattaatgtttacattttgaatattatatacttgatttttacttgctatcgcttctagtaaatttattaacaacatatcaaatccgttactacgattactacaattgcaacttctaaaactattattagacatcaaagatgctattttaaataattctatattatcaatcattttatcacctctaccatatagttctattaattatacgtcaattaactaaaatacttgatgtttttaggtttaataactttaaattaatataaaaaaataaggtcatatttatatgaccttatttttattagtctaagtttcttaaatcgtccattaattttgttttatcagcagttttttcatccttcatttttattacttttgcaggagaaccagcaacaactgctccagcaggaacattttcagtaactacagaaccagcagcaacaactgcaccttctccgattctaacaccttcaagtattactgcattagcacctatcattgcgttatcttctataataactggatctgctgaaggtggctctaatacacctgcaactactgctccagctccaaggtgaacatttttaccaagtgttcctctagctcctattacagcgttcatatctaccatagaaccttctccaactactgctcctatgtttataactgctcccatcattactacagcatttttacctatagtaaccatatctcttatataagcacctggctctattcttgcatgctcatgtaaatagttatacattggtattgcagaatttcttctgtcatattccatatgtatatcaactaacttatccttttgagcatctaaaactggctttattgcctcatagtctcctattatagtgaatgaaccattgtttccaaacactttataatcttcagttgactcagcttttaaatctccgttcacataaacttttactggagtctttttctcaactgtctttatatatcttgctatttcgtatgcatcgtttaaatttatcattcgttacctcctaattagcttagcatatcgtccatattatagtatccagcttctttattaactaaatacttagctgctgttatagctccatttgcaaatatatctttagattgagctctatgacttatcataacttcttcatctaatcctgcaaatatagcttcgtgttctccaactattgttccacctcttacagcatgtataccaacttcattttccattctcttggcatctcttccgtgtcttccgtagttataagtaacttctggtaaaacttctttaactgcattggctaccattatagctgttccacttggtgcatcaacttttttattgtgatgcttttctatgatttctatatcaaatccctttaatgcctttgccgcttcttttacaagttttagcattacattaactcctaaagacatattagaagaatggaatattggtattatttttgaagcttcttttatttgttctaattgatctttagtaaatcctgttgtagctattactaaaggcgtttttgttttaagtgcataacctaacacatcatcaagtgcagagaaatgtgaaaagtctattattacatcagcttcttcttttatctcactcattttattatataatttatagtcaggagtttctcccgttggcatagaacacccacaaactaactctgtatctttatcttcatttacacatctagtaagaacttttcccatcttaccaagcgaaccatttactataacctttatcattttaatcctcctaaaactcaaaaccgtagtttacaagttcatctcttaaagcttttaaattattttcttccataggagcaagtggtaatcttaaatctccaacttcaaatcctaatatattcatagcagtttttactggtataggattaacttctataaataatttatctattaatgctttcatacccaattgtagttctcttgaacctttaacatcaccatttaagaatttttctactaaatcatgagtttcttttgggcaaatatttgcaactactgatataactccaactccaccaagtgataaaagcggtaatatagaatcatcatttcctgagtatattgcaaaaccttctggcactaatctagctatttctgctacttgtgctatatctccactagcttctttaacagctactatattttctatttttgcaagttctgctattacactaggttttatattaactcctgttcttcctggaacattgtataatataattggtaattctgtactagctgctatagtctcaaaatgaagtttaagacctctttgatttgttttattgtaataaggagttattactaaaagtccatctgctcctaatttttcagcttcttggcataagtaaactgaatgcatagtatcattagaacctgttcctgctataactggaattcttttattaactttttttacagtaaaatctattacagcaaattgttcttcatcagacatcgttgtagattctccagtagttccacaaactattaatgcatctgtgttgttttttatatgatattctattaattctccaagtttttcaaaatctacaccatcttcgttaaaaggagtaactaaagcaactccagaacccttaaataacatactcaatacctcctaatttttttactaaatcatattttaaaagaagttcagcaatttgtacagcatttgtagcagcaccttttcttatattgtcagctactacccacatatttataccgctgtctacgctaaaatctcttcttactctacctacaaatacttcatctcttccactaagttcaaaagctgtaggatatatattattttctatgtcatctactaattctaatccttgtgagtttgctagtaaagcttttaattcttctatatcaaaatctttttcaaactctacatttatagattcactatgtccatttactacaggtactcttactgtagtcgctgtgatttttaaatcatagtcatttaaaattttcatagtttcatttatcattttcatttcttcttttgtatatccattatccataaatacatctatgtgtggtaagcagttatatgctatagggtgtggataaaatttattttctaatccttttattccatcttctaaatctttagttccttttactccagaacctgatactgcttgatatgttgaatatactattctttttatattatatttatcattaagaggttttaacggcaccattgcttgtatagtagaacaatttggatttgctattatacctttgtgttctttaacagcttctgggttaacttcaggaactactaaaggtacattttcatccattctccatgcacttgagttatctacaacaactacaccttttgatgcagctattggtgcgtatttttcacttacacttcctcccgctgagaaaagcgctatttgtatatctctatcaaatgaattttcatttagttcttctactgtatattcttttcctttaaattctactttagatcctgctgatctagctgaagaaaataaatataaattgtctattgggaaatttctctcttctaatacctttaaaaaagttcttccaaccataccagtggctccaactatcgcaacgtttacttttttcatatctatgcgcctcttttcacttaaaatttcattatccaataatatatacgtaattttagtatatattattttaaatatcaatgtctagtatataaacatagcattaatcgcaataatttttataatttaagcattaatgtccatataaataaactttatatgttatattatgactttcatatgtatttgtgatttaattgtagtatcttattctgttgcaaacgcttaacaattatgatataattcatataatttgaatacatcactaaataaaaaccgatagagacttattatctatcggtttttattttttatttaaattttatctacattcatctataaatctcttaaataaattaagcatatgagaactataatctaccatcagttctggatgccactgaacacccaatacaaatttttcattttccttttggacagcttctattaccccatcatttgaatatgctattacttttaaattactccctagagtttttatactttgatgatgataactatttactaatactttatcttttattatatcttttaatatagagttttcttttatatctatataatgagttcctaagtaaggttttgtttcttgattatgttttatatgacatccttttatatattttaaatcttggtataaactacctcctaatgctacatttaatacttgtaatcctctacatattccaagaattggtttatccaattctaatgctatctttgttacctctatatcaaattcatctaatattggatttatatatccaagttctttaaaaggctcttctttatatatatttgtatttacatcatctcctccagatataattatcccatccatagcacttacttgtgcttttatattttctttgtttgtatttgcaggaataacaattggtactcctcctgccttttcaattgcatttatataagcatttgtaagatttattctttcaaggccattaaatgctcctgaatctatagtggctaatcttcccaatactcctattaaaggcttcatttttacccctccgcattaactaaattatttaatttaaaatttggtctcatttctccaattatatcttttcgggcgtttaatagttttgggtttgcaaacttttctagttcttttaattctttttcatttattaacttaagctgtcttaaaacttccatagtagcacatgcagttgcttgacctgatccatcatcaacttttatagctatccccagtttattatttttatctccaactaaatatactccctgtgctcctgctttaccaaatattctatctccacaaactctcataagtgcagtacaaaatctatctcttcctgcaacaatttcagggtacttcatcatagacgatgttattttatttacatattcttctttttgacctaacttttttgaatctgctaatcttgaaaatccataagcaaatttctctagaggcatagcatgaactggtgctccacatccatcaatgccaattattatgtcttctttattgtaatcacaaacaaaagatatattttctaaaattctttgttgaactggatgatttatatctaggtatatatctaaatcttcatttaaatttttagcagatattaacattccactatgttttccagaacaattattatgttcttgagttaaaggttctttactttctattaattctttgtatatttgactattgccagggacatgtataccacagtttaacttatctacgcttatattagctttttttaatatttctctcgtacactctacatgatatggttctcctgaatgagatgagcacataaaagatatttctctatcacttatattaaatcttttatctgctttagtttctaagacttgtatagcttgtattggttttactgatgatcttgcatatattacttttttaggatttcctagagaatatataaggtccccctctgaatttactacagctatatgtacactatgagtacattcaatcaaactacctctagttacttctattgctttgttcaagttcaatctccccctaaatctattcttttatatatatatttatctataatttaattagtccttttatttttaaattaatttagggtttacatcatttttttcatcatcgtatctatttaagtttttaagagcaggaccttcaattacgtttcctttataatcaaatctagatgcatgacatggacagtcccatgttttttcagcagagttaaaagttaattcacaacctaaatgagtacaagttatatctactatatataactttccatcactatctctataagctccacatcttttaccatttatattaactatttttccttctcctttatctacagcaaaatctttttctccaaccttaagctttccttttatatactcttttcctacatttaaattttctgttacaaactgtgtagttaataaactaccttttctattaggtttaaatatattttcatattcagattttctatagcacattaaatcttttattataatagaagctaatgttccattactcattccccacttacaaaatcctgttgctacataaacattatcttctcttttatttacataacctatatatggcatactatcaaagcttatataatcttgtgctgaccacttgtatttaaattcacttaccttaaatttttctcctagtttagtttttaacttttcgtaaatagcttcttcatttttgcattgtccaactttgtggtctcctccacctgctataattaattttttaccttctcctatatatgttttaaatgtaattccattttcctctacatttaaatacatacctcttggtatttttgctttgtattcaccacctaataaataagacctttctcctttttcttttgcaaagtaaaaatttagtccatcataccatggaaaatgtgaagccataacaatatttaatgcacttattattttatgatccttagtttttaccttgtaaatattttctttttcataatctacaataggagtatgttcataaattttcactcctagttttagacatactttagttaattcatctaaatatttttttggattaaattgagcttgattaaaaaattctatagctccttttacttcaaaaggaatatctaatgtgtcgtgatacttacattttatacctaggttatcacaagtactaaattcttcttttaactcttctatataattttcattatctgcatatatatatgaagacaacctttcaaaactacattctattttattgtcttttattatttcttctattaaatctatagctttttcatttccttcataatataattttgcactatctaagccatacttatctcttatctttgaataaattattccatgttgtgaagtaattttacctgtatttcttccagaacttccacaacctattttatttgtttctactatagctgtttcaataccctttttagctaataaataagctgtagtaagtccaactatacctccgcctattataagtgtgtctacctctaaatcttcttttaaactttcaaaatctaatcctttagaacttaacatccaatatgattcattcataaaattttcaactagattatctagtttctcctttcttagaaattaatctaccttatatttgtatagttcccttttttttcttaattattataaacacttattttgactttaaaaatttaaggattattaattattagttaaatttaatatatcaatatgtttttgccaaataatctacaaagttataatgagattaaataaaaagttaattttaatgttaagtatatctttagttctataaatatagttggatgtagtcaaaaaaacttttataataaaaaaataaaagacgcagtaaataatataaacaatacaaagattggtcaatctataaatgaatttatgagtattaattgtatatactatatatttattttgtgtaaaacaaaaaaaattcttagaataaatctaagaattttttaatcaaaatattaatcatttaaagaaatattattttttaaactattaaagtagatataaagttcttcttcttttttaaataaaggtaaattcatattcttatgaacttttacaagccaaggaatatttaatccagcatttactatagctttatcttctttaaatacagttttacaatctccttctattactacatttcctttattaagcacatatatgtaatcacaaatttcatatatcaaatccatatcatgacttgatatagctattttaattcctttatcacataaatcttttaatatttttactatagcctttgtactttcaggatcaagccctgctgttggttcatctaaaagaactactttattttccatagctattacagatgctattgctattctctttttctgaccataacttaaaaaatgtactggcttatttattaaatctagggcattgacaagctctaatgctctatgtacttttttatctacttcgttttcatccaaaccaatatttcttaaagaaaaagcaacatcgtcatatactcttgaataaaatatttgcttatctggatcttgaaatactatacctacttcttttcttaagttatataagtcttttttcttataacttaattctttattatcataaaatatctttccatcagacggttttaagatacctactaaattcataaataaagtggattttccagaaccatttgctccaattattccaatcatatttccatttgagaaatctaaacttatattatctattgccttatttgatttatcgtacttgtatgctaaattacttaccttaaacatagttctctcctatatatgaaatttcccatcatacaactttatatctaaagttatactcatctcctcgtatcttttcatcattctaaaaaacaagacttttataagtagtgccgttgaattatacgagttttttaaatttgtatacccaaattttaattgctgtgatttatatatattttttacttcttctaagaaaataaatataaatctatacattaaaaccataagttctaataatgtatctggaatatgcaattttttaaatataattattaactgattaaatggagtagtaagtattaaaaaataaatagatataactgagctcatagctcttagtaatatatgtatagaattctcaattgcaaatttagtcgtgcctatataaaaactaaatatttttatatcaaataaaaaatctttattttcaaaagatatattaactaaattaagtgtagttcctataattaaaaaatatataggtatctttaagcactttatatacaatttaatatcaactcttgctaaaaacacaattaacatgcttataaataacattattaataaatgtagactaatactattagttattaaagaaattgccataaaaataaaagtaacacctactttaatcattggattagcatttgttagattgctattataagcacatttatcaatttctagcatttaccttttttaccttttctcgaacctaaataatatcctataaatccagctcctattgctgcttgtgtagagaataataaactttctatttctccactaggtggttcgtataaactactaaaccatggtttataatctgggtttatttcagaaattaaattttctgcttctccatcagctcccccatactcagctttagagtttaacagtaaaggagttattataagtattattgttaaagcaagtaacataaagtttttagttttagttttcgtatttgcactcattatcttcaactccttcttcattattttgtgttattaaattatatactaaagtagttaataatccttctgctatagctataggtatttgagtcgtgaaaaatactcctaagaatttaactgcagatccaatcactcctcctgcaggatcaggaaatgctagtgctaattgtattgctgtaacagtgtatgtagctaaatcacctaatgccgctgctaaaaatacactcacaccaatacttaaatttctttttctacaaaacttaaatattaaatatgaaactataggtccaactattgccattgaaaaagcattagctcctaatgtagtaagtccaccatgtgcaagtaataaagcttggaataataatgctattgttcctattacagccataacagctggcccaaataatattgctcctaatcctactccagtagggtgtgaacaactacctgttaatgatggtatttttagtgctgataatacaaatacaaaagctcctgctaatgctaataatacctttttctttggatcttttttaactatttcattaattgcctttaatccatatacgaaaaatggaataaatactatggtccaaagtattgaccattttactggtaaaaatccttccataatatgcatagcgcttgatgtagtcgggtttaacagtacaattaaaacaccggctactacggatagtgttaaataattcattttagtacctcactttttattataaataatataaatttttgtgataaattaatttataaatttaaatatagtttttaagtttatcaggtacaaaaaaaatcctaacttttggattaggatttaaataacatcttaaataatacctaagcctataaaaaaccaagatattacttttttaattattttccttcatcccgaagaaactaatttaattactgtaggcaggtctcctggcttggcttcattttactcctttcccttcccataatatatattacagtggtatttgaaagtttcatcagcttcacagtagcggggactgcagaggattttaacctctttcccttttaattttatttctaaaaacctacaataggcatatttaatttatcacatatgtattaattctataaatatctttgatattcctctaatttttttaaatttataaaattaactaacatcaccttattctaacaaatttcaacaaaataatctagagagtttatttttttataaactctctaaaaaaataatactatttaataagattcatatattatataaataaatgtaaattttataatttattgctcattgttaaaaaactgctcattttgagctatatactcattattagggttaatcttataagcctcattatgatgttttatagcttcttctattttgttcattttataataacaaactgtaagttgaagatgtggtttccaagtccaatattctggagaaataaatccataacaattttttggcatttctaaattaaatatgctttcataccaacttattgcttcttcatatctaccttcctctttaaagcaatctgctaatttataaacggcttcagctctaggagatgtatattcaaaagttttatatatactttccctagcatttttgtaatcacctttaaaaaagtaacaatcagataccttacacatagcatctattttttcttctacccacacatccatattactaaattcagtaagaatttttatagcatcatcgtaaaacttattataataaagctcttttccgtaataataaatatctcttgttgataatttatgaccttcatctaatttttttctataaattctaagattcctatctcctgcatcatgtagtttttgatgtgttattgctacttcactttcatatacattcccactaactcctaagtattcatgtataaatccaacccatttaaaattattttttcttttaactaatctatttcttttatatcttaacaatggttctccactttcatctaatcctctgtggtctgtcattgtaactgtgtctatattagaagttaaatttttctttatatctaataacttgatttgatcttctttaaataatacctcatctgcatctatccaaaatatatagtcttttgtagctttactaaaagaataatttctagcggcagcaaaatcatctatccatttaaaatcatagattttatcagtgtattttttaactatttcttttgttttatctgttgagcctgtatctactattataatttcatctactatgtcttttacacaatctaaacatcttcctataacatcttcttcattttttaatatcatgcataaacttatagaaatcattctttgcctccatcaaataatttttctatttcaggcataacaatagacttatcaaaatcaaatttttctacttcctttaaatttcttatatataaatcccttatatctttatttaatatcataagtctaagtccatagtataatccatcttcactatttgaaaccataagacctaatttatctttaaataaagcccttgatccatgattatctgttgcaactactggttttcctaataccatagcctctatgattgcaaggcctaatgcttctgcataagacggtgatacaaacacatcacacatttttacccatggataaggatttttttgatattcaattaatttacagctactttctaacttcaaatctttcactagttttcttaaattttcttcttcttctccactacctagtattattaactcatggtctattctttcatctattagttttttatgaactttaattaatctatcaaatcctttttctgatcccaatctacctatagacattatagtaaatttactttttttgtattttatatattctaacgataattcacgtattttagatacatcattaggaacgtatattctttgtagttttgaatttagaccatttcctacaaaatctgtaaatgatttacttactccatcagatacacttataattttgtccattcttccatatatatcagttacataatcttttgaatttccgcataccatcaaagaaaaatcaccatgaagccaagttattttctttgcatttggagttccaaatctacaaattacccatgttgtaaatatacctaaaaaacctatttctacatcatattttttttctaattctaaattaaaatttccacttaagtattccttatacatttcatctacagtatcatacatatacactacattcacattttcatttatatcatataagtaacttttttcttttgctaagactactaaatctacattatattttgaataatctagattatctagtatcgacattaaagccttttctgctcctccatcagataaaagatacattacaaataaaatatttttcttattatattctttatatgaaattttctcttcaaattctagttcctttaaaataatttcatcacctattttaaattttttaattatcctatttttatcatctattaaattgcctctttcacaaagcataatagctttattaaacataaattttatatgattttttatattatctgctacatctgatttaaacaaatctttattatttatataaaatctgcacatttctcttagtatagattctgtatcttctaatctttttttacagttatccgataccactatataattatctctaattcttcttaaacatagttttttaggtatatataaaaccctcttagctaataaaaacgattgaatagaatacaatttactctcatctaatattccttcataaaagaaaagattattttgaattatgaaatctcttttatacaaattcgatatatcaagattattatagtctgctgttgtaaaatatttttttaaaaaatcttcacctttaatacattcagattctatatttttacagctctcattaaaatcatttatcctacatcccttatcctcaaataattttgtatcaaatttgaccatatctaaatcatattctttagctttttcataacaaattttcatagcatcttcatctaaataatcatcgatatctaaaaagtatatatactctcctttagcattttgtattccaatatttctaatagcagatatgcctatatttttttcatttgatattatttttacaaagtcatatttttctttatatttatttaatatatctaaacttgaatctgttgatttatcatctataactattatttctatatcatctaatgtttgatttatcgcacttaaaatacattcatctatatacttttctacgttatatacaggtattattatacttaccttcatgattaccccctaaaactatctataatttaaataatttttgtacgttaaaattataatatctatcatatttttatttcatcaagcaacctttctatttcaggcataacaatagacttatcaaagtcaaaatgttctactttttttaagtttcttgtatatatttctcttatttcttgatttaatatcataagtctaagcccataatataagccctcttcgctatttgaaaccataagccctaatttatctttaaataaacttctaggtccatggttatctgttgcaactactggtttttctaataccatagcttctataattgcaatgcccaatgcttcttgataagatggtgatacaaacacatcacacatctttatccatggataaggatttttttgatattcaattagtttacaactactttctaggcctagattatttattaaatttttgagattttcttcttccgctccactacctattattattaattcatggtctattccttcatctatcagtcttttatgaactttaattaatctatcgaatcctttttctgatgataatcttcctattgacattatagtaaacttactttttttatattctatatcttctaatgataatttgcgtatttgatatatatcaataggaacataaattctttgcagctttgaattcaatccatctcctataaaatctataaatgatttacttacaccatcagatacacttataattttatccattctcccatatatatctcttgcataatctactgtatttgcacctacaactactttaaaatcaccatgaagccaagttattttttttgcagttggacttccaaacctacaaattgcccatgttgtaaataaatctaaaaagcctatttctacatcatatttcgctcctaattctaaattgaaatttccgtttgcatattcctcatacatttcccttaaagtatcatacatatatactacatttaccttttcatttatattgtataagtaactattttcttttgccaataccactaaatctacattgtattttgaataatctagattatctaatattgacattaaagccttttctgcccctcccccgtataacatatacatcaaaaataatatattttttttattattagacccttcatatgaaatttcatcatctactttaaatttttcaatcattctatttttatcatccattagattacctctttcacaaagtataaatataatcatctttaaatttttttaatacagttttttagatatttataatttaaataacttttatctaatgtacaatttaagcacctgcttagttttttatttcgtcaagcaatttttctatttcaggcataacaataaacttgtcaaaatcaaatttttctacttcctttaaattttttgtatataattctcttatttcttgatttagtatcataagtctaagcccataatataagccatcttcactatttgaaaccataagtcctaatttatctttaaataaagctctagatccatgtgtatctgttgcaactaccacttttcccaataccatagcttctataattgcaagtggtaatgcttctgtataagatgccgatacaaatacatcacacatttttatccatggataaggatttttttgatattcaattagtctacagctattttctaactctaactcctttactaaacttttgagattttcttcctccgctccactacctattattagtagttcattatctattccatcatctaatagtcttttgtgaactttaattaatctatcaaatcctttttctgatgataatcttcctattgacattatagtaaatttattttttttatattctatatcttctaatgataatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgacattatagtaaatttattttttttatattctatatcttctaatgataatttacgtatttgatatatatcagtaggaacatatattctttgtaattttgagttaaaactatctcctacaaaatctgtaaatgatttacttacaccatcagatacgcttataattttatccatccttccatatatatcttttacataatctactgtatttccacctacagttaaagaaaaatcagtatgaagccaagttattttctttgcatttggatttccatatctacaaattacccatgttgtaaatatgcctaaaaaacttatctctacatcatattcttttttaaattctaaattaaaattcccagataaataatctcgatctaattgatctgggctatcataaatataaattacatttacattttcatttatgttgtatatatactctttttctttcgctaataatactagatccacgttatattttgaataatctaaattatccaatattgacattagagccttttctgcccctccatcgtataaaaaatacattaaaaataatatgtttttcttattattaggctcttcatatgaaatttcatcatctattttaaatttttcaattattctacttctatcatctattaaattacctctttcacaaagtataatagttttatcaaatataaattttatataattttttatatgatcggatatatttgatttaaataaatctttattattcatataaaatctgtacatttcgcttaatatagtttctgtatcttctaatctttttttacaattatccgatatctgtatataatcatctctaatttttttgaaacatagctttttaggtatatataaaactctattagctaataaaaataattgaaaagagcataatttattttcatctaatattccttcacataagaaaagattattttgaattatgaaatctcttttatacaaattcgatatatcaataaagatgttattaatcagtatatatgtaatgatatgtttaacttaatagaatatacgtttaattcaaataaataaaattattaaaataccttttgatattaatgtcaaaaggtattttttatttataaaaataggaagtttaaagtaaaacctaaattaaatgtaatatataattagtaaaaataagagtataaaatttaattgtttcatggtgtaaaagcttcgtttttacatgtatattgataaaatcaatattagaactttttggtattgatattatcaatttgtagaaaatttatatatattgtaagatgattatgtaatatttaacaaataaagaggtggagttatggagtataaaataattaaagatcaaatgaccccaaaagaaaggatggaagcttttgcaaagggagaacctatggatagaattttatgttctccatttttaggtgaaagtgtttcttctatatttggacatacgatatatgagtacaaccattcagtggatgcacttgttgatgtagcagttggaagttttaatttatttagacctgacagcgttggatttggaccaggtcttcaaggtataccagaggctatgggaagtgaagttacttttcctacaaataacacaccatatataagcaaacctgctataaatgactatagtgaaataggcaagttaaaacctattgatacatataaagatggaagaataagatacttcctagaagctcttaaaataactcaagacaagttaaatcctatggtaagtgttggaactacttgtggagggccttttacaactgcatcttttttaagaggcactgataaatttttaagagatttaacaaaaaataaagataaggctcatgagcttttagaaatagcaacccaaagtgttataaattatatagatgcagcttgtgatataggacttgctccaggtatagcagaacctaatgcatcttctactatgataagtgagaaaaattttgtagagtttgcaaaaccgtatttaaaaagatgtatggatagaataattgaaagaactggaagtgggactactcttcatatttgcggaaaaactaaaaaagtgtgggggcatatggttgatactggaatatctaatttaagtttagataacatagatgatataggagagttaaaagatgcctatggagataaggtttgcttaataggaaatgttgatccagttgatacaataatgagaggaagtatagatgatatatataatgaagcaagaaaatgtataaaaaaagctcatgatagcaagcgtggatttatattaagtactggttgtgatgttcctataggaacagaccctaaaaatattatagcacttatggatgctgcaagaatatttggggcatatccaattaacatagacaacttataagggggaattagttatggaaaattcaaaagaaattttattagataaattggcaaaatgtgttttagaaatggaagatgaagaagttgttgatgtagcaaatgaatatataaaaggtgaatttgatgtttatgaaggaatatctaaagggttagcttcaggaatggaagaagcagggaaattatatgaagaagaagagtattatataccagaacttttattatgctcagatgctatgtatgaaggaataaatatattaaaaccacatttaaaaaaacatcaaacacaagaacattatagagcagtagtaggagttgttgaaggagatactcacgatatagggaaaaacttatttaaaataatgttagaaacatcaggatttgaagtttttgatttaggaagagatgtaccacctgtagattttataaataaagcaaaagaagtaaatgctgatgtagtgggtatgtctacacttatgacaactacaatggataatatgcaagtagttatagatttattaaagaaagaaaatatgcgtgatgatgtagttgtaatggtaggtggaggtcctatatcacaaagttttgcagataaaattggagcagatggatatgcacatgaagcttcaaaagcagtaaaacttgcaaaagatttagtagataaaaaaagaggtattcacaaagaggtggtataaaatgaatccaaaagaaagactatataaagttttacaaggaaagaaagtagatagaccaccttgtatatgtcctggtggaatgatgaatatgataattgaagatgttatggatatagaaaatgtatcatggccagatgcacatacaaatccaaatatgatggcagatttaacatatggtatgtataaaaataaagcttttgaaaattttggagttccattttgtatgactgtagaagcagaaggtatgggagctagtgtttatatgggtactaaaaatacagaacctagagtaactaagtatccgataaattcttcaaaagaatataagaagttaaaaaatataaatgtaaatgaaggtagagccaaagtagttatagatgctattaaaatattaaaagaaaaagataaagatgtacctataatagcaaatttaacaggacctgttagcttagcatcatctttacttgagcctatggtttattataaagaaattagaaaaaatccaggagatgtccataacttaatgaactttgtaactgataatcttataacttttggtaaggctcaacttgaagctggagcagatatattaactatatcagaccctagtggaacaggtgaaatattaggtgctaaaaattttaatgagtttgcagctttttatttaaataaaattatagatgaattaagtaattatgctgaaggtggaactataatacatatatgtggaagattaaaaagtatatataaagaattaaattctctacatagtaatgctattagttttgattcaataacaaatgttaaacaggttaaagaaaatgtttcaaataaagctattatgggaaatgtaagcacatttgcacttgaaaacagtgatagagttagtttagaaactatgtgtaattcttgtttagagagtggagtagatatattatctccagcttgtggaataggagttagaactaaacttgataatataaaagttttattagaatgtgcaaaaaattataatagataaagaggtaacttatgagttttttatacacgggtgacaaaagctatgagtttgaaataggaaataatcttttagatataatacaaagtcataacttgggaatggaaagtccatgtggtggaaaaggtttttgcgggaaatgcaaaattaaaatattaagtggagacataaatgatttaactaaggaagaacttaagtttttaactaaagaagaaatagataaaaatataaggctcagttgcttagtttatcctaagggagatttatatgtagaatttttagatactaaaagtgttaatcacaaaatattagtagatgggtatatgcctgaatttaaaaaagagccaattctcaataaaagtacatatgatttagaaaaaccgactttagaaaataatttgtcttatgaagatatattaataaacactataaattgtgatttaaaagataactatgaaatattaaaagatattccaaacttatttgaaaaaaataaatttacaaaggtttgtttaggagaaaagttaataggtttagaatgtgatgatactaaagataaattatattcaatagctatagatataggaacaacaacagtagtttgctctttaatcgatataaaaaatcaatttgaagtaagctcggaaagtgaaataaatccgcaaaaggaatatggtctagatgtattatctcgaataaactttataaaaacaaaggaaaatgggttagatatattacataaaagtattataacttgtattaataaattaattgaaaaattatgtgaaaataataacgtaaatagagagaatatatatgaagtttcaatagctgcaaataccacaatgatgcatatacttttaaatattaatcctatatcaataggaaaatcaccatatgcaccagtatttgtaaaaggtaaaaatattgatgcgaaatcattaggtataaatatatcaagttttggaaaggtttatttattacctggggtatcaagttatatcggtgctgatattgtagctggagtatgtgtttgtgatttaaaaaatgtagataaaaatatattatttatagatataggaactaatggggagatggttttatctaaaaaaggaaagttagtttcttgttcttgtgcagctgggccagcacttgaaggaatgaatataagttgtggtatgagagctggagatggagctattgaaaatgtaaaaattgaagaatctataaatttaaaagttataggagataagattccaagtggaatttgtggaagtggtatagttgatgctataagtgaattagctagattaaatattataggaaaaacaggaagaatagttaaaaaagaaaagattttagaagatgataaactaagtcatttaagtgaatgtataatagatgaaaataaaaaaagaagatttgtattaaataaaaatacaaaagaaatagctattactcaagaagatataagacaagttcagcttgcaaaaggagctatactttctggcatttatgcattagcagataaagtaggtattaaaataactgacttagatgaagttataatagctggtcagtttggaaagcacctaagtattgatagtttagcaggtgttggcataataccaagagaactaaaggaaaaaataaaatatatagggaactcttcaaaaataggagctataatgagtttattatctaaagatattagagagagtatggataacatagcaagtgatatagattattttgaattatctacaaaagatggttacgaaagattatttacagagtgcttaaaattctaaagggtgatgatatgataaaagtagatataatatcgggttttttaggttcaggcaaaacgactttaataaaaaaacttctagaatctattaatgatgaaagagtagttgtaattgaaaatgaatttggacaaataggaattgacaaagaaattatacaaaaagatggatttgatataattgaacttcaaaatggatgtatatgctgtagtataaaactaaattttaaagatactttattaaaagttataaataattttaatcctactcgtataataatagagccaacaggggtaggtttattaagtgaaataataactatgataaatgattctaagcttaatgaagttttaagtttaaattctttaattactgtagttgatggagtgaattactttgaatatatagataattttggagagttttttgaagatcaaatagaaaatgctcaaattattattataagtaaaagtcaatttatagataaaaataatttagataatataattaaatctttaagaaatattaataaaaatgctcatataatacatgaaaattggagtaatatatcttttttaaaactatttgaagtgttaaatttattaagtgatgaaatttcggataacttagattgtaaaaatagaaaagatataactgaaaatatgaaatcaattgaatcaatatctataaatcctctaaaatcatacagtatagaggaaatcgaagatatatttaaaaatttaagcgaaaatacgtttgggaatataataagatgcaaagggtttgtagatagtggtgattgtttattggaatttaattatgtaaataaacaatatactataaaacaaagagttaaaaatacaaatcctaagcttactataataggtactaatttaaaaaagaaagacttattaaagacatttgagtagaggaagttataatgaaaataaattttacttgtaatcaaaatgataatgaaaatatacccatagctttaattaaagctttaggtataaactttccagattttcacacaaataaagaggatatagcttatatatctaaaggtttaaaaaaatataaaaatgatagtatatgtaaagtaccattttgtactactgttgaagctgaagcttttggaggaattataaacttaggagatttgaaaagtactccaagagtaaaaagttatgcttataatagtttagatgaattatttaatattaaaaatattgattttactaaaggaaggataaaagaagtattagaagctgtaagtatattaaacaatgaaggtgaagtagttgctttaaatatttgtggacctattactattatatctttacttatagatttaaaatatttttataaaggtattagaaaaaacaaagataaaatcaatgattttatgaaagtaatagaagataatattgttaattatataattaaaggatatgaaaatggagctaagataatatcttatagtgaccctgtaggagatattaatatagttgggcctaaggtttatgaggatatagttagtgtaactactttaaatataataaagagagtttcaaataaacttgatgattgtgttatacacttatgtggaaagacatctactgctttatgtaatattggggcttatgactttaatgaaattaaatataataataaaattacttatggtcaagctatatgtaatttattagatactaaaggcgttaaaatcataggcaacaattgtatgaaaaaaactccttgtaaagttaaagaatcaattatttattcaattagcttaagtaatatctaaattaaaggctgtagataaacttgttgtaaacaaatttatttacagcttttaattttttaaagtgctgctatttcattagcgtatttttttgcgttatcaatatttctaaatatttcataaatgttcataaagattagtttatcatctcgttctgataagttatcaaaattttttattatataatctttacttaaatcaccatttatatatctttgcatttcgttacatacattacttatatccaaattttttattctattattttttatactacttttaaaaacacgtaaattactcattacaatacgctcactatttaagaaatttcctatactagcagataaaatcgtattattatttatattaattttatcgtttgtaagtctattagttaaaatggtttctcttaaattatggctatctaaattatttatatttaagttttctaaaatagtagctaaactattatttaattcaactgatttttttactagatttttagtaacatctttaattttataagggaatattattctatttgctataaatgcaataacacaacctattaatataaattttaatctatcaaaagatagtatattaaaatcattatttgtagcccccatacttagtgcaaatacagtcataaatatcatttttttagagtagtctttaaagtaaaaacctatgtatccacaagtaaatgctataagcattttaacttccatgctaggtacaaggtgaaataataattcaaatattaatatacctattaaacttccttttatcctatctatcattttagtttcactagattcaatataaggttgtacgacagatgaaagtgtaaataccatccacttacctttatataaatcaaaatagtctactacaaaagctcctaagctaacgagtaaagcaatcctaaatgcaaaagtaaatctaagggaatttctattaaaacgtcttttaataacttctctttcttttattttttcattaataccatactttttatcgctgtatgataagcctccattttctaaattatctaggatatctcttaataaagtcatattttgtcttagttcatatgaaatatagtgtgaataatgaatatcgtctccttcatatataaattcattaagttgatttttaagttctttagtacttttttcttcattcataaattttaatatgttattaaactgaagttttaattttactaaaacatcatcatacttacctaaattatctatatcttctatagacttttctaaaattatattagttccttcaagcgtttgaactatacataaataaagcttacttttatcagaaattaaaaaggtcttttcttttctagagtataagctttgagaaagagcttgcagttgcttatttaaatttttactactttcttttaataagttcatatcttttttttctaataaaatgtctatttcatcaattaataaatcaatatttttacatatagaagatttcgacttattccaaaacttatttttgtttactaacatctgaactaacattataagtatgccagaaagtattaaagcttctattctattaggcatatcaatttgttttactggcatataaagcataaataaataacagaaaataaaaggcatatatattggtttacttgtatcaaatgtaaagatatatactataaaaaatactactatgaatgtgaaaattaaggttagaggggcagagaaggatgatataaaagccgacaatccaataaataattctattaaaataaatcttaaagtatttcttataggatttgctgtatagtcatttcccatcaaagttactgctgccataaaacctgtaataccaactagcatatttgaagttccaaacatacacttaaaaaatatagcagttggtattgcacccataaaaactaatgtcttagatattatacttttcatttttttaccacctcaaatttattcactataataaaaaatttacccttaatatagaaaataaaacttacaatataaaaatttatcatttgaaaaaaaaatatacatataatgttgtattagaggaagtaattaaggagggatatttatatattgtgaggttatttttaaatatgataacaacattttagtactaggtcaaaggctagatgtgattatagaaattttaaagtattattacaaaataacaactttaaaatcaaatgatgaattaaatatgttaaaaagatatgtaaagaggatataaaataataataaataataataaatttaaattaacagttaattatgattttttaaaaaaagcctactaaatttataaagtatataaaaattaggtatcttaaataaaaaaattatttgaagatacctaaatattaaatatgagatattaaatcacttaaaaacatttcaaacataacaccatcatttctatcgacattaaattttgatgtatataaaatagatttatgtataaattggctggcaatatcaacgctatattttaaggagtgaccatttaatatcatgccagctagtatagatgtaaataaatcacctgtaccactataagatatattgttaaaatcagtagatgtaaaataaacttcatttgaatttttatcaaatgctaaattatgaattttattatctaaaattataccggttataacaactttactaggacctaaatcagataccttcttggctaatgatataagttcatctttacaaaggttaatttgagtatagtctgattctgttaatatcagagcttcagttatattaggggtaactatatttgagtgtttaactaaattttttattttattacacatggttttgttaaatattggatatagacatccattatcacccattactggatctactataactaatgaatttttattatcatttataaagtcagatactatatcaatctgatcttcagatcctaaaaagccactatatatacaatcaaaatctacgttaagttcattccagacttttttataagaaaccatttcagatgttaaatctaaaaatgaatattttggatagcctgtttgacttgataatatagctgttggaaaaggacaacattgtatttttaaagctgataatatgggaattgcaacagttaaagaacatcttccaattccagataaatcatgaatagcagcaactttttttatcatacaaaaacctccattaataaaatttataattatatattactatggaaatattatatttaacatatttatacaaaataaaaaaattgtattagtacaatttattatatgattttaaataaagttataaataaatatatatatggttaatataaatctaaaatataaaaaaggagaatttatatgagttttttactgcttataattggatttatagtacttataaaatgtgcagatttttttgttagtggaacatcttcaatagcaaaatctttaaaaataccgacaatagtaataggacttactattgtagcatttggaactagtgccccagaggctgcagtaagtgtaacagctgcattaagtggaaataatgatattgccatagccaatgtagttggatctaatatatttaacttgttagctgtagttggtattgcatctataataagacctgttaaagttcaaaagaccacaatattaaaagaatttccttttattttattatcgtcattagttcttttaatattgtctcacgatgtgaggtttcaaggatatagtgaaaatgaattaactaagtcagatggacttatgttacttgcactattttcaatatttatgtattatcttttagaaatggctataacttcaaaagaagaaatgaaagtagaacaaggagattctaaatcatctatactaaagagtgtattaataagtttaattggtataataggaattattttaggtggaaatctagttgttaagagtgcaactaatatagcattagctcttggaatgagcgaaaatttagtcggacttacaatagtcgctgtaggaacatctttgccagagttagtaactagtgtagttgcagctaaaaaaggtgaaagtgatatagcaatgggaaatatagtaggatcaaatatttttaatatattatttgtattgggaatatcagcttttattaatcctatagcagttcatcctgtagtatttatagatatgtttataatgtttataatatctataataacttatatatttgctattactaaaaaagaagtgaataagattgaaggaattatattaggtttaatttatataggatatatggtatttataataataagaagataaatatatagtaaaaagctataattaatataaaatgtatagttttttactattgtacataaaaagagggtatatgttaaaatttcattgtaaatcattatagttattgggggaaagacaatgatatcattaccagaaaaattcgaagaatttagtgaagctagaagaaatggatttataagagcaaaagagttaaaagaaagtggtaaaaagttagtaggtgtattttgcgcatttacgccagttgaaatacctatggctgctaaagctgtaactgtgggtgtatgcggagtaagtgaagagccaataccagaagctgaaaaggttttaccgagaaatctttgtccacttattaaatctagttttggacatgctataacagatacttgcccatacttttatttttcagatttactaataggagaaacaacatgtgatggaaagaaaaaaatgtatgaagaattagcaaaaataaaagatttacatttaatgcaacttccaaatagtagaaatggcaaatatgcatatgaactttggaaaaatgaaattaaagttttaaaagaagatttagaaaatagattctcagtaaaaataactgatgaagatttaaaagaagctataaaagataaaaatgaagaaagaaaattattaaaagagttttatgaattaggtaagttagttccaccaccaatgaatgggtatgatatgcaccaagtattatataactctggatttaaatttgatagagatgaactaaaaaatagtataaaagatatgatagtatcaataaaagacaaatatgaaaaaggagaaaggccagtaaatgaggataagccaagaatactaataactggatgtccaataggtggagtaagtgaaaaaatagtaaaaactatagaagatagtggagcagttgtagttgcatttgaaacttgtggagggataagatctaatgatgaattagtagatgaaaataatcctgatccgatagatgctatagctaaaaaatacataaatatagcatgttcatgcatggttaataatgatgcaagaatagatcttttaaataggttaatagatgaatataaaatagatggagtaatagatgttgtattacaagcatgtcatacatttaatgtagagagctatagaattaaaaaatttgtaaatgaagttaaaaataagccatatatggctatagaaactgattattcaaaatcagatacagagcaactaagaacaagatttgaagcatttatagaaatgatagactaaaattagggggactttatgtacagtgtaggtatagattcaggttctgtagcaactaaaggggttttatttgatggaagtaatatagtaaaaaaaattataataccaacaggatggagccctaagtgtgcatcactcgaagtttataataaactaactaaagatatagaaaaaagtgatataaaaaaagttataggaactggatatggaagagttagtatggattttgcagataaaaaagtaacagaaataacatgccatgctaagggagttcattttttaaacaacaacataaaaactattttagatataggtggacaagatagtaaagtaataaatttagataatgatggaaatgtatctaattttataatgaatgataaatgtgcagctggaacaggtagatttctacaagtgacatctaatttgttaggaactgatgttggcagtatagatgatttagcaaaaggagctgagcctgaaataatatcaagtatgtgtacagtttttgcagaatcagagataataagtctattagcaaaaagtgtatctaaagaatctatagcagcaggtatattacaatctatatcaaataggtcaaaatcaatgttatctagaattgatatattagatgaaattgcatttacaggcggggtagcaaaatgtagtgtgcttgtaaatatgattgaagagagtttaaataagaaaatatatatagctgaggatactcaaataataggagcattaggagccgctattataggatataaaaaataaaaggatggtttaaaccatccttttattatgcaattgattcttctttttcaacttttacatctgattggtttgataattttgttataccaattcccgtagcagctaaagttaatgatattataggacatatcaagttaaaaaatgcgtatggtaaaaatgcaaatgatccaactgcaagagtagcactcatgtaagctccacatgtattccaaggaataagtggagaagttatagtggcactatcttctaatgcacgtgataaattttcaggagctaaaccttgttttttgaaggcttctctatacatacttccaggcattactatagctaaatattgatcagcaactgctagattagttcctatacaagtaaatatagttgcagcaactaaccctaaagttccttttgcaaactttaatattgcagtagctaaagcttctaacataccagttttttcaagtataccaccagtagctaaagcacataacataagtgatactgtacctaacatactattaagtccaccacgagataataattcatcaacaaagaccataccactattagatgtataaccaacttgagcaacctctaatacttctttaaaagaagctccttggaaaactatagctactaatccaccaagtagtgtacctattataagacctggaacagcaggtacttttaaaattaccattattataactgctgctggaattaataataataatggtgataatgtattataacttgctgataatgcttgttgaatttgtgtaatttgactactatctatagcttgacctgcatatttaaaacctataactgcatatataataagcgatattaaatatgcaggaattgttgaatataacatatgctttatatgagtaaataaatcagttcctgccatagctggagctaaatttgtagtatctgaaagaggagacatcttatccccaaagtatgctccagaaattatagcaccagctattatttctttaggaattccaagtgcactacctatacctaaaagtgcaatacctatagtacctgcagtagtccaagaagaacctgttgatatagaaactatagaacatattatagttgtagcaactaagaatattcctggtgataatatatttaatccccaataaatcatgcttggaacaacaccagataatatccatgtaccaattaacatacctacaattaaaagaataattatagcttgcattgtagaatttatagtagataatataccttcttcaatttctttccatgtgaatcctagcttaaaaacagctacaaaaccactaaatattccgcctaaagctaatggtatatgagccgaaacacctaatttagttaatgatatgcataataaaaatactaaaacacctatgcataaaagtgaatcgcccaatgaagcttgtcttttctctctttttaacataataacctccaataatttataagaatataacttaaaatggagcatagtactaaaaaaggtctagaagacaaagagatacttctagacctgagattattatataaatataataacgtaatctaaagatagctctccacataaagtgacagtgttatgcatattatacataaccccaacacataagctcaaagcaaaacttatatatttcggcattattacctttcctattatctcacaggtgcttttcctcaataatagtaatatttaataatgcgacctctaccattagttatattctgtttatttaataaatttattatatcatataaaataaaaatgtaaatattaattaaaacaaaaattaaaattttaaaaatataaaaaacagtctatcatttgatatactattttttagtttaaaaagttaggaccgtaagtttcttctatttctcttcttaattcattaggatcattaataccttgattcattgctctagcaagtatattagctttgtcatatggagacatccaagagaatataccacctaaacagttatctacgacatattgagattttatatatatagaaagaatatcatcatatgacatagcaaattctccatcttttactagatatggaacttgagcatctttatcaaatctgaattcatatccatttttattaatataatctcttctaagttgatcataagatcttgtaattgtagctcctaaacgtccgtaaaaaggaactccaagcattattttttgtgaaggcattccagcattagttaaattttgaaccatagcatctacactataaccaggtattgataaattagagtcatatagatttgattgatgtttttgagcattagggcctgtttcaccagcagtaaagtcataactcattaagttaaagtgatttattaaaggtgcgattttagctatttcaacacttctatttatatatgctctatcacctgtaccagccacacttagccatttatcaggacctataatatctctaatagcagtcaaaagaagtgtaaagttttctttatcttcaggtctagatttaattccagcggcactatttgcaggatattcccaatcaatatcaataccatctaaatcatattgattaataagtgcatttacttctcttgcaaagttatatctagaagttggtgttaatgaagcatctgaaaatccatcttgcccccatccaccgatagcaactataacatttaaatctggattatcttttcttaaagctagcaattgtcgtaaatatttaggagttggaatgaataaagtaccatcgggtcttatttcagcaaatgcataaataacaaaatcaagtaaaaaagcatcaacatttgaaggatcacctaatacatatgtgcctactaatctaactaaatctggacagttaggattttctgcaatattactagatggagctgaaatttgaggtctagattgtgacttacaaatttttttcttaaaagtcataggttcatataaattagaattttctgcattaggatttttatctggaataaagcaaagataccaatctataaaatcttcattttcagaacaactattaatgcgttgagttaattccttgtatgtttttggaggtggaagtataacaggcataccaggaagccaatttgcaggtgttacaatattttgttcatcagatgtttgtagtgcatctataattcttattatttcaggaatatttcttccagtagtcaatggataatataatatagttcttaatatctgattagggtcaattataaaaactgacctaactgtaactgaatcactcataggttcagagatcattccatataattgagctatttccatttttctatcatctattataggaaatggaattttgattccagtatttctatatatgttgtcaagccaagacaaatgagaactgttactatcaacactaagtcctattaattctgtatttcttttttgaaaatttgaatagtattttgcaaaacataaaaattctgtagtacatacaggtgtaaaatctccagggtgagaaaaaagtacaacccattttcctttgtaatcagataattttattggtccgcttgttgtattagcactaaaattaggcgctttagagcctaagctaggaagacaaggcaaataaatcactcctttaaaagttagttttaatttaatttattaactaacttataggaatgttactaataagaattgctattttaatacaaatttggtatatttattatattagaatatatgtatgatttgttgatattagggggcaaaaacatgaaaaaaagccaaaaaaataaaaaggtgccaagatttgttaaaacattttcggatattttaagaatacttgtgttatcatctgtaatatccctaagtattacgagtgtattattagtagtaaactcaataacaggagtattcataggatttagatattatattgcattagctttaggaatgattattacattgacaccatgttgggtcttatgtgactgtaaaagaatttttggtaaaaaagtttatagatctaagaagattagaccagcaactaaaaggtcacaaagaaataaagaaacaattagaagaagaaaaatatcttaaaaagtacggcgtatgttgtacttttttttctttatcttaatataattaataatagggtagaggagggattatatgaactacgatgttttttgtagtagtgtagtaggatataagaataaaattaaaaataaaggatctcaagattatttaaagtataaaaaattggaaaatggaattatttgtgcaataggagatggacacggaatagataggtgtaaatatagtcacaaaggatcagagtttgcttgtgatgcatgtattgatatattaactgatttatatgatgaaatagcaaattttgatgaagaggaattaaataatttaattaaaaatattagtaaagaaaactatatacaagtgtctatacaaaatagatggagaaagtacgttataaatcattttagaaaaaaagtacctaatgtatataaaatagattatgtgctttatggaactactcttataggcgtactaattacaaataaaataaaactttatttacaaattggagatggaaatatagttgaatatttaaatgaatttaatattgtagattataataaggaaaacaaagtaaatggagttttaaattcaatgtatctagatgatgcatataaatatatagatttaaaaattagctttaacaatttagaaaaattagattcaattgtgttattttctgatgggtttaccaacagctttaacaagagtacaggggtagccgactaaacacttgggttaaagtcccaactgcatatattgatgtctgataccatcaagaagggcagagagtagtgactcgatactacatatgttgaaagcgaggtttgtggcatttctttgtgcaaacataacgataccgactattgggggaaatggtagtctatattaaattatgaggtgttatgttgactgtatcagtcctagacgttccatggtcgtatacatggcgagatgacggtattatatacctgataggaggttagcttgcgacttgttcgtaggctaactctgtccaaaattaactcgaatctggtattatataaaaaccatataagcaagtacataagaaacttataaaacaaaagagtttgatggacaaccctcttctgggttggtcatttgaactctgcgttagtacgactgaagaccgataggttataaggagttgttagccgataggcttaattatagggaggtttagacggtgaaagaattcttaaaaatatttactaagatggaaaaaatattcattgttgctgctcttttttggatactaactttagatgttcatgacatgagtattattactatagctaactgtatattgatcccaataatattaatagaacttgctaaaaagtatagttaaaaaataaaaaaacaagtgatggatcaagtcctatcacttgttttttttagtataaaataggttattttttaggatgcattttggatgcagaattggtggcaaaagtggaggcaattcattttttcatggggtcatgatttttttacttaaaatgagagtattactgggctttgcccagacccaaatcgcagatggggacaaaaactccttatgctcttttttctccgaaggctcttgcagagggctttttattttttataaaaaatattaaaaggattttgtaatacatttgtaatatactacaaatgtattacaaaaaaattgattatttcaaaggagctaaaatgactaaagaagagtttttagaattagatatagataaaaaaattgaatacctaaatgaaaaattaagcgaaggacaaactgtaattcgcattagagaagatctaggaataggagaaaaatctcttcaaaaaattataagagaaaatggatataaatattttcaaaaagaaaaaagatattacaaagaaaatacaaatgtattacaaaaaaatatagttaatgaaaattataatttagattctaaagatcccacaattgtattacaaaattataaagatgatttattagaaatagttcaagccaagaaagacatatttgaagttataaatgcttttaaagaaaatttgtattacaaagatactacaaatgtaatagaagtggttgctagtaatgaaatacaaattaaagattttaatagcgacgcaaaagtaacttcatttagagtttatggtgaaacattaactaagtggaaagagttttgcagcaaacataaaaaatataataatcaagatctagtgtctatggcattagaagaatatatgaaaaagtatgagtaatagataaaaaagcgccgtaaattatggctaaaaaaacgtctagaatccatgtagagcgaaaataataaagttaagggtaaatagggtatctatttataaaataagccttaaaatcgaaattagagctttataagtaaataaaataaagaaaggtcagacttaataaaattaagtttgacctttctttattttgctagaccttacaagtattggaaatactatgtttttataaactattccctaaacctaaattttaagattagttatataggcctagctatcatatttccgaaaaaaagcaccaaagtttgttcaatataagcaattgcaatgaatgtatcgatttaaatcggtagattctttttttgtgccataattgaaatactgacactatataaatcaatctagttattacaatcaattgcttggtgtcattaattagtgacaacaaggtcttaaatttgcttattattgaaatttcataaaatacagctatttcaatgctttagataatgtttggtgctttttttcgagaatatgatatctaggcctataatattatacaaataatctttcattctcaacatatataccaattagtgcattaatttatcatctatgtactaattggtattactagatttgaacaaattttggtgcaattttgcagaaaaaacgcaggttggcctataaaaatttaacttatctatttaaatttaatctctaattgcgtttaatttatgaagcaaatactcttttttattcaatggatcataagttgttttttggcgtgcttttgcaaatccagcggaaacttccttatatccataaaattttgtcacaaacattcccctaccttctgtatatgaagctattttcattttatattcttttgaattttctactggaattaatccctttattgagaattcatcccctataacaataggattatcaaaggttgccctcatagtttctaaatcccataccgctttacttaaagcattttgaggaatccttaactcaaactcatgtaatggctctaataaaacagtttgtgctttatataatgcttccatgaataccataggtgtcacatttctaaaatctgctggagtgctggctggactaaaaaattcaccacagctaagagtgacttttacatctgtaacctcccatccaaataatccttgtttacttgtcttaataactgcttcttcaattgcattttgaaaagattttggcaatgaccctactgaaacattagaaatatacctaagaccttcgcctctccctgctggttctatttctaagcctactgtcgcccaaaatggatttaagtcttcctgcatatgcattattgacgctccaaaacctttaggtgtttccttatagatagtctcaatattcgaaaactctacttttattccatataaatcatctaacatagaacttagtatttccatttgaacttcaccgaataagttgacataaatttctttatccatgtcattcatctctaattctagtagtggatcttcctctgcaagtaatgttaatgctttaaatagctctggatttttttctttatcaattgcagaaattgttgtttttaatgctggtttagctatagatatatttttaattttattatttgaaattccaataacatctcccacttggaaacttgtaagtccatataaaatacctatatcccctgcttctatcctctgtgcttcaataattaccccattttctaacctattaattttctttactttttctgctatctccttattaggtacttggattttatctcttacagatatttttcctccaaataatcttacataaaccttcttttcatttttacttgttctttcgattttaaacactaccccagataaatcactttcacaatcatcacctgcaaatgaaaaataactacaaattccatctaataaatcttcaactccaagtccaattgctgcagcaccacaaaatactggatatagacttccttcccttgcatataatgaaagcttttcttgtatttcttctttatcaggttctattccaccaatatatctttctaaaaatgcttcgtctaagtctgataaaacattaatagcatcatcatttattatgcatgtatcaaataggttttttatataaacagctttgcttcctgcatcatatacttcttgtaatctaactactttattggacatattcttctttatctcttcaaatactttattgaaatttgccccaattctatctagcttatttacaaaaattattgttggaatgtttaactcctttaatgtgtcaaataatattcttgtttgtgactgaatcccctctactcctgatataactagtattgctccatctaagccacttaatgaacgttcaacttccgaaataaaatccacatgtcctggagtatcaacaatattcaccttaacattattccaattaaaagatatggttgacgatttaatggtaattcctctcctacgctcaagctccatagaatccgtctgtgtattgcctagatcaactcttccaactgattttatagctccactataatataataagttttctgttatagttgtttttcctgcatccacgtgtgctacgattcctatattaattattttcttcataatcaatacctccaactctatcaaccacctttttatccattatcatagcaacaatatataacactaataccggtgttactaataacgaagtacatgctatacccatacttactgaaatatttgtagctatgattcctataattggtccacctaaaatttgacctaaggaatttatttgtccatttatagaaagtacagtagctctggccttgtcatctatatgtccattaagccatgcactaaatataggttcatttatagttctaaaggtatttgttgctaaataagctattagcattaagttaaagctttttgtaatagcaaatatgaacataaatgatatataaaatatatttatacataataacagctttccattttgattcttatcatcatccttaagcttcttttccataaaatgcattactatagcactcaatatcattcctgcaattccaaaaattccgaaccaagtcactggcttaagatttccaagtttaggaagcatagtatcttgtaaaaaatgtgcattagaaagtctatcataaccttcactggataatccataaaataaagttactgaaagcaaaatcataattatagatttactttttataaatttaagaccagatttaaaggtatatcccatctttttgaatgtatttaaatcctctggagcagatggtttaaaattattttctggcatatataaccataaaaataatgcaagaattataaataaaactccactaactataataggcagtcttacagagaaattagctattacagtgcttagtactattccaataaccgatcctatctgtcctacttgtgctccctttatataaatttcatccaaatctttatctttctcttcttccgcaatccaagcttcaacagatccactgataaaagtagaacctaatccccatacaatctgtgctgcaagtatgaaaacgaaactagaaatagaaccttctaaaataaatcccactcctgttaaaactgcaccaataacaatagatagtttacgactgtacacatctgcaactatgcctgtaggaatttcaaatataaagcatgctacttctaaagtagttccaacaagtataagctgaagtggatttaaatgaaccgtttcaatgtgatacactatcataactgtagctactaacgaaaaacacattgctgtaatagctgaaaataataaataagttttatatgctgaaagtttattaaccattaatcatcaccatcctagtatttcttaaaaaatttgtttgtttttcataaccttcatatttaaatatataaatcatcaaaataatctccttaaacaaaaaaaggctgtaaatgaatataattcacttacagcctcataattatataacctaaatataaacatgaaatatagaactttaatttatatagcttattattaagctattcaaattaaaatcttataccatatctataaatgtagcaaaaatagacataaaaatactgtgtttagaacacagttttcccattctgcaaatagaggtgtaacatgctcattataatactgattatttttagagtacacaaataaacatggtaatatcaatattatcaataattgattctaccacaaataaaccttgagttattcaagattttttcatatactttttaaaataatccttattcagttagtttagttaaaaactacctctttgcgcatatttataacccctttacatttatatttttcatgtttatattttagtataattacattatatataaatttttaattttcttcaatgcttttacttttatatttattttcttattactattattatatttggaaacgaatacattaaaacgattttagatattttcttacgaaaaaaatatactattcctaaaaaacttatttaaagatatctagtaaaaaagcccttataatccatttatttcgattttaagggctttaactttatttaaaatacataactagtttctaaagtaaaattttaagactaattacttggaatttctaaacatgatgctaaatctttttctggcgtacttataggttttatatcgaatgtatcaactaaatattgaagtacatttggacttaaaaatgctggtaatgtaggtccaagatagattccttttattcctaatgataaaagcgctaacaagtcagcaactgctttttgttcataccatgataatattatagaaagtggtaagctatttacatctgtatcaaaagcatctgctaaagctagggctattcttacagctgagtaagcatcattacattgccctacgtctaaaagtcttggaagtccagcaacttctccgaattctagtttattaaatctatatttaccacaagccagagtaagtattatacagtcttttggaactttagtagcaaattctgtataataatttcttccagatcttgccccatcacatcccccaattaagaagaaatgttttaatttaccagacttaactgcatctattatagctggtgcattgcttaatgtagcattgtgtccaaatccaactaaaatttccttaggttcttggtcttctttaaatccaccaagttctaaagctttatttattatttcactaaagtctttttctccgctttcagtttttcctatatattttactccatcccaaccaactacacttgttgtaaatattctatctttgtatgaatctctaggtttcataagacagtttgtagtcattaatatacatcctggaatattgtcaaattctttttgttgatcttgccaagctccaccaaagtttcctactaaatgaggatacttattaagttctggataaccatgacaaggaatcatttcaccatgagtatatatatttattcctttaccttcagtttgttttaaaagcatttctaaatcttttaaatcatggccagaaactattataaatggaccttttttaatatttacatttactttatgaggagctggatttttgtaaatagtagtgtttgcttcatccagtttttgcataacagcaacactcatgtcacctgtttttaaagtccatgttattaaatcttctactgttaaattctcatcacaagttgcagctaatgctctaaaataaaattcatcaacttgatcattataatatcctaattctctagcttgatgaccatatgcagatactccttttaatccataaattatagtttgtcttaatgaacgtatatctgggtctaagttttgatcatacattatacctgcacgtttagcatcttctaacatttgatttctagtttcacttaaattatatgtagcctcttcactgaaattttcacatgatgatatcttgcttcttaaagattgttttatttcttgtgactttcttaacaattgttcatgaacatcaccatcaaagttaacatttgtaagtgttgtaaataaagagttttcaacgaaactaactatatctttatctattttttcacctttttttattaactcatttgcataacaactgatgccttttatttgataaataagtaaatcttgaagagctgctatatctgaggttttaccacaaactcctacttttgtacagcctttacctccaactgtttgttcacattgataacaaaacattgaataatccatataaaccactccttttttaatagtctttaatataattaccaataaattgaggaaataacatgaatttgtaaataaattatttcaaataagtgggatactgaaataagtaaaaaacaggtgtttatttatgtatatattgatattgctgagattaattttttacttttgtatttagaataatattatacttaataatgaaagtgtctagttctataattgtttcggaaaaatactagtctttaaaaacttatttaaagatatttagtaaaaaagcccttagaatccatttctttggacactaagggctttgattttataattaaatttatattaataataaaaaacatttgtaaatttatgtaaaaaactttatcatatatttagaaaacaaaataaaaaagacttacaagtttccctttcggtcgccaaacctaatcggaaattagtacccaactgttagcgcagttagatagtacaagtaagccttataaactgtcattactaataaagtactgcaatacttattagaacaacaacagtttactcttaaatttataatcaagattagtataatatatacttgaaaattatacaagattataaatttaaaaaaggtttatgaaatatcgagctattctcacagttgagaatagctttttttagtttttagacaaggcttgaggtcggaaagcattgatactatgcttgattaattagtattagcttataccatacttaaacggcttgagagaatgggagcattgatattaggctcgataattaatattagctgataaaagaaatatttacatacatataaaaaaattgaatagatagggttttataagggagagtgtttgacctagagcaaaccgaatggcaacctttcacatttattaaattcagctaaatcaatatataaactagctaaatctaaagttacaaatataggtatgtagttaattttagtatatatatcataagctttttccatataataaagagcatcttcatactcctttgctattatataattttttcctaattgataattcatatatgggtcattaggagatttttttacttcttctattaaaatttttttatttctaacatcttttaattgtttaatttcttcatcttcaaataaatacccataatgattaaacatcgctatatcattatatataggatttttaaatattggttgctcatgtatagctcctttatatccaaatccttcataatttttaaataatcttaacataggagatatgctatagctctcttcatcttgagaaagaatattttttaatgttatacatgcactattatatttattacataaatctgaattaaaaaattctttaagtttatcataattagttaattgttcatctgcatctaatatgagtatccaatctccacttgcatgactaattgatatatttctcatatgagcaaagtcattattccaactggaaaaaaatactttattggtatatttcttggctatttcaacagtagaatcatcagatcctgtatctaaaattacaagttcactatttatatcttccattaaaggctttaatgattttaaggttttatccaaatatctttcctcattttttaccatcattacaatacttaataacatatttaatatccctttcaaataattaaatttaaaaataaagagtaaagcatttttgctttaccccttagtttaaaatttaattaactagttaattatcttaataattgagttacactctcaggttgttgcttagcttgtgcaaccatagcttgagatgcttgatttaatatgtttaacttagataacttaaccatttccttagcaacatctatgtctcttattctagactctgcagctgttaagttttcagtagaagttgttaagttagaagaagtgtactctaatctattttgagttgctcctaagttagctcttcctgtgtttattgattctaaagctttatctactgcagcaacgaaagattgagctgcttttgaagttgatacatcagtcttagataaagtattagcttgagcaactaagtctattgtagttatagttcttacttctgtattagctcctgcttgtattgtaaagttttgaactccgcttaataagttctttccattgaatttagcttcttgacctattttagtcatttcttgttgtaattgatctaattcagtttttatcttagttctatctgtagaagagaaagtatcattcccagcttgaactccaagttctctcattctttgagctatgtttccagcttcttgtaaagcaccttcagcagtttgtaccatagatataccatcttgtacgtttctatctgcttgttccatacctcttatttgagatctcattttttcagaaactgctagtcctgcagcgtcatctccagctttagttattcttaatcctgtagataacttctccatagattttcctgataaagcagtgttttttgccatttggttagtagcaaccatagcgtttaagttagtgtttattctcatttttatactctccttagttttttacgacatcctgtctatttttatttatttacaattacttggccaagtattgcttacaattatatatatcggaacactttaaaaaaactttacacttttttattaaaaatatttaaattttctttattatagttaatatatgagttatttgcttgtttagactttttatgctccattatttccatcttaactttaataatattttcctttattaaagagtgtattttttcatctatttcaagtatcccatcttcaacaagcatttgtttaaataattttctatcacttacattatctaaaatcttttgtctttcgtttaaaagttcatcaatatcataagtattattattttctaatttatctataatatctaatgatatttgtttatacttttgggttactaactccataaaactacctccatgaaactatgcttgagcaaagtagttcatttgagaatttagtttattcatactagcttctaactgtccaaattgtttatataacttttcttctctatcatccattttcttttgaagtctttttatcatatcttcttgtcttcttatttgttctgagtaaaagtttttaacaacagatgaagttttttcaagtcctgcttttctggcaaatatagaagatgaactacctatatatttatgcatagtatctttcattttttctagcatactagttttttcacctgcaaaagctttaaaaactcgatcaccttcattttgaagagattttctaaacttatcttcatttatagataattgtcctcttttattataatcttcacttgaggttaatccacattcatttaaaaactgagcattttttccaaatatagcattttgcatactatccataaaacttctcatttcagaatcatttcttaataatccagatttagctttcttttcccacttttcaatttctttttcgctcatatcttccttttgggcatctgttaaaggtgagtagtctttatttttcttttcagttacaagtccatataccttatccattattttgttgtaatcttcaacaaactttttcatattttcaactacaggctctacatcttgtgttgaagttatatttgtagttccttcagcatggacactatagtttattccatctatagtaaatgaatttgattcttgctctaatgttttgtcaaatgttttgtcatttgatttaactattatttttgcattttttccctctgaaacatcctttaatcctaaaaatttcagtggattttttgaaccttcttttgaatcaataaaacttaatttagcacttttacctattttattagtttcaatagtaagctttcctgtcatttcactaaaacttgcttttattttcccatcagtactttcatttattttcactattaaagaatctactgtatcttcaggttttatagttatctctttagatatatctttatctccatctccatattttatagtaaacttactttctacattatttaaatcaaattcagataatttagattctttttttatagtttttccatttaaagctttttctgctgatgtacttgccggtttagctaaattttcaacagtaaaactgtaatctatatcattagcacctgcacttccagttgcagtcattactttttcattagaacttgacacttttaatgaattccaagcttttgaactcattatagaatcttttgatgttactgaaaaatatttatcttgaaaactttttatatctttcataacatccctatatatttcttgttgccattttatattctgttctttttgttttgctctatcaactttattttgttctcctgaaagcatttgttttactacactatcagtttccatccccgttgcaagtcctggtaaccttacactatttactcttgtcataattatgcctcctatttaccagtctttatttttctatcaactgcataccacatatctcttatttcttctattaaaggtaatacattatctattatctttacatctttttgtatattagctctagataattcactttttataaattcataaacattatataaattttgcatatatttactagaatctttgtctatagttatcataagttctaaaaatatatcttgaactctaactaattctttatgtgctctttccatatttttatctattatagctaatctagctatctttgtatatttaaccgcaccatctaataacataagtaataattgttctttagatgctgtgtttacagaattttgtttatatgtattgtatggatttgccgtatacataaatttctcctcacctacttaaataacttaaaaatatcatcaatattagctatagcttttgaattttcatcttttacattttcatatatttcttttctaagtatcaccttatctcttggtgcatcaatagctaatttaacacttccatcatctatctttataatttttatttctatatcgtctccaattagtatagattcatcttttttcctagtaattactaacatttttatcacttcctattaaaggttcttttatttgatatttatcatcttgtaatattaattgtttacctttattattttttatatttattattataggagcttttaaattcactgtacttttttctaagttttttcctaaagttattatatttaataataatacatcattaggtgtttctatttgtaatgactttatagtttcatcatctaaatttatttcataatctttttttacagaaaaaggagatatagctataaatcctatattttcttcttctgtagagttgattaatttaaatttagaattaccctcaatatcacaaagtctaaaagttttgtaactttcaaatccaggaagtcctttttcaaatgttatattcatagttattcctcctgactatcttaaataatccattatactaggttgtattaatttagaaccaacttgaattgatacattatatagcatttctgctgattttaattctataaatttatttatatgatctacatcttgttctaaagataatacacccttcatatttaatatattttcatcattaaaatcctttattttttctgctgtatttactctaactccaaaagtagttctcgtatttacactatgattaaaaagtttatctatatcgtcttttacagttcctagtaattcttttttatttttttctacatctttaccatttgatatatcattcataagtttagataaattatttatttgatccaaataatttttaccatcattttcaaaaatttctttagctgaaatattataatccacagttattccatctgaaatttcagcttttaaatctttattatttatagctggatttaattttaatgtaacaactccatctttttcttcaaacgatactggaacttcatcaacttctgttccagaaaacatatgtctacccccatgagaagtatttaatgattctcctagttctttaattttttcattaacttctgcatgtatagcttttatctcttcatctgagtaagttccattacctacttttaataaatttgtttttatttctcctaaaatgtttccaacttcttctaaagatgaatctgtgttattcatccatcctactgtttcatctatgttttgattatacttttctgtatatttaatttcattgtttaaattcattatttttatagctttatgcggatcatctgacactctgttaatttgtttccccgaatcaagttgtctatttaaagcatcccttctttgtaagctttgttgtgtatcatacatatgatttctaatcattgaagagtctgttattctcatgtcttcctcctaagttatcttattaatccatttattacaacatttaataatgagtctatagttgaaattactttagcgcttgcattatatgcatgttggaattgaactaaatttatcatttcttcatctaaagttactccagatacattaagtcttgagttatcaacatcttttaaaattttactttgatttttttcatttcttataacttcttgagtttcatttcctaatctttgaattatatcattataaaagttattgatggtcatgttttctctacctatagaaactttctcatcttttaacttatacatcttttgtgctgtttctgatgatatatttatatctgtttttttacttaatatatcatcttttacttttaatattggtttatctccaacttcaaaaaaatcaattcctaaagttttatttacattatctgttataccttcagctagttttttcacatcatctttaaagccttttattttctctatcatatctagcgaaccttttatttcacctgatacaccttttatacctttaaggtcagcttccgttatatcttttccattttctaacttttcttttaataatttttgaacattttcatcttgaatattcattttaaaacttagatcatctaaaattttatctctttcatctaataagtcattaggagatttcccactaccttgaactaatttgatatgtctttctaattcttttaattgatctagtttcccgtttatttcttttatattttcatttaattttatttgtgcactttcgcttaaattatctaatttattataaacttgacttattttttttgatagatagtcactattttgtataactatatcttttgatcccttatcctttgggtttttagaaagctcttgccagcttgtaaagaagttatttatagatgctgatattccattttctgatggttcattaaatatagtttccatagtagtatagtgatcatatttaatctctatttctccataattatgactttcacttctaaattggaaatcataaaaagtgtttcttattctagtaatgtctgtagcttcaactcctgtacctagttgacctgcacctaaagtactgttgtatcctgggtaactatatgcacttcttgcactttgttctactttttgtcttgaatacccaggagtattcatattattgatattatgagaagttgtttgtattgatgcttgacttacactcattcctgttcttgctgattgtaagctacctaataatcctgtcatagtttctctccatttctcctatttacctacttgcccataagcattgtaagtacctattccttgatttggttttataacattcatcattttttttgtaaaaaataatctttgttttaaaagagtttgatttgcttctttttgcaattcaatcatttttatatttgattttatttcttcatatgcttctttaattttctcatcttcacaattttcaatcaaagaactcatactagcttcttctgtaattatatttcttctttgtatttctaacttagctatatcccttgatatattctctaaatctttagctattttatccatttttgttacttctttattaataatgaactcatgttgttcatctaataaatccaataattttttaaataactttctttgttcatatattacaacttttaattcagggttcaaatctttttcctcctaaagtttttcaattatcttttttgctaagtctctagaatttactttgtaagttccactttcgatttgtttttttaatctattaattttttccatatctattgattcttcttttgaattaactttgcttaaatatttacctaattcagatatttctaatgtatctgtattatttttgtttttataattattatgattttttattttatccattttatatatattattgaacgctactttcacatcattgctaactttcaaaatatacctcctcaagaattttaatattcttcttgcattgattttatttttgataatcttactgctattctatcatgaattatcatactttctccacttgctatattaactccatttacgtttatatctagaggatcttctaaacttttttcaagctgtattacatctccaaccttaaaattcactattttttctatcttttcacgagtagatcctactaaaacttccaactccatcttagcctcagatatagattctatagcatttataggttctaattcgcctaattctaattgttcaaatttaggctcataaacttcttttgtttgtttttcattttgcataaatttgtctccttatatcttataaatataaatcaattaaaagtccattaatttcatcaatttgtgatgccatatctatattttctttttcatcattaaaaaaatctctagttatactttctagtttttcatttactacatttactgttctaaagtagttttgattccaaaaactatcttttttatctatttcataagcatattcaaccacagattttaaatatttttgtataacttgtttgtaattaattacatctgtatacccttttgtatgtattaactttttacctatctcttttatctgatttaaatatttatctacttcttcttttgtttttaatttgttaacttgattaaaactctcactaaaacttattccctgtttaatttttctagtatctatatttgtagtttcttgcactattttaaaatcacttattttcataatcaacctctaataaaattaacttatagctaatttgtcatacttttatatttaccttttcctactacatctattaattcatttaaactcataggtttataacaatagtatccttgtactaaatcacactttatattttttaacattaaatattctgattcagtttctactccctctgctacaacctttgttttagttgtatgaatcatctttattaaatttttgataaacataggatttacattcatgtattctactaattttgtatatttatttttactgtaatttatagaaaatatatcatcctttattttctcacaactcattttatcccccccttttagtaatttattatactaaattataaaagtaattatattaaaatacaatatttgtatttttgcataaaaaaacatttaaaataaatatgcactctacttattttaaatgtttttaatatatcatactttaactaatctccctatattatttttatcataaactaaattataatttattttatcatttaagttaattttatctccatagtcaatatcttctgaattgtaaaagaaactacttattctttctaaatttttactagcagctttaaatgttggatctaatgcatatgatgctctataatgtcttcttgctaaatttagattatcttgtaactcatacataattcctaaaaggttatgcccttctggcttagagaaatcttttataataatattttgtatatgttttttagctgatatataatcatatatttttaaataatagattgctttattcatttcttctttgtaataatcagattcacaattaatagctaacatatacaaccctccttatcaacttttttataattattagtataagaattttcatattaatatggtattaagatatacaactaaaaataaagattttgttaatttatatatcacaaaactgcaattaaaatgtaaattaatataattactaaaaaagagttagtaaaattactagctctttttttgtttaaatgtcatagtagctataataaagcctatttatatactaatttgtaaaacgaaattatttatcttctaaagggaattttttaattttacaagaattctttatatgattgtaaattttaatattattggggggtttttatgttattaaagaaaaaagcgtcaatatttctaagtactatgtttatatgtagtttagttttaacgggttgtagttctacaaatgaagaaactaagtcttctaaaaaagccgatccttttaaagtccttgaaaatgaagatgcaagaaaagctatagctttagctatagacaaagaacaaatgacaaatataatacttaatgatgggtcaaaacctgttgataaatttgttcctgataatctagcttttaatgaaaaaggtgaagattacagaaatgtagcaggagaaatgggttattctcataatgatgaagaagctaaaaaagtttgggaaaaagtaaaaaaagaaattggttttgattctgtagaatttgaatttttaactagtgatacagaacaaagtggaaaaatagctgaatttattcaagcagagcttcaagatgctctagaaggagttactgtaaaaattcagcaactacctactaaattaaaaactgaaaaaggttctaatggagatttccaattatcaattgcaggttggggagctgattacccagacccacttactttcttagaaatatattatcctgaagttggaagatatgctataaatgtaggatataaagatacagaatataaagatttaataacaaaagcaaaaggatctactacaatagatgaaagctgggaaagttattcaaaggctgaaaaaatattattagatagtgcttttattactcctttataccaaaaaggtggagcttatttagaaaaagaatatttaaaagatgtggttaattattcatttggtccacaaacttcatataaatgggctaagttaattaatggtaaaaaagaagtaaatactacttctagttctgatatatcttctatggatactgctaaagcttcagattctacatcttttgaagctataaacaacgttatggagggattggtaagagttgacagtaaaaatgaattaattccaggtatggctgaaagttgggaaaaatcaagtgattcaaaaacttggacttttaaaataagaaaagatgctaagtggtctaatggtgatcctttaactgctaaagactttgaatattcatttataagaaatttaactcctgaaactgcttgtgagtatgcttatgttatgtatgatatacaaggagctgaagattttaacttaggtaaaaattcagattcaagtactgtaggtgtaaaagcaatagatgattatactttagaaataaaattaaatagaccagtaaattattttgatcaacttatggcatttcctgtattcttccctgtaaataaaaacatggttgaaacttatggagacaattacggaactgataaagataaattagcttttaatggacctttcgttatggatagttggaagatggaagatcaatatggtttaaagaaaaatgaaaattactgggataataaaactgttaatttagataaagttaattttaaaatagtaaaagatattaatgcagctgtaaacttatatgaaactggagaagtagacaaagttgctatagcttcagaacatgttgataaatataaagatagtaaagagtttaaaactataaaatatgcaacttgtaatttccttatggtaaacggtggaaaccctcctaaaaataaaaaataaaaatattaaaaaggactatggtttttaatcatagtcctttaaatatattttctcctacttcttcttcaaactgcttaacatataatgaataataatatttcttttgttttaataattctttatgacttcccttttctactatcttaccatctctaacaaccaatataatatctgcttttcttatagtagataatctatgagcaactaaaaaagatgttctatccttaagtaagtgagaaatagcattttgaataatttgttctgtttcagtatctatagatgaagtggcttcatcaagtacaaatattctaggatttgcaagaactgctctagcaaaagatataagttgcttttctcctgttgataaattagaaccaccttctcctacctgagaatcataacctttttccatattcataattatcttatgagctgatactattttagctgcattttctacttcttcatcagttgcatcaagctttccataacgtatattttcttttatagttcctgaaaataaatgtggattttgaagaacataaccaatattattgtgtaaccataactgagatctttctctataatcttttccatctattaatacttttcctttagtaggttcaaaaaatctacaagctaagtttaccaaagtacttttacctgaacctgtttcaccaactaaagctattgtagttcctgctggtatcttaagattaaagttttcatagatatattcatctccgtcaggatatttaaaatatacatctttaaattctatatcacctttgatttcttcccaattttcttttttaggattaaatgaatctccatactttttaattacttcttcactatcaactatatctggaattctttctaataatccaaaaactctttctatatttgcttgagtagctataaattctgatatatttttagctaattgttgaattggttcaaatatacttattgcataagatataaatgctgataatgtacctatttccattaaatcgtttataactaaattcccacctctatcaagaacaaatgccacagctagtgaactaaaaaatagtataattggcatatatatagcatttaattttgtagctcttatacttgttttatacattttatctgttattttagaaaaatcctctaggtttttatcttctattacaagtgttttagaagtaatagagcctgttattccttcgttaaatgctcccgttatttttgagtttatttttcttacatctctatttacatttagtattttattttgaaagtaaactgtaagtattgctataaatggtactattgctattacatacatagctagttttgcatttagcataaacattgctataaatactcctaatacataagtaatagaccaaaacaaatccacaagtccccatgctaccatagaccctattttattagtatcactcattactctagctattatatagcctactggtgtagtgttataatatgaaaatgaaagtttttgcaaatgcataaaggtagctctttttaaatccttacctatgttcatttctaaatacattgaaagccttgtaaatattattacaaatattacttgtaaaactatggctagtatatatacaattacaaaattatttattccttttgtactcataggagttataaaattatctattgcatacttttgaaatattggaaacattacgtctacaaatgcaacaaataagtttgctaatatagcacatataaaatgtaatttgtattgttttaaaaacggatttagctttttccatatatttatagaaaaacttcttttatattcttcttcatcaaaactcattatttttcacctcctgtatcttcatttaaggtgtctattagttcattttctacacttgattgcatatcgtaaacttttttgtataatccatttgtttttattaaagattcgtgattgccactttctactacttttccatcatctaaaactataatattatcacaactcataagcgtagttatacgatgagatattattattaccgtactatcttttacatgtttttttagttcatgtctaatctttgcatctgtttctgtatctactgcagatagtgagtcgtcaaatactattactggactattttttattaatgttctagctatggctactctttgcttttgtccaccagataaagttactcctctttctcctactatagtgtcatagcctttactaaaatctagtatattctcatgaacatgtgaaacttgagaaacgtgttttatagattcaaagttttcaatttcatctattttagatgctatatttatattttgttttatagtttttgaaaataagaaaggctcttgtaatactactcctatgttatgtcttaaataatcaagctttatattttttatatttactccatttattaatatttccccacaattttcatctaaattgtataatctgtttaataaatatactattgtagattttccagaaccagtacctcctaaaataccaaaggtacttcctttttttattttaaatgaaacatctttaagcacaggtttagtaccgtagtaatcaaattttacatttttaaattctatatcaccatttatatctggagtaatagcatcttcattatctttttcttcctctgcatctaaaatttctttaatacgatttatagatactcctgctttacccatttctgaaataattcttccaagagaccttactggccaaactagcatagagttatagaatataaatgctaaaagttctcctagtgttaatgccccagaaactgtttcaaagcatccaaatacaactatagacataacttgaagtcctgaaaataaatctcctataccccaataaaaactaagtacgtgtccaagcttaatccatagtcttgaaaatcctatatttttttcatcaaatctttcaatttcataagactgtctaccaaaagctcttacaactcttactcctgtaaagttttcttgtacaagtgttgatagctcaccttctgcttcatctgcaactttaaacttcttttgtataaggctataaaatattacagaataagctattactattaatataaaagctactgctattaaggatagttttacattcatagaaaacattaatgtaagagaaattgttattagaaaaattattcttataaattctagtaattggattcctagaaagctttttactacctccatatcagatgtacatctttggattatatctcctgttggatttttcatatgccagctaaatggaagtctacttatatgattgtataatttatctcttaagttttttatagtaccatctgatgcttttgccatatataccttataaaagtaattacatattccagataaaactgaaaatactactcctatcgttgcaggtatatataaattttgtcttaaaaattctcttccacctaaattatctattgtatttaacatgtaactaggtaaattaaatggagtatttccaattatagaatccactgtaattcttattacttgcggagtaaggtagttaaatattattcctaatatagtagttattactgctataacaaaatattttttaagtccatttgtatattctattatcatttttactttgcttttattttctttcatgtgtatcctcctttcttaatcaaataagttattgttatatctttaagtcaataataatatatatataatattttatttctatatgtagaaaaaaatacctttctactctcttttagggtaatttttattataatttgaatatattttaaataattatctaaatttattaaacatgagaagatataatattaaacatttgttacaaaaaaaatttaaccacaataatcatataattttaattattgtggttaaactttctaatacttatatttaaactttttaattagtttactccaacttcattccatgcagcttgaacatcattagcttctttatctccataaaggtcttttgctgattgaattaaagcatggctagcatctgagaaatttgattgtcttgttaaatatttagtaagagctctgtaataaattttttcagctttttcttttcctaatttagttatagtattatatgctgctttattaggaataccactatttatatgaactcctccattatcaaaatccataccataatttctatattcactcatatgttctggttgattatattttttaggatcttttaaatctcttatagctgtattaggtgttttgtataaatcttcacccattgtccagtcatcactatctacaaaatatccaaatacatctgaaaaagactcatttaaagctcctggttgatacttataaactaagttagctgttgctgatgtaactccatgtgtaatttcatgagcaacaacatcatctgctgctgagaaataattttcatcagcttggttaccatctccataaatcatctctgttccaatccaagcagcattactccaactttcacctgtctgtgggtctggtacatgtacataagagtatatatctgaccctttatcatcataactttctctattatgaacatctttataatatttataaactttatctgcaaagtagtgagcatctacagctgctttgtctttttcaccatcaaaatgattttttatattagagataatacttcctactatgccatcattattaaagccttcaaatgctgcagtagctattttacctttatgagtagtatctattaaatagtacttacctccatcttctgttatgtttaaaggtgatctaacttgtccatttgcacctactccagttcctgttgtttgagttgcattttctatgatattttgtttttcaactatatttccattttctgcatctactttaatattccaatgagctggttctggtacagtatatgctatatctaaactataaattgctctattgctttgttcatcaacagcaattttagcttcttgcacaacatcttttcctgataaatttttaacttcatcacgtgattttcctattgctttaaaagctaattcaatagctttatctttatctattttagtttggtttttgacttccaatttaccttgatctaaatccccatttacaaaaacaactttacctgacttatcagtatgtattttaacttctgctgcgtcggcaaaatatccattagctttaggctttaaagtatagtgagtaaagcctaattcatctttttgtgtatctactaattgatactgatcagagttattttttatgctatattcatctgatacattttttaaaacatcttttaaatctttgtctgatttcacattatatgcttgtggtaaatcttcttttgtttgactatctgcataacttactgaaggtgctaaaaaactaagagttaatcctgctactgttaaaattgctatattttttttaatcatttaaatccatctcccttgttaagtttttatttagtcaacatttgatatcaattctgtacttaagtaatggcaacttgtttcgtttataaatattaattaagtcttcagattgatattttttttacttttaattacaaaaataagataaatatttcacaattaaaagtaaattttaatacaaatattttttatattaattgtttaaacaacaaattaatactttttaaactgtatatttttatttatcttacttgtaaaaattgaaaattaaagatttgtttcagatttaaaagattttgtatacaaaatttttattttgttacttaaaacataattatgttggttcttacaatataaatactataaagagatagatttagcagatagattagcaatgaaaggatggcaaatacctgcatatccattaccaataaacttacaagacactataatacaacgtatagtatgtagagcagacttaagtcgtgatatggctgaattatttataagagatttaaaagcagctataaaagatttagataatgcaaatgtattaatgcatggtaaaaaaacagaaaataaagtatatggatttactcattaataaataaaaattaaacacaatcttaaagagtcttagtatttttaaaatactaagactttttttattgtttgttaaaatgaaggttatgatttttttattgcaaaattatttttagtgaatttttttttgcaaaaattgtttaatcaaagacatgaggggtatatatacagtgtacaaaacgacgatttattataggcctagaataatttacgttgtggaaaattaaatatactaggagatgattgacatgaaagacgaaaaagcagctaaaaggaattcccttagtttatttgcattcttcgcaatgactgcatcaatggttatgacggtctatgaatacccaacatttgcaacatcagggtttaatttagtatttttccttttattaggtggtatcttatggtttttaccagttgcattatgtgcagcagaaatggctacagttgacggatggcaagaaggcggaatattcgcatgggttggaaatacattaggagaaagatttggatttgcggcaatattttttcaatggtttcaaataacagttggatttgtaacaatgatttattttatattaggatgtgtttcatacatatttaattgggattcattaaatagtgttccattaataaaattcataggagttttagtaatattttggggattaacattctcacaattaggtggtactaaaaacacagctaaaatagcaaaagctggatttattttcggtatagcaatacctgcagtaatattatttgtattatcaatagcttatatagtacaaggaaatcctatagatgtaaaaataggagcaaaatactttgtacctgacttttcaaaagtaaacacattagttatttttgtttcatttatacttgcttatatgggtgttgaagcatcagcatctcacgtaaatgaattacaagatgctaaaaagaactatccattagctatgattatgttagttgttttagcgataattttaaatactataggtggattaacagttgcagctgtaattccacaaggagatttaagtttaagttcaggtgtagttgaaacatttaaagttttaatattacatttcagtagtaattctacatggcttgtaaaattaatagctatattattagcattaggagtaatgggtgaagttagtgcatgggttgtaggaccttcaagaggtatgtatgcagcagctcaaaaaggtattttacctaaatctcttgcaaaaactaatcaacacgatgttccagttaacttagtttttgtacaaggagtaatagttacaatatgggcagcagtacttactttcggtggtggaggaaataatgtatcattccttacagctatatcattaacagtagttatatacttagttggatatttattattctttataggttattttgtattagtacttaaaaaaggtgatttaaaacgctcttacaatgttcctggaggaaaaatatttaaactaatagttgcagcatgtggtttattaacttcagtgtttgcactagctatatcatttgttccaccaagtcaattaagtggaaagagtgtacatgaatatttaactatattaagtataagtttcattataactatattaataccatttgtaatatattcaatatcaactaaaaagaaataaaattagctataaataacaacagataactatttaaaaattaatacaatagataaacagcataagattttaggagggtttttacaatgttatttaaaaaagaagatgattatagtacaccagtgtttgggacaatagagtctggctctaatattccaaaggatgtaatagggaaagattctattgctccaaacatagcatacagactaataaaagatgaattaatgaatgaaggaaatgcaagacttaatttagcaacattctgtcaaacatatatggaagatgaagcaactaaacttatggcagaaacattagaaaaaaatgcaatagataaatcagaatatccacaaacaacagaaatggaaaatagatgtgttgatatgatagctaatttatggaatgcaccaaaagatatgaattatataggaacatcaacagtaggatcatcagaagcatgtatgcttggtggtatggctatgaaattcagatggagaaatagagcagaaaaattaggtatagatgtaactaagagaaaaccaaacttagtagtatcatcaggatatcaagtttgttgggaaaaattctgtgtatactgggatatagaaatgcgtacagtaccaatggatgaagagcatatgagcttagatatagataaagttttagattatgtggatgattatacaataggtatagcagcattactaggtataacatatacaggtaaatttgatgatataaaagcattagatgcagtagttgaagaatataataaaacagctaaaataagtttaccaatacatgttgatgccgcttcaggaggattattcacaccatttataaatccagaacttgagtgggactttagattaaagaatgtagtatcaataagtacatcaggacataaatacggattagtttatccaggtataggttgggtaatatggaaagatgaagagtacttaccaaaggaattaatatttgaagtaagttacttagggggaacaatgccaacaatggcaataaacttctcaagatcagcaagtcaagttataggacaatattataacttcttacgtcttggatttgaaggatatagacaaatacatcaacgtacaaaagatgtagctatgtacttagcaaatgaaatagaaaatacaggattatttaaaatatacaataatggtgaaaatttaccaatagtatgttatagattaagaaatgaagatgcagttgagtggacattatatgacttagcagatagattagcaatgaaaggatggcaaatacctgcatatccattaccagttaatttagacaaagttataatacaacgtatagtatgtagagctgatttaagttatgatatggctgaattatttataagagatttaaatacagctataaaagatttaaataatgcaaatgtattagtacatggtaaaaaaagtgaaaataaaagatatggatttactcattaataaaaaaataactatctctgtaaggagatagttattttttatgtgtattaaattataagctaaatgcccataagttttttgcttccttaagaaatacatctacatcccaagtctcactacttctttttttactatcagaatcattaacttttattttaccatcatcagtaactccagttaatacaatataatgaccttcttttgtaaaatgccctggtcccatagttactataattgggtgacctttttttagtgtagatataatacttgatgcacttagaggtataactttgcttttaagaccaagttttctagctccttcagtcattagagaccaagaagtacctactccattaactaaatatccattttccttgctaaagttttctatgtatctaggatttatatttgtattgccagtaagtccgactgtaaccattgctaaagcagttgggccacatccatttatagcaaaaaagtctggaccatatttatcatatccccatctttcatcccattgcataaataatggaatctctccttttttgtaatcatttcttatatcaataggagtattatctgtagatgttttatgtttaggataatcaactacaaagtttatagtttcaggttttttagaagctagttctagaaattcttctggatattgttttgtatcttttaatatttcataaacttgagggtattgtggtgctagtttaactaagttttcaataacaggatctttagatttaagaatttcttgaggcaattgaacaactttttgttctacttttttagaaggacttgataacatatgtgaaatttctttatatcctgcatatatacctagtgctataaccacaggaacaactacatatgtaacattttttctacttttatttttagattttatactatgtttcccttttgcgtaagtcacttgtgctttctcctttactgctgttttaatttaatatattaattatacaactttaaaatacactacaatataacaaaaatgttacaaagtcataatatacgtacatttacaataacgattaaaaatgaattaattaatgtgtaattgtgtaataaaatttatttacaaatttaaaacatgtaaaaaaacatgtaaaaaatatgtaaaatatgaaagtgaatatttaattaaaaatgatatattatattataatattgttataaaaccaatgaaaattaaaaaaaagttgaaataataataaaaaatatgttaaatataatatatagggtatcatatatatttgtaaaaaagtataaatatggttaatatatgtaaaatatatgaaagaatgtgaggcttaaatatgaatctaaaaactaaagatatagctaataagtctggagtgtctatagcgactgtatctagatatctaaataattcaggatatgtaaaagaagaaactagaaaaataataaaagatgccataaaagaactaaaaggcaatgataataactcacacataaaaaatatagctgtattgttacctgatttatctaacttattttttatagatgtattaaaaggtataaatgaagaagcaataaaaaatggctataatgtattttcttttgatagcaatgaagatataaataaagaatttcaaatattagattcattattaaaccttaatatagatggaatcataataacaccatcttcaggagatttaaaaaatagtaataaatatgctaataagttaaaaagtttaaatgttcctgtagtattagtagacagagatttaatatatagtgattttgatggagtttttatagatgataaaaaaggggcctttgatggagtatgtatgttgattaataataatcataaagacatagcgataataactgggccattacaaactaaaccaagtatagaaagattaaatggatataaagaagctttaagtataaatgatatagatataaaagaagagtatatatatgaaggcgattttcaagttgaatctggatatagaataacaaatgatataatcaaaaataataaagatgtaactgctatatttgtaagcaataatatgatgttattaggagctataaacgcattaaatgaaaataacttagatataggaaaagatatatctttattaggatttgatgatttagagtttttaaattatgtaggaataaatataagtgtagtagcaagaccaacatcggaaatgggaaaaatatcattagagatattaaaaaagaaagtaagtgaatttgaaccatgctctacacaaaatgtggttttaaaaccatatttgatagctagaggatcagaaaaaataactaaaaatatataaacattaattaggagattggagacgttaaaatgaatgtatatttagctgaatttatagggataacaataattatatttttaggttgtggagttttagcaggaaactcactaaaaaaatctggttcttatggagcgggaaatgtggctataaatcttacttgggcaagtgctgttgcacttgcagtatatatatctggagacataagtggaggacattttaatccagctgtaactatagctaatgctataagaggaacattttcgtggagactagttccaggatatataatagcgcaagttttaggggcgatgtttggagctttattagtatacttacagtacttaccacattggaaagaaacagatgatgaagaagttaaattaaaagtatttgcaactgccccagctataagaaataacattactaattttatgagtgaatattttgttacttttggtttagtattttgtacatatggattagatacaaatagatttacagatggattaaagccattgattgcaggagctttaatatttgtacttggaacttcttttggaggagtaacaggatgtgctataaatccagcacgtgatttaggacctcgtatagctcattttttattaccgatagtaggtaaaggtaattctgatttttcatatgcttgggttcctataattggacctataatgggtggtagtacagcagctatggtatatgttgcattatatgagggagttatagattttagacttatatcgcttttagttctaacagttgttatattagtgattataaagttaaaaagcaaagatgaaattaaagagcaagtaaactatatgaatgaagcggtgtaattactgtatataaatgatttactagattggagatattaaaatgaataagatatgtgttataggaagcattaatatggacttagttgtaaatgtagatgaaatgcctaaaaaaggacaaactttaattggaagtaattttaaagaagttccaggaggtaaaggtgctaaccaagcagttgcagcatcaagacttggagctaatgtatgcatggtaggcaaagttggaagtgatggatttggacaaaatttattaaatcaactaaaaaataataatgttgatactaaatacattcaaatagaagaaggtgcaagtggagtagcacttataactgttgataaaaatgcagaaaatgcaatagttgtatctccaggagctaattttaaattagctcaaaaagatatagataattgtatagatgctataaaggaaagcaatgttgtagtaattcaacttgaaactcctatagatactataaaatatgctttagaaaaatctaaggaattagataaatttacaatattaaatccagctccagctgttaagttaggtgatgatattataaaaaatgtagatttattaactccaaatgagacggaattagaaatattaagtggagtaagtataaataatgaggatgatatacttaaagctgctcaagtaatgcttgaaaaaggtgtaaaaaaacttatagttacacttggttctaagggaagtttatatatagataaagaaaataaaatatttaaaaaatcatataaggtagatgcaatagatactacagcagcaggtgatagttacacaggtgcaattgctgtatcgctttcacaaggcaaaaatgtagaagatgctatagattttgcgtcaagagttggagctttatgtgttacaaaagaaggagcacaaacttcactacctacaatagaagaagttttaaactataaattttaaaggtggctattatgaaaaaaggaaaattaataaatagtgaattatcttcggtaatagctaaaatggggcatactgatttattaacaatatgtgatagtggccttccaatcccaaaggatgttcaaagaattgacttggcattaaaacgtggaatacctacttttttagaaacactagacacagtgttggaagaattggaagtagaagaaattataatagctaatgagatggaggaagttagtaataatttatatttagaaatattaaagaaatttcctcatataaaaataacaaaagtaaagcatgaagaatttaaatgtattacaaaaaattctagtgcaatagttcgaacaggggaatttactccatatgcaaatataatattaaaatcaggagttgtattttaagaaaataaagaattgaaatttctaaaataaaggcattatcatataaaatgatagtgctttttatttttatattttaataactatattacatttgttaaatttaacttaataagaaaagataaaaagttctttaaaaatgaaagcggtgtatttaaaagttaatataggaatttaataaaagaattcaataagagttaagatatatgaaaagaaagtagatataaataaattatatatagaaactaagaatttaaatgttgagataagaaaaagtgactcagataaacttataataaaacaagtaggtaacttaagtactaattcatttactatagatgaaaataataaggaatttaaaataaaatcaaataatgaaaataaatatttagattcaaaaatacaaggatttggtgatgctatattaaatatgatcaataactcttataataaaattatagtatttgttccaaatcatgtagatataaaggttagaactagtgttggagatttaatagtagaaaataaagatgtgttacttaataaaatagaatttaacacttcacaaggtcaaattatannnnnnnnnnnnnnnnnnnnnnnnnnnnnnnnnnnnnnnnnnnnnnnnnnnnnnnnnnnnnnnnnnnnnnaactataaatctaaaagttagtgaacttttaggaataaaaaatatagatataagtactcaagatagtgtttatatagaatctacgccagatgatatatttgtagataatatagaaagtttcataccagaatctataaatataataacatctagtagagattttgatactatagatataaaatctaatatacctattgctaaaaatttaaatatagataataaatcaggaaatgtttatttagatttacctgtagatcgttataatatacattttgatttaaattcattaaaaggtatacattttgataatgaaaatcaagatgttgaatctgataaattaataaataaatttgaaggtagttttagagaccaaaaagaaaatgaattaaaatataatgtatatgttaactcagataatataaatgtatataaaaaataatataattgaaattaactaaaggagcttttcaaaagctcctttattatttaaaaaacattattactatttttattagttaaataagaagccatagcaagcattccaattcctaatgtaaatttagcttgttgcttgattgcatattttgcaacaggtacagttatttttctagttttaggactaattaagcttactcctgtcaatactgttgcagaagctgctgtagcggttataacaggatgttgtttagcataatcctttacatagtcaactgtagttttaggttcatcaaaacactcataactaataccacagcaatcatcattataataatttactttagaattgtctttttttttaacatattttccatatcttctgtcatttcattagctttatctactatatcgtgagctaatgtattagtttttgataaaagttcattagctttattatcagctttttctatatactcttgtcctttttttgtataatcatcaatctgattattaattttattgttatccaattaaatcactccaatcaactataattttatgttttgataaatctttattcaatagtatattatgcaataactaatattttatagtaagaaaaaaataagtttaaaggtaatttatgtataacttttagattttattagtaaccagaaaaagctactttcatataattattattaagcatattaatttgcttagttaaaataaaaatacaacaaaggagttttgactatctatgactattatgagaaaaaagaaaaaatctaataatagctgtgctatgaattcaggttgtcattgtaaaaaagagaaagatacttactgtgaaccatgcaaaaagccagtttataaaaagtgcgatccatgtaagaaagtagatccatgtaaagattatgatatgcataaaaaacatgatatgtcttgttgtcctccaggaccatgtgaagactgtgaaataaaatttgacgatacatgtgttaagctagctcaacaagctgaaaaacttttcaaaaaagctttagactgcgaatgtttagcagttgaatcatatgaagaagctagagaatttgataaaaaagctaaagcactagaagctaaagcaaaaagattggctaaagaatctgtagaaaatgaatgtgaagctgaaaaactaagaagacaagcaaatgaccttttatgcaaatcagaagaactttgcgaaaaagctaaatgtttatacaaagaagcagaagctgcaggggatgaggctgagagattctgtgaaaaagctaagtgtttatatgaaaaagcgcaaaatgaaaatgaacaagcaaaatgcttatattctcaagctatgaagtgtgatgaaaaagctatgaattgttataaagcagcaggagaaaaaataaaagagtatgaagataaatctaaaaaatgtgaagatatgatgaaaaaatgtcaagataaaataaaaggatgctatgacatggatgattgtaagaaaatgaaaaaaagctgttatgttgatttaggaatagaagaaccttgcaagcctaaatcttgccatgataaacacgacaagtgtgataaaaaatataataagcatgataaatgtgaagataaatatgttaagtgtggtaaaaaaatgaatccaagttgtggttgcgaagttaaatatgtatgcccaacatacactcaaaaacctaagaaagaaatgaagaaaaataacgaatgtgaatatggatattatgatatgtttgataaatgtaataaaaaaaatgagtattattatgaagataattactgtgatttagatgatatcactttaataaaagaagaagagactggactatatataaatccaatatataatatggagccaatgcaatacatgggagattttgcttgtaagtacccatctatggatgaaccatatatgcatatggataaaatgggaatggaagaaatgcaagatatgtggatgaattactatatgtatatgcaaaatatgatgcaaaacatgatgcaaaatatggaagattaataataaataaatcaaagctcatagttaagactatgagctttgatttatttattgtaaaataagattgaataaaatttatttatattaagagtagggggcaattaacatgaaaatttttaaatgtagtttttatatattaattataggtgtaattcttgtatttgttattgggtgtgataaaaaagacgttaaagatataagtaataataataaaattagtattgataagaaaaaagaggaatttactccagtttttaaaaaagaggatataccaaaatctgtgtatgaaaaaatgttgggtaagtctattcctaataaagatttagtggacataagccaattatcttatttaacaattacatattatggatttgatgataaacctcatataggagaaatgatagttaataaatcagttgataatgaggttttagatatatttaaagagctttttgaaaaaaaatatccaatagaaaaaatgagattaattgatgagtataatgcagatgataatctagcaatgaaagataacaatacatctgcattcaactatagagttatagagggatctaatgtattatctaatcatgctaaaggtttagcaatagatattaacacacttataaatcctatggttaaaaatggtcaagtaagtcctaaagaaggagaaaagtatatagatagaacgattaatgtcaaaggaatgataaaaaaaggagatgcatgttacgaagcatttataaagagaggatggacttggggtggagattggaatactttaaaagattatcaacatttcgaaaaataaaggagattatttttaaataatctcctttattttaaaattttatggaataatattttatttagttaattcagcttctatttgtttatataaattttccatcatagtgttaaaactgcgattagatttcatataattagaaactaaaggatgattaaaaaatttatcataatctctatttagttgacttattttttttgatgcatcttcaattttatatcttgaatatattaaatttttctttttaacgtactcatcaaattgctttttcaaagatgcatttttatctaactctttttttgctttattcatagatttaaactcattactactcctaatgcaaaaagctagttcttttgccttttcatttatattcaaattattttccccctttagaattaaacaaaaaatttgatgcctataaattattttataaaaaatatttagaagtgttaccaaaactataaaattaaatttgtatcaaatttaattttatagaatagtatatattatgaaacaaaaagacctataagaactatacaacgtggaaaagagacctttttataaggtctcttttatattacacaagttattatattttcatctattatattttcatttatatcacttgggaataagtatttaatgaaaatatttcttaaaattccatgttcatttttttgttgagtcttaaattcaaatcctttgcttattatattgttaagactatgtatattatcaacagcagaaactgtaactatatattttttctgttgtgatttagctatatctattcttaaatcaagtaatttactttgtaaagaattgcctctatacataggatgtaccataacaaaacctgatataaatgtattttttatatcttctatggaaatacctaaagaagataaagtttctaaatcatttatgttaggaacatcacaaagagcacaagcaataagttctaaacctacataacaaccaattataaatccaccattttctattgtttttttcaaagagtcataatctctattttttaaccaatttttattatccatagaattacttacttcttcatatagttttgatatatcaccaaaattttcctcacttaaaaaacagatatttgcatatatattattagtaagaacattatttactttagatagtttaacttttgttagcaactaagcacctctttcctttgatttaatgttagacaattataccataaatttgattatatttgattaaaaaaatgtaaaaactataaaaaatattataatagctttaaaatactccatattcttaagcttaagtctattatttgataggaggcacaaatttgaactcaagaaaagaaaaaaacaagaaaataaggaaaatactagttttagtaggtgtttttataattagtactataactttaatacaagcaaacaaagaaaatattaatacctttataagaaaaggagcttctacaaaattagaagaggattcagagatttctaaattccaattgttacttgaaaatttatttgataatagaaataaagctatattaactaagaatgatgaagttttaaaaaagctatatgatatagatcataaatttggactttgggcatatgaacaagaagttacaaaaatgaaatatctagaaaattggtcatataaacaaggtgttaaatttaatgatataaaaactagagttaaagttcgaaaagttaaagaaaaagaagaaaatttatatggaataatatgtgcagtatctacagaatataattattcatatgaaaatcaattagatactaaaaatatgtttagaataggtacttatcattatcttaatatgagaatagtagataatgaatatgtaataactaaagaatggtatacggatccatttgctgattcattacatctagacaatataaaatctgatgatattagaaattatattttatcaaaggaaaatcaaccaataagtttaactaatgaacaaactaaagcaatggaatatgctcacaaatattgtggagcagcagctgatgaagaacatggaatgaaatttaatccaaaatataaagattttaacccagatggaggagactgtgcaaattttgcttctcaaataatgtatgaaagtaaaagatttaagaaaaatagaatttggaattatgaaggtaattcaggaactaaagcctgggtaaatgcacaaggatttaaaaattatttattaaatagtggaagagggagtttaatatctaaaggatcttatgaagacgtgtacaaaactgcttacaatatgaggcctggagatatagtagcatacgaaaagggtggaaggataacccatgtatctactgtaacaggattagattcaagagggtatccacttgttacatgtcataatactgatagattactagttccatgggatttaggatggagtgataaatctataagatttcatttaataaaagttcattattaataaaaattaaaaagtagctactcttttagggtagttactttttaatttaaaaggtttttataatataacaaaatctaatttattttaatattggttaatatatggtaaaatgataataaatatattttaatttagactacttattaggaggttcagtatttgaatatactattttttataacacccaaaagtgaagtagcatatatatatgatgattatacgatgagacaggcattagagaaaatggagtatcatagatactctgctatacctattataaatcgtagtggagaatatgtggggactatcacagaaggagatctcctatggtatttgaaaaacgatttgaagttagatttaaaagctatagaagatgtatatatatgtgatataaaaagacgaatggacaataagcctgtatctataaatgctaatatagaagatttaatatctaaatctatgaatcaaaattttgttccagttatagatgatcaaaatattttcatagggataataaaaagaagagatataattgaatattgctataaaaagataaagtcttaaaaatcaaaagagtaacttaaaatattaatttaagttactctttatttatataaatatattagtcattaaatttaaccatatctgtatatttagattttaaatcatttatctttgaagaataaacttcattttgtttttgatacattaagcttttagctatgtcatctttaacttcatcaagttcagattgtccaccttcatttctatcttcaacttttattaagtgatatccgaattgagttttaactggacctttaacttctcctttgttcatagaaaatactgcttcttcaaattcaggaaccatttgtcctcttgggaaagtgcctaaatcaccatcagcatctttagatggacaagaagaatgctctctagcagcttcttcaaatgatatttcattgttatttattttatttaataattcattagctttttcttcgttatcaactagtatatgtttagctgatgcagtttcaggtttaacgaatctagttttattagcttcatagaaattagctatttcttcatcagttaatttaactgatgctaatactctgtttatagaatattgctttaacatattttcttctatctttttcatttcagctttaaagttttcatcgttatgtaaattttcttctttagcttcaagatagaataactcttgattaactaaatcttctaataatctttttttgccttcttcattattaaattgcatagcttggtatggatctaagctttttaaagcattttcaatatcaatattagttatttctttttctccaatagtagctaaaacttttctttccataatattaactcctttgtaatttgtttattatagtattaactattaaaataaataatatcaaaaaattctagatatgtctaatatttcaaaactagtatcttaaaagcgtaaatatcattaaaatagaagctattattccaacaactccttcttctagcttatatttatgaactttaattattgatatatacatatatataataaacacttagatactatgatgaaattggattattaaaacctaaatatgtaaatcaagaaaataattatagatactattccatagaacaattaacaaccatagatttaatagagttgtttaaatctacaggaatatcattaaatgtaataaaaaaattttaagctcacaagctactctagattttatggtacaaaatataagaaatcaatcaaaaatagtagaagaaaaaataaaagcattatctcaaataaaaaaccacttagactatttagataaagaaatatctcaaaatattgaatatggacttgataaagtatttataaaacataacgaaagaagaaattatctaaattatgatattgcatcaaatagcccacaagaactagatcttaacttaagagaggtaatgttagatttagataaaaagaaatatccattttctgttacattaggatcaacagtatcatataaaaacttaaataaagaagaactatgtatcacaaaaattgttaagtacaataataaatatagctttatgtctattgaagaattttgacaagaggaaatatataaagtaaaaaatatgatatttcatttataatatagagtataatatagaagaaaactttactcaaaagcaacttaaggaggaaatagcattggatagaaaaattgtaaagttagatttagctttaatgctcaatagcgcacttatgggtgcatttgtaggactttttacatggacgtttttaggaattgtaaatataggtatacactttatatggcatactttaaaagatttttttaatataaaatattggactttaatagttgcaagtataggtggtattttagtcggaatcacgcaaaaatattttggagaatacccaaaatatatggaccaaactttagcagagtttaagaaaaataaaagagtagaatataaatcggtaaaatattctataataaattctttaacaatattattctttggtgcaagtgttggaccagaggctgcactatcaggcattgtaggaggagtaattacctttgttggagataaaatgaaagaacgatttaagaaaaagaacgttgttaatcagtattcagatgaactaatagcatgtagcatgcaagttagtacagggattatattcaacgcccctttatttggaatatatacattaagtgaaaaaagttcagaaaatagaaaagtaataaagaaaataaaaacaattgtttacactgtaacaacaatagctggttttttagtatttatattattatcaaaatttgataatagaccttcatttatagttaaatttggacaaagtaatattggattgaaagagattacttggtttataccattaattattatagctatgttacttgcatatgtatacaaaatgtacgctttagtactacataaaatattaaagcctattgaaaataaaaaaatactaaaaggaataattggaggattagggataggtatattaggaactattttcccatggacattattttctggagaacatgaattaaaaaagttagttgttgagtggaataatatatctgcttatatgcttattttattatcattagtaaaacttttattgacagagatatgtttatcaacagggcatagaggtggacatatatttcctttgatattttctgggagttgtctagcttatggattgtctaagttgttttctatagatccagttttttgtttgtctataatagttacagggcttgcaagtaaggctataggaaatatgtatgtagctatatttttattgatatttttctttccaattaatactataataccaatggtattatccgcagctataggcaaaatgattaatgatattgaaactaaattagtatataaaaattaaagtattaagaaataaatcacgggttttattcctgcgattcgttttaatcattaaagttcacgacaacacattgataatttaatcaatgtgtttttttatattcatattatggataaaattaggaggcataccaatttcctttaaagtatatataacactaaataaatctaattgatactcagaataatatatatttccaaccgttattatgatggtatttttctcgttaagtacaattatagatggtatattcgtatctagatatgtcggggcaaatacattatctgcaactaatattgtttacactgtaataaatatttcaataggtataagtataatggttgcaactggattaatagtggctgtattatctattatatttataaatgatataaattacgcactaggagacgcacttgctacttgtgtaagctatgcaaagcctaaatttaacatgaaattgattttatatagttgtatgaatggatctaatgaaatgggaactcaaatgtcaggtgcagttacaacatttatagtttctatgatatttataaataaataataagtatatttatatgtatggaaaaaaggatgagagtttatattttgcatagttaatttaaaataaaaatcaaagcttaatacaagataaaaaaactcatacactcaaatgtatgagtttttttgtttataaatactgataaaaaaattttgttacttagagaagtatatgttttcttagttaatgtatatttggttgggtacttttatagacgatatacttaccagactggtcttaattttggtgataaattacctttatttgcttcataaactaattttgttaaatcttctttgagtatttgcattcgttcaatacctatgatttcaatccaacgttgctcaatatcagttagaatctcctcttttaatttcattactaacaaaccttgttcggtcaaaacaataattttccctctcttatcagtgggattagtttgacgcactacataaccacttttctcaagataatcaaccattttacttaccgcttgctttgtaattcctaagtactcagctatttctatgcctgttgctccgtcaggatttatgaatttaaacataaaaccatgtgcaggtctaatatctccaaatcctaactcactcaatctgtcgtttagttcatcaatcaatgaactaaaggataatgataaaagtgatgtaagatcaaattcactaaatgtttgatgattcatacatgaaacctccttaaataaagtcaattaagttgactttatctgaattgtattttataataaataatatagtcaatcaagttgactatattatttattataaaataaatgggaagacctagtaagaacaattactagagcataagggttagtaataggaggaaaaggggcacctcagacggttagtgttaaattatatgaagcttttttagaaagttataaaaaatcacatccaaatgatacagtggcagagcttgatttatacaaggaagagataccatatataggagtagagatgttttattaaattaaatattagttagctaaatatataatttaagaaatcttatttataaaatattaatattacaaataagattttagaattaaaatattaaacaataaatttaaatgttgggagaaatatatatgacactagaaatgaacaaatacttacaagttagaaaggctcaagcacagggagctagaactattgaagaacttaaagaaatatctgatatagttattgaaaacgaagaagaacttaaggaggtagaagctcttataaaaaatgcatgtaaatgtaaaaatgtatcaatagatacaattgtagaagcagtaaaaaatggagcagatactgttgaaaaagttggagaagttactaaagcaggtacaggctgtggaagatgtaaaagcattatagcaaatatcatagaaaataaaagataattagtttacaaatttgttatagatctaactaaatgatatgtttaaaaacatatcatttagttattttattattaatatacaactataccataccttttcaaaatacatggtgaagtattttaatgcgaatatagagagatattttgggaaagcaattctccaacttgttttgatatttcatcagtactaaaatttaattcatccaataaaaaggattctaaatttcctaaaacagccatacttaaaaatcttttaagtatggctgtatcttttttaggatttattttatttatttttttacttagctgattcataataaaatctagaagctgtagtcttaggctatcaaatcagtgctttttttattgcattttttaatataaataaatttgtaatatatataagtataaaaacatataaatatataagttttaaagcaaattaacgaaggggatgagcgtatgagatattacagtaaatctactaatgaagccttaaaatatctaaaagtaaatcctgaaattggattaagtaccaatgaggtagaagaaagaaggaaaaagtatgggtacaatgaatttaaaatcaaagaaggtaaatcattaatagaatcaataagtgacagtatcatggagccaatgatattgattttattaggtgctgcagtaataagtgcatttgtaggtgaagttcatgatgcatttggaattttaggagcaataattttaggactatccataggagcagcaacagaaagcaaatctaaaaaagcagcccaagcattatcaaaattaactgaaaatatagaggtaaaggtattaagaaatggaaaaatacatcaaatatccaaaagagatttagtacctggcgatattatttatatagaaagtggagatatgatacctgcagatggtaggcttatccagtctattaacttaaagttaagagaggacatgcttacaggtgagtcggcagatgttttaaaaaatgcagaaaatataatagacatggaagtagtatatggaaaaactgagataatagaacaagatgctataccagcaaaacaagttaatatggtatttggaggaactcttgtagcctatggaagaggaattatggtggtaacaactataggagataaaacagaaatgggtaaaatagcacaaaatataggtgatgatgatatccaaactcctcttcaattaaagcttggaaaattaggagctagaatagctattgtttcagggattgtagcatttttactatgtatgtatatgattatgaaaatgaatgcaaatggagaaataatattagatacttcaggaataataccatttttaaaatcactagaaccagcaaaaggagcatatatggtttgcatagcattaattgtagcaactgtaccagaaggtttacccactatggtaaatattacattggctataactatgcagaagatggcaaagataaatgctttggtaactaaaaaagaagcttgtgaaactatagggtgtgtatcagtaatttgttctgataaaactggtaccttaactcaaaataaaatgatggtagaagttgcgtatatagatggaaaatatattgatagtagtgagtatcatagtaatagttactttgaagaaaattgtatagtaaactcgactgctgatattgaaaaagaggataaagattacaaatacataggtagtgcaactgaatgtgcattacttttatatcatagaaataaagattataacaaatttagaaaagaagttaatttagtatcacaagttccttttaactcagataaaaagagaatgtcatcgttgataaatatggaggataatggagtatttttaagtaaaggagctccagaagttttgttagaagaatgtgaatatatgcaaaaaggcaaagatatagtaactttgactcctcaaatgaaaagaaatatacttaatgaaattagaaagcttcaagttaagtctatgagaacattgggatttgcttataaaactatagataaatcatctatgcaggttgcgctaacttatgaagatgaaattgctagcactgaagacttaggaatttatgaaagaggcagagatttaatttttggaggttttgttggtatagttgacccgttaagagaaggggtaaaagaatccattcaaatagcctatgatgcaggtgtaaaggtgaaaatgcttacgggagataatataaatacagcaaaggctataggaaaagagataggtcttttagacgatgggaaaaaagcagtagaagcaacttacatagatatattatcagatgaagaattaagagaagaaataaatgatatttctattgtagctagatctaagcctgatacgaagatgagaatcgtacaagcgcttcaagctaatttagaagtagtagcagttactggagatggtataaatgatgcaccagctttaagtaaagcagatgttggaatttcaatgggtatatcaggaactgaggtttcaaaaaatgcatcagatataatactgacagatgatagctttagtactatagttgatggtataaagtggggaagaggtatatatgagaacttccaaagatttatacagtttcaacttactgttaatatagtagcttttatgatagctgtaatatctcaaattatgggtacggaaatgccatttactacgatacaactattatgggtaaatataataatggatggaccaccagcattagctttaggattagaaccagttagagattatgttcttaaaagaaagccaattaaaagaaaggctagtattatagcaaaaggtatgttagtaaatataattataaatgcagtacttataatatcaatagtgaatcttcaatcatttttcaatgtgttaaacgctactccagaagaacaaggaacagtagtattctcagttttcgcatttagtgcattgtttaatgccctaagttgtcgtgagtttggccttaacagtgtaataccaaatttctttaagaataagttagcattgtatgtaatttttataactggtatagtacaagttttatttacacaagtttttagaagcttttttaattcagtagcacttagcaattttatgtggataaaaataatacttctttcatcaatggtacttgttttaaatgaagtagttaagtttatacttagagtaatgaaaaaacaaggacatatggttagaaatataagaagagtttataaataatataatgagtttgagattatatggcattttccttcactgtaaagactaaagagcagggctttaacgttttgtaaaattgctagataacctcagacttttttcgtataataaattaaaaaatttgtgataaacaagagctagtttgtattactagcttttatttttatcttaaatcttatggaatataaacttattggtatattatggtaaaaataaattgatagttattaatctactaagtttttataatcatatacttctatgggtcagatagaagaaactagattagataaagaatttttagatttgactataaataagttaacaatattacaagaattaggtaaaaattctagttataaagataaagtttatatactagatacatacttttaaagtacaataaatgctatgaaagaattagaaaataatttaaataataaaaattacgtattatattatagattataaaggtacagctagaatatgtatgaaagagttaacaaagacttgttcaaatgaaattatatcatgaagtaaacaacagatgactataaaaaataatatttttaaatcatatacatattttttataatagtggttaatatataattaaacagttaataaaactttaagtttaaaattttgtaaaaaaattattacataaatcttaatatattaaaaataaactacattcaagtttacagtttttataaaaaagggttatctttaaaaaattatagataacccttttttgttttgtaaatttataaaaattttaatctaacacttcaactaaattacttttaaaattgtataaatctttctttttataaactacatatccaataatccaccttacacaaacatcaagtcccatagcaatccatacccattgaatatcaagttttgtaaaatagacgattaaaacagtaagtggaacccttattccccatataccagtagcagatataagcatcggtaattttgtaaaaccagaacctctaagtgctccatttattaccccacctaaatttcctgcaagttgtataactcccataactattaaatattttgctgatatatttattaactgactatcattagttaatattaacataagttgttttggaaaaaatattaaaggtatggatgttagtatcgttattactattgtagatttaaataattctttcatatatcttttgcctaatttttcattattagcgcctacacactgacctacaaatgcagttgctgctattgcaaatgcgtttgatggcataaaagatatagattctgcttgaagccctaattgataagctgcaagtgtgacttctccgtaatttaatatcgctcgagttaatattatagttgataattgccaaaatgagttttcaagagatattggtattcctattttatatacatttttaatttgatttatatcaggcttaaaatcttttatgaactctttaatattaatttttactttatctatttgttctccaaaatatacatagcctttttttctattaaacattaaataaacaccataaaaacaagctataaaataaccactaaaagttcctatagctgcaccttgaactccaagatttggcatattaaaattaccaaatataaataagtaacctataattatactagttatattcatagacatagctattttcatagatattttagctttattcatagattgtaaagaagatgtacatataagcatcatactcataaaatataatgaccaagaagaagtttttaaacacttagatgctatatacattaattcactacctggatcgaatatagacaacacaaattctgtgtttagaaatatgaattgctgaattaaaaatattaaaatactaagtcctatcatagtctgttttattatatactttatcttttttgtatttttagaaccataagcttgtgcaacgaacactgcacttcccatagttattcctcttaaaattgcccaggttatattaattattcggttacttagactaaaagcacttatagatattggatctagtcttcccatcatacctgttaggcaaaatccagaagtcatttgaagtatactttctataactataggaagtaccattatctgtatggcttttcttatttcattttgacttatttgaatcttagcctccatactttaccccccaatattttactttacattcaacttatattgtagcaatgtttaatatttttgtactcataggataaattttatatttataattttgttattatataaaaaatagatataccaaaagtgactataattttttgtacacttaaatctcctttggtatatcctaattttttaaattttattattttcactattgttattccttaaataccttctataattcatcatgtctatggctactaaactaacacctataccggtaatcacagcacctttcatttcacctgttataattccaactattattcctattaatattcctaaaattatatatattgttgactttactttaggatttaattttaacttaatgtataccgccattcttgagtataaaaaagctccaactattaatccaactaaagataatattatggtgtcttgtatctgtcctaaaattaaacctgttccaatacctattaaaatacatccaattgctaccatttacaagtcccctttattctcttttatatatcttatgctactaaacttgaaaagttacttaatttattgtacataggttaatattttatattgatattttttgtgttatactatttattatgataatgtcatttttaggaggtccttatgtcatttttaactttattaattggattcgccctacttattaaaggagcagacatatttgttgatggggcatcttctatagcaaaaaaatttaatgtttcacctatgctaatagggttaactatagttgctatgggaaccagtgctccagaagcagccgttagtgtatcatcttcattagctggtcaaaatgatatgagtattgctaatgtagtgggttctaacttttttaatatacttatagttttaggagtttcatctatcatagctaaattaccagttgaaaaagagactataaaaaaagatactccatttttaatttttataagtatattgcttttagctttaagtcttaattttaatttaagcagattagatggtgtgatttttttagtattatttattttattcttaataaatatgataaaatctaatataagttcaaaagatattgaaagttctagtggagaaactgctatagctattgaagctacagatacaaagtctatacatatgcctaaaacattactactttgtttaattggtatagttggaatagtatttggtggagatttagttgtaaactctgcaactaatatagcgacatcatttggtatgagtgctaatttagtaggtcttactatagttgctatggggacatcgcttccagaacttgttacttctgtaatagcagtaaaaaaaggtgaaacagaaattgctataggaaatgttataggttctaatatatttaatatattattagttttaggtttagctgctttaatacatcctatggcagttagtgtggtagccataatagatactatttttatgactgctgtaacaattcttttatacatatttattaaaaagaataactcacttactaaaattcacggtataatttttgtaataatttattttatttacttaatatatactataataagataataaacaaaaagaaatatggactaattttaaattagtccatatttcttttttattactttaacttttgaagaatttttaaagttaaaggatatataaattctttatgtttataatactgtattatagccattatacatattactgcatatataatagtcattacaggtaataaatattttccaacttctacaaaacatagtaataagactataatttcatatattacaaaagatatgtaaaaatcaataagtcttgttccatttcttttaataaatgtcgactgttttccataaacttggcatgtaacatatactattatagctcctattatgttaaaaaacataacggctaatgtcataactatcatcatagtactttcattttttgtacatctttcacaatctgccatactaataaaaatcctttctctaaatacttacttttatattttgaactatatttttaaaatcgtcaactttttaataagtatataggtttactagttcaaattatttagatataatttttataaatatataataataagggagatttgttatggcaattgaaatgagtattaaagacttatataaagttggggaaagctttgaaagttgtgttggtagtggtagtaaatctgaaagagctagaataccaaaaaatacatctagaattaatttaagtgaagaacttataaataaaatagctacttatccaaataaagttaactgccttgtttctggagaaatatggtgtcctgattttcaacttaatatatctgttttgaaaaaatttgttgatattaatgataattttgatatatcagtcataaccatgggtagaggcaaaaaatttatgagtgaggctttgaatatagaaaaagaaaaatttaaaggtccaacaattgcttttttagatgaaaattatgaaataattggcatttttgaagaaagaccaaagtcagtactcaaatttgaaaattttgaagatgtaaaaatagattactataaaggaaaatatttatctgataccattaatgattatttagacattttagatatattataaaatataaaatttctaaatttaaaaatgtgtatctcaaaaatctgagatacacattttattttttatggaattaatgtatcaattccatttatatacttttcctcttctattgaagatattgaacttaagtttatacttacaccacttttaagctcaactaacttacatggtaattctccattttcatttaatttatcttttaaaaagttttctataaagtcttttacatgtttatagtcagcttcgtattcatttccatctttcattaggatctttatcattgttgccatctccttgtacgaattacatatcctctactttgatgtctatgttttcatcatttgcatctataattacatgacaaccatcatatacttgacctgctattatcattttagctatcttagtttctaatatatttcctatatatctttttaatggtctagctccatatatagggtcataaccttcatttattaatatatcttttgcactatctgttatgcttaaagttatacgtctatcttttaatcttcttcttaaatcatctaagaatatatctattatttttcttataccttctttatcaagtggtttaaacattattatatcgtcaactctatttaaaaattcaggcttaaatcttcttttcatttcattcataacaagttcttttgttgaatctgttattttaccttcaccttctaataagtatgaacttcctatatttgaagtcattattattatagtatttttaaagtcaacagttttacctttattatctgtaagtctaccatcatctagtatttgaaggaataagttaaatacatcttcatgtgctttttctatctcatcaaatagtataactgaatatggatttcttctaactatttcagttaattgtccaccttcttcatatcctacatatcctggaggaggtcctataagtcttgatactgcatgtttttccatgtattcactcatatcaattcttactatattttcttcactatcaaataaatttctagctaaagttttagcaagttctgttttaccaacacctgtaggtcctaagaatataaatgaacctattggtttgttttcatctttaagacctgctctatgacgaataacagcatcacttacagcagttactgcttcatcttgtcctataacacgagttttaagttcatcttctaatctaagtaatttttctttttcactttcaactaacttagttacaggtatattagtccatttagctactatttgtgctatttcatcttctgttacttcttcttttaataaagatgtttcattgtcttgttccattttatcttctgcttcttttatctctttttcaagatttgggattaccccatatttaagttcagcagctttatttaaatcatattctctttcatatctttcaacctctcctctagcttcatcaagcttagctttaaggtttcttatattcattatatgagatttttctttttcgtatattgcagttaaatcatcattttttgattttaaatctgcaagttcattttgaagtttttcaactcttcttttacttgcttcatcatcttctttaagaagtgcttctctttctgtttctaatgtaaatatttttcttctaacaatgtcaagctctgttgggagagaatctatttcactacgtatcattgcactagcttcatctattaagtctattgctttatctggtaaatatctatcttgaatatatctatcagataatttagctgcagcaactattgctgagtcgtgtattcttatcccatggtgtatttcaaatttttctttaagtccacgaagtatagatacagtatcacttacactaggttcatcagctataactggttggaatcttctttctagtgctttatctttttctatatattgtctatattcatcaaaagtagttgctcctatacaatttaactctccacgtgctaacattggtttaattagatttcctgcatccatagcaccatcagtttttcctgcacctactattgtatgtatctcatctataaataatataattttaccttcagaagcttgaacttctttaagtactgcttttaatctttcttcaaattcccctctatattttgcacctgctattaatgaacccatatcaagtgcaaatataattttatctttaagaccttctggaacgtctccttttactattctttctgctaacccttctactatagcagttttaccaaccccaggttcacctattaatacaggattatttttagttcttcttgataaaatccttataactcttcttatttcttcatcgcgacctataactgggtctaatttatttttcttagctaaatttattaagtttgtcccatatctagctaatgcgtcataagttccttctgggtcttgagtttctactctttgatttcctctaacttttgataatacttccataaaattatttttagttatgttaaattgtttaaatattttacctatatttgaatgtttctctaattctattatagctaaaaatacatgttcaacacttatatataaatcattaaattctttagatatttcttctgattttaaaagtatctcatttaattttctagtagctactacaccttgtgaactagctgcctcaccttgtatttgaggtaattttaaaagttcagtttttacactagcttttaggccttcaacagatatccccattttttctattattctaggaattaatccatcttcttggtctatcaatgcataaagtaaatgaattgtatctacttgttgattatgatttttaacagcttcactaaaagcatcatttaagcttttttggactctttgtgtcattttatctacttccataaaaaactcctccaaacttttaatctataattttaatatttttataccactacaagtacagtttaaacacatgttgtcaatgtaaatatattcttatttttctctaatttatgaaaacttttatttttataattaaattttatatttaaaatttattatttactttaatttatgttataatgcatttagaaaacgttattttaaaacttaaaaggagataaaatgataaagtacgaaaataaaaaaataataaattcaacccctgataaaatatttaatgtatttataaataatgctaaagatacatttgaaaagataaatattaaaaatccagttggatgtaaaactataaaagaagttaaaagagattctaaaggcaaaaaactatataaatcatgtcttgaaataacagattttaaaaaagataagctatatgaaataacttttacaacagatggacaaacttttatatctaaacttgataaataaaattgtaattgcctatgaagatttaggagagaagaaatttataaaaaaaatagttaaagatataaatattgataaaaaattatatttattttattttaaaagaaaatttatacctatatgtaccctcccaaaattcagaattatcttagtgtctaagcagggattcatatctttttgttataattttttttcttttctacactcaaagaacttatttataaatgtatcttataaaaatataatgtctatcgctaaatttgttgtataccatgaggtaggccatatactagataaaagtataaatgataataaagttgaatataatcaaacacttaaaactttcattaataaacttattgaatacgatatagatataaatgtagaaaattttcacaagaaaaatctgccatcagatatagaagagtgcgttttaaaactaaaaaaaaatttgataaatagagaatctacagcttggaaaatagctcatgatttaattgaatttgaggataaaaacgaagaacttatattcaataatatgagagaatatgctctagcaacttataattttggaaatatccaaaatattattaatgaaaacaatatagatgttttcattaaatacaaaaaagcaatataaaaaataatgaggacattaagtccccattattttttatattatctatgtacaggtatttcaaatattaaattactattagtatcatacatacctataaacttatacattattcctgatatagcattcgcccagtttacgtcagttgcatattgatggtgtaaatgatcataactccatctcattttatacagtgtattttgaccgtagctaccatgatgtatataattcgaagaaatccatctggccgatccttctatagttttttctacactagtccatccatttttatatgcagcttctgctcctgataagtttgcagttccatcaaatgcccctatcccaaaaaagttatatactttaactggctgtggtagaggttttcctttatatgaagttagaacttgtccttgagcaagtgtagatcttccatatccagtctctaacatagagtgtcctactaaatatgataaatctatattgtacttacgagctgcatttataaatgcttgaccttgattgtaaaatacattagttccacttgatgcaggttttagactatttaagtatccatttaactctcctgcagttattcctcctttataactatctaatcttaggaattgtaacattccttttttcccatttttaaaattattaggatttagataatgttctatgtcagatctacttgcattaataaatcctcctgaagatgaagctatcatatttacttttgataactgcttattaatatggtcttgtaatgaatgattttcatatttataattaacagttgctccatttactacttctgaactatctcctcctgaactaatatccccatcataatcttttaagtatgtacttgatacgtatgcttcttttccattgtattttatctttgaccatccattactttctgatatcacttctactttttcattatgttttagcgttcctattagtccatgacttgttgatggtccacttcttacatttaatgatgttgctgttactatctttattttagcagattcttgattttcacctggattagttacttctccattttcagcatcttttaagtatgtacttgatacgtatgcttcttttccattgtattttatctttgaccatccgnnnnnnntaagtatgtacttgatacgtatgcttcttttccattgtattttatctttgaccatccgttactttctgatattacttctactttttcattatgttttagtgttcctattaatccgtgacttgttgatggtccacttcttacgtttaatgatgttgctgttactacttttgttttcgtagttccttcatttggtttttcacttggatttggattagtatttgtgttactatctccagcatcttttaagtatgtacttgatacgtatgcttcttttccattgtattttatctttgaccatccgttactttctgatattacttctactttttcattatgttttagtgttcctattaatccgtgacttgttgatggtccacttcttacgtttaacgatgtcgctgttactacttttgttttcgtagttcctccatttggtttttcacttgggtttggattagtatttgtgttactgtctccgacatcttttaagtaaatacttgatacatagcctactcttccaccatattttatctttgaccatccgttactttctgatatcacttctactttttcattatttcttaaacttcctatcaatgcattacttgttgacggtccacttcttacatttaatgatgttgctgttactacttttattttggttattattgtatctggtaatgtttcagatggtttttcaggttttttatctggtatatcaccatctatgttcgataaaaattcacttgatacatatcctaatcttccatcatattttacctttgaccatccattattctctgatattaattctacaatattgcctttactcaacttggcaattactctataacttgtagatgctccacttctcatattgagagtatctgcattaactatctttttattagttgattgattagtattacttatatttgtgcttatatattcactagaaacccatccactttttccatttgccgcacttattttataccatccattatcactttgaagtatagtaaccttgtcattttttttaaccgtaaaaataactgaatgacctgttgatggcccacttcttacatttagcgatgttgctgttactatcccttcttgattggatgcaaatgcatttgtagctgtcaatggtattaatgctagagtagccattgctatttttcgcttcaacacatattcccccattctgttgatatcatatacttaagttaattatacgacaatttgtgtatatattaaatataaaaggttaaaattttgtaactttttctataataggtaaaaaaacacattaaccaatatgtattttatatttttatagcaaaataaaagagatggtatatcccatctcttttattcatttataactatagctaaaatttctaattcttcatctccagtattttctaaataatgcgattctccatctgccgtatatactacatctcctgatcctataggttgcataaatccattatctaaaactcttccttcaccttttattatgtaatatacttcaaaatcatcagtgtgatcatgtactcctatagaagctcctgggtctaaaaccaatctagatattaatttagcttttccttttaattctttcccttcaattaaatgatacatagtagtagttcctctaccatctcttaacttatttactttattaacagttaattcttgtggcctttttatcatttaaatctcctcccctatgtgattactataattttaacatatttacaaaacataatcatacatgagagttaaaattttataaatttatttttttacatcaactttatattttttagttaatttttctatcaaagtattttgtttttctaacattaattgttcttttaatgattcttttacatcttctaaagactgagttctttcatctgttttctttattatatgatatccatattttgtttctacaagttttggatttatctcacctttatttaacttaaatgctgcttcctcaaattcagaaaccatctgtccctttccaaagaaacctagatctcccccactttgagcacttgtatcctcagaatacttctttgctaactcttcgaaacttacaccttctagcgctttttttaacacaccttcagctaactttttattttcctttaatttagcgtcatctaatttcttatcattttcatccgtatttttaattaatatatgtgatgcttttacttcattaaatttttctttattttcattataatatttctcaacatctttatcacttatattagattctttttctatttcttttgttgctatagtttctttttctattgtttttttaatttcatcttttgttaatttaaattcctttaaataactctcttcatctaacccaaaactttgagatatagttgtcattaacgacttatattgactttctatatcatttttatctactttaattttatttttaaccccttcttgatataacatttctgtagttgttatataatctatcatattttgttcataataatctatctgctcatcagtcattttagtttttccattcatataaaatataggttccattctgttttttaattctttttcttttatcttcacatctccaactgttgctattatcttattatcactataatttctacttgttgctggtaaaactcttcctttttcctttcctatataaaatccggaacctatccctacagttagaatacctaatacaattagtatttttttacttaaattctttttttctttatccatattttatttaaactccttttataattttaaattgtttataaatactctacattatagatgtgaattctatatgaatacaaaatattttttattatatgtattttcacattaaaaaataaagtaaaaatataatttattttaaaattatatttacattttattttttttaaactataataatattcagaatatttttcgtaatcaacttaatttataatagatatcgaattatattttaattattaaaatgtcctaaaaaaagtatgaattatttatccatactttttttattataaatttcattaattataaatatcttgataatacatattcctttctagacaattcatatctatggcatttaacgtatcttactttgttttttgttacaatttttttatcataagttgttacatacttaaatcctaaatttttcaaagattttgttgattttttattatcttcataagttgttgctattaatttttctagttttaaaaatttaaatccatattctaataagtatttcgtcagatctgttgctatatcatttccccagtacaatggatttacacatatacccatatatgcttctgtatctttttcagaaacatcatttaaacctatatttcctattaattttttattatgcttatctataattgcccaatgatttacatttccttttttataactatctataaaattttttcgtataaatcgctttgtttcgcttatggatttgtgtacttttataggtaaatactttactactttctcttgactataatattcaaacatactagttgcatcttctaaggttataggtcttaatatatatttattactttctattattttcatttgaggatatatagagtctttcatataataattacctccttaaagttcaataatattatttaatatgcttatatgtttaaaattgttaatgtatgtataaaaaaagatataaagagatattttaaaatacctactttataccttaattgatcatttttattttctgtgaagctttgagtaaactcctgatttttcaatgagttctttatgagttcctctttcttctattccgttttctgttaaaactattatttcatctgcattttgtattgtcgataatctatgagctacaactaaattagttctatttctacctagctcttctagtgatttttgtatttcatattcagtaacattatcaagtgctgatgtagcttcatctagtatcattataggtggatttttaaggaaaattctcgctatagaaattctttgcttttgacctccagataacttaactcctctttcacctacataagtatcatagccttgcggtaatgtcattataaattcatgtattcttgcttttttgcaagcatctattacttctgcatctgttgcatctgatttacctattattatattttcttttatagttccagtaaataaaaatacatcttgtgcaacaactccaatattttttctaagtgaatttaaactcacctctttaatgcttttaccatctattttaatatctccctcagagaaatcaaaaaatctaggtataagattacacaatgtagttttcccaccacctgatggtccgactaatgctactgtttttcctgcttctatagataatgtaagattactaaatacttcattatcatcttcataagtaaaagatacattttctatttctatatttccttttacatctttaagctctataggatttttagcttctttttcagtttcttcgtttattatctctgtaaatctttcaaaccctgtcataccgttttgatattgctctgtaaagtttattaactttctaataggctgtataaacatttttacatataatagatatgctgcaaaatctcctaagtttatataattcatataagtaaaatatcctgctactattaaaactaccaattctagtacgtctataaataaaaacattccagagaaatattgtgccataaccttataagcactttctcttgcatgtctaaatatattattagactcattaaactttttaagttcttcttcttcagtacaaaatgattttgtaactctcattcctgctatactattttctaaagttgcatttacatcaccagtttttaccctagtttctttaaaagctctgttcattctctttctctgagttatagcatataaaagtataaatggtaatattgcaaatacaattaatgtaagtggtacattaattctaagaagtattaaaaatgaaccaaccaacataactaaagatacaaataaatcttctggaccatgatgtgcaagttctgaaacttccataagatcatttattattctggacattataactccagatttattattgttaaaatactgattaggaagtttttgcaagtgagtaaatacataacttctcatatctgcttgcattcttacacctactacatgaccccagtattgcataaagtaatttaatcctgcctttaatataaatattaataataaacttatagcaaataccatcaacattcttaaatctttatttggcacaacttcattcattatatttctagttatcataggataaactaaatcacacaaagctactgtaaaagccgctaataaatcaagtataaataactttttatatggcttataatacttaataaattcttttaacataaaatacctccatttctctaatattatatacccaaaatgcaatgaatgtaattaataatttcaattatattctaaatttaattatttttgcaaatttagatatacatctttaaatttaattaattatatgactattctaaatatatacattttattcctaataagctatattacttgtaactttacttatttcatttaatatttgttttaaataattttttatcaaactactcttttttattagattggcatctggaccacttgggggagaccaacaaattgcatataaacctcataaaaattttagaggtatttttaagactataactagtatactctttgtaactatagctataagtggatatttagaaaaaagtagcaattttatttattttatttttattcttttaggtcttttattttctctatttggagatatatttcttatatttaaaaatgaagataaaaatcatataagtaaattttttatctatggtcttttaagttttagtctagctcatgtatttttttcactaggatttatatatcttagtaactttggctttgacactatactatttacttttttactagcatttgtagttttatttattttaaagtctataaaaaaacttgattttaaagattccttttattatgtagctttttattcagttgtaattagctttatgtttattcaatctttaaatttatacttttctagcaacttttataacccttatgttatatggatcacaattggtgcattattatttgttttatcagatttaatattatcatttgactacttttataaagattgtcctaagtttatagcagttcttaaccttttaatttactatatagcacaattgcttatagctttaagtatcttgtatatataaaaaaagcttatttgaaatagattatgtctacttcaaataagctttttatcttaagacgtatgaagtgaaatttttggcttgactccaacatttaaagatttacaagtcttagtatataataaacttaaatttggtaaatttttattctttaatttatcagttgtaaaatctgtaaataatttaaaatataaaaatttccaactacatataaacaataaaactccaaccaaattgtctataagtagccatttattattaattttaatgctatcttcatatatcttaggcaagcttaataaagagtcgtatacttgtcttctttcataattatttattgatattttccctaatttattttgtattttctcatctaaacttgcactagactcccagttgtcatatttatacccatttacataatatttgatatttccatcatctttttctaattgagaatataaattgtcagttactactacaatccatatcccaatcccttttggaagtattttaccatctgctataccttttacttttagattataaagacctatttcaaaattagtaaatttacttatatttttcttatatcttttattatcaaatcttggtactattaatgtttcatcgttatttaacttaacctttcttaagtttaacttttttgctaccttattaaattctgagttttttattacatattttccttcattatttatatttaatatttcaaatgcagttttatcataatcgtatccagctttatttaatgtattttctataacttctacttgttgttttttcacgtaattataatttgaagatatatagtttaatacaaatggataatcagctttttttacttccagtttattagctaacactatatgtaatataattacacatcctaagcttgccactaaaagagtactagttaaaaataacaattttaagttttcttttgatatattatttatttttaacatttccatatttatctgctacctttccttttgtttatgtaataataatatatcaattctattttttttagtatttatctagattacattaaagttacttttttgtaagataaaatacataaataaaaaaacttctttaaaatagactatagaccttttctaaagaagtttttattaacttttattattaactatttttcgaaaaattctttagcatatactacctttccagatacatctttaagtgcattttcttcaagttctattgccataaagtttggacttggaacctcaaaaggtggtctaattccaaagtttagagcttcttcaaacccgaatttaggataataattttcacttccaagtacaataactgatttatatcctagttcttttgctatatctagaccttcattaattaacttgcttccaataccttttttttgataatcaggcaatactgcaagtggtgctagtgctaatgattcaaatttattatcttcattttctattaaaagttttgtaaacataatatgaccaactatagtttcaccatctaatgccaccaatgaaagttctgatatataacttttagaatttctaagcctattaactaagtcttgttcatctccatctgaatgaactccagttttaaaagcctcttttattaaaaaataaattatatctatatcttctatattttcttttctaatatttatattcatataattttcactccctataaaaataaaaaaatattacatagagtatatcagattcaacctacttatgtaatatttttttattggattttttatttataatttaattttatacaacttgctttttaccaattttattaataaagtctagtactattggtatactaataatccctattgtaactattacatttaaatataaaactggctttccaaatatgttatatgtacttatacttccaaacatacttattggtcctattaaattttctatatttagttctgcaaaaatcttagttagagtatatgttggcataaatctacctataaattctggacctaatagcatagctacacttactgcaaaagatatcatattatttttacttattaatgatactaacatgattaataatgtaaataatacagtacctataaaacttactattaatccgcaaacatagaaagttcctatattcatagtataaggagttcttacataagatgataaaaagctcatcggtacatcccaccccttaaatccatgcattgcaagtattatcacctgtattccgttcataattaaaaatacaaatgtagaaaatatcaaacctgttattatcttagcagtagttaattttttttgcccatttttagaacttaatactattgatgccgtattactttgatattcattactaaatatggtacatatagaaacaagtattaatatagatatccacatacaattcatattaaaatttgttgcctctctccatccaaacttaaagtaatatttcggagtttcttttttagatactaagtcatgtatataatttaattctttatattggtaactattagtatctccttctttttctaatctttttagttcttttttcatatcatcaaatttataaaattttccatttatcatatattcaggattgatccatattaaataatctgtcataccaaaagcttttactttttctttgtcactcagcatctttccattattatattttgtaagtaaatcaccgcattgttttttaaatatatcatgtttcttctctgttatgatttgaccttcatattctttacctattttctgtatactggagtagcttaatccctttgaccttatatctaaatagcttgttactgtatttgataaagacgctactatacatccaactaataatactaatactattttttttgaaaaaatcttatacaactcaaatttaactaaatctttcatatttatccccctttataagtcagtactaatctcaaagtaatataaaaataaatcttctaaattaggtgattcttctataacttcaattccatctattaatggatattcatctcctacaactctaactacaatatgctcatcatctcttataatattagaaactttaaatttactttgtactttatgtaataaatcctcctttatctttaaactatgtacttttcctctaatactatttaatatttcaactggagtagctttttcaaccaactctccatttctcataataagtatttcatttgctataaattctacatcagatactatatgcgttgatagtattacaatcttatctcttgatatctctgatattaagtttttaaatcttattctttcattaggatcaagccctgctgttggctcgtctaatattaatatctttggatcatttaaaagagcttgagctatacctaacctttgtttcattccaccagaaaacttacctatttttctttttctatctttttctaaatttacaaactttaaaagttcatcaatcttaacactagcttcttctctatctattccttttaatgttgctacatattctaagaacttttgtgctgtaaaacttttataaaatcccacatcttgtggtaaataacctaaaacatctctataatctgctcctagttcagttttactttttccatttaaataaacctctccactagtagcatttgaaacatctgcaattattctcataagtgaagtttttcctgctccattaggtcctaataatccatatattccattagttaaacttacattaaaatcatttactgcaaccttatctttaaatgattttgttatattttttaaagttaattccatatcttttctcccctaaaaatcaaatttcttatactctgtaaaatttatactttttttataaaatacttttaacgaaattatagttaatacccctagtattgctactattgcaaatagctttaagttacttacatttgcaatatttttaaaagtattactatctaccatgttcgaacatattatccatattccagttgataatgctatactgttcatgcttctatatatagatgctgttaataatgaaacagtagatataaaacaaattggtattaagcttgtatttattaattttaataaattaacttctgagtaagtatttgataatataaaactaacaaacaaacttatagctattgaagtaatacctattattgttaatttagcaaatactatttctctaaaagaaaatttatagctaagttctagttcccaaactccttcttcttttcctcttaaaatttctacaaaccctagtagtactggtataggtgaaattgtataagaatatacatatggatttaaattatattttatagttccaatcaatccccctaaagtaagtattaatgatactataatatacattttattaaacaccataaattgtattttcattaattctatatttgtctttattttatttactaagtatgtatttttatttactactaaatcttcacttgtactttgtggcatgtagtttattaatgtttctatagttaaatcaattttttcttcatcaactgtttttacaacataactatctaaaaagttttctatatccaataaatcttcttctaatagattttcaaattcataatcatttatatcatcacatctcatgttgtttatttttgatggtgtttttttcatagttatcacctccaagtaatctttttaagtttttaacaccattaaataatcttgattttatggtgttttcattttctcctgtaatataacttatttctttgatttttaaatcattgtaatattttaatataactgcttctctttgaagcttaggtaaatttccaatagcttcttttatcttaattgcctcttcctttttcgataaaatatctactacgttagttctatcttctatttcctgattagatatatcatagctttgtgtcctttgtttataagtcttacttctgaagtaatcctttgtcgtatttacagcaatttttaatagccaacttttaaatttcccattttctatttgatatttatctatatttttcatcatttttataaatacatcttgggttatatcataggctatattataatcactagtatttctgtaaataaagctatgtactaaatcgtaatatcttttaactaaaatctccattgcactttcattaccttgtaataattcctttattaacttttcatctgtttgtgccaatttatttccctcctttcacttatataacgaggttaacttataaaaaattttattttatctattttattttaccaaatttttactgacattatttttcccatagtaatttagcgaagtatttattaaataagatgtattaactataaatttgaattaatatttattttagggagggaatttttatgaataataatgaaaagtatcagagcaataataaagttgtagttcaaaagtcagtaaagtcagggctttcttttggagctggtctagcaatggtcatttcttattcggcatggaagtcaataccttgggctatatttcacggtatattaagttggatttatgtaatttattactggattaaatatacataattttaaataaaaaagccacaatctaatttagattagtggcttttttatttctatatttattaattttttaattataattttctataagatacttcatagtttgtttatccatagcacctggaacatattgagttatataaccttctttgtctattataaaagtcgttggatatgcacttattccatattgataagctaattctccattattatccataactacaggaaaagtatatttctcttgttgtaaaaattctataatatcttctttagatccttcacgatctaaatttggtgatgctactcctagtattactacatctttattatttttattgtattctttgtataattgttctatatatggcatttctgctttacatggaggacaccatgttgcccagaaatttaaaaatacagttttacctttgtaatcacttagtttatgttccttaccattttgatcatataaagtaaaatctatagacattattttttcatttttattttctttatctatactttggctatttgaattagaattattagaatcatttaagtgtttgtatacaccaaaagagccatttataaacataattaatcctgataatataagtataatcccacctatcttttttattaatcccatataatttttcattttatcaaatgttttaaataatttattataaaataatgatgctagtataaatggtaatatgaatccaattgtataaactagcataagtaaatttgacgttcctatattatcagcacttgatgacataataagtacagatgttagtataggtcctatacaaggtgtccatccaaagctaaatgtaaatccaaataaaaatgcagatataggatttatttgcttagtatttatattaaatcttttttctctatttaataaggaagattttattactcccatataaaatagtcccataaaaattattattaatccaccaaaaatcattattaaatctttattagtatcaaaaaatgattttaaagcatttactgatgatcctaatataaaaaatgttaaagatatacctaatgcaaaaaacaatattttacctattgtaaagtagttttccataataatctccttatttgttaaaattcaaattaatagttatatagattatattaatataaattttaaataactacattattatctataaatatatcaaaaaaacacattgattaaattatcaatgtgttttcgctcattttaatagttaggataaatctgataaatactctacattttattattatcaagggataaataataatcggttaaatctttatatactatattcccatcagcttcataaagtatacttaactttccattattgaaagataaacaagaatatcctccaccacttggattcccatcttcaggatatggaatacataattctttaacccctttagctaaatcatcaaaatcaatcatataaacagttatattatctctaatatatccaccttttgtatttttaggtgctgaaataaatcctaatctatgtccatctttagcagtaactttaataaatgaaccttggcatcctgatccattaccagttaatattttgccatgtaaaggctcatatacttcccatgtagatcctaaatcataagatatatatgatgatctataattatttccatcatttctagaactcataattaaagctccatctaattcaattaccatattttcagaagtttttgaattagatactttatttcccatagtccacgtttcaccattatcttttgaatatataactgatgaatagtagttattagcattgttttctcttagtgcaatttgtattggcattactattgttccatcagacattacagtaccagctccaacaccgcctaaccatccaatagtattacttggttgattttttattcttgctgtatttgtagttagatcaattttgtcagaccatgttgatccattatcatcagaataaaccatttgaacagaccagtcacttcttaatgaagttgtactgcttgcccaatttccatttttattccatgatcctgcaattaatattattctacctgtgtctgtaacaacagttgttgaatccattacacgagaataagttggatcaacacgatcatttttcattactgttttataatcccatgtttttcccccgtcaatacttctagcagctccaatatctatatatgcatgatcttgagctccattataacgaatatctgaaaatgctagcattgtaccatcgggtaacgtttgtaagctaggtattctaaaatactttgcattccacatgttatcacttttattaaatacagttgttttatagggctcattagttgtgtttaaattacttgcaaaaacaccattgatactacatgctgacaaaacaattgccatacttaatacttttaaatttttaataatttttttcataagtttcccccttagtttaaactttcccttatatatctctttacatattaagtatagcataattttgtttattttttatcataatcgatgtttcatatttatattttttatattttcatttaaaatatcatatgaagattactatgtttataatttgctactttaattttggtcaaccttatattaacttaaaattttaccatctttaatagttataattctatctgccatattagctatctcgtcattatgagttatcataactagagtttgattaaactccttaacacacatttttaaaatatccattacttcacctgtagtctttgaatcaagatttccagtaggttcatctgcaaatattactgatggtttatttgcaagtgcacgagcaattgctaccctttgttgttgtccccctgataattcatttggaaatttcttaatttgtgatttaagacctaatttaattattaaatcttctatgtactttttatctacctttttaccactaagtgaaataggtaatactatattatcataaacatttataacaggtattagattaaagctttgaaatataaatccaaattcatctcttcttatcttagataacttatcatcatttaaagtatataaatctaaatcatctataaacactttgcctaaggtcggtttatcaagtcctgccatacagtgaagtaatgtactttttcccgaaccactttgtccaattatagctgtaaacttatgaggttctatttctaaagttattccatcaatagctttaacttcactatcacctttcccgtatgtttttcttaaatctatagtttttaaagttttcataacttaacctcccaaattaatcattatcttttattccctcaataatactcatattttttaactccctactgcttgtagttattgctataatacacacagtaactgataaagcaaagaatactattgattctttaactggaaatgtaaaatccataaagtgctctattccgaaatttgtataagcgttgttattccaatttacaaatttaattaagtttatcattgatggaattaaagctattatattgcttaaaattgcatatgttaatgcttcataaagaaccattttcttcatatttttaatgctcaatcctattgctctaaatgttgaaatttccttttttctcattaataaatttgttcttattgtgcagaatatattaattcctgctattattaaaactaatgctattgttgatatttgagacttataatactctctactagaatctatccctctttgtctaaaattaaatctactgtcgaatctagataaatgaatatcattagaaattttttctatttttttatttacattctcatcatatgaatcttttaaatttatacctaatttagtatatttatctttacctgtaagagctatagcatgattttgagatgttataatttcaatactattaccaccatctccattagacatccaatttggtgttaaagttgcacacactcttaccttattttctttatatacagtttcaccattctctatagtttgaacttttactgttatgatgtcccctatgtttaaatttttataaatttctttatatgtatgatctgtaactatatcataaaaataattatatactgctacattaatataaccatcggtaacttttccaatgtcttttaaacttccatcttgtatgaaatcttttatatttttatttaaatcattattttcatataattttaaagtaaactcagcttccatattatcttgttcttctactccaaaatattttggaaattctttatttacttcattctttttaaaatcaaacaacccacttactagttgcatagattctatgctttttactccatctatattttttatcttatttatatcactatccatatattctaaattatctacatctgaaattgatggaataaactgcattgttatatcatatttattgtatatatcttcgattttattatttacctcaaactgcatgcttgaaaatgtagttaaatatacatatcctcctagtgcaattgataacatagatataactgctctagttttatttcttccaatatttttaatccccatatacccataaaatccaaatattttatttaaaaccttacttaatttataacttttgccactacttttcatcttgtctgttgtctttgtagattcaataagtgatatatttccaatctttataataggtaaaatacatgaaataagtacagaaattatacctgttattatagacgtcataataatttctttacttacatataactttggtttaattaatgcttcttgatatagtgaaaaattgtatttgctaattcctacatatgaatatataaccccaaatactaatccaagtattatacctaaagctattataaataagccttgatatattataatacctcttacactttttttacttgaacctattaatctaagtaaggcagtttcttttattgtctcatttagagtaatattaaagatattaaatattaaaatagctgatgtaagtacaattaaaatttgagtttgaataacttgaggactatcaagtctttgttctacctccattgtattttgcataagtacaatatttggtgtatagctatttttccctaagtcatttcttttcgtaatagttttaatctgaccattaatatttctccatccactttttaaagttactatacaatcataactaattgtatcttctggtataatattgttattttcgccatttccataagtaaatgcttcaagagttaagttcatatcataaaatttttgtggcttttctataattcctacaagtttaaattttttatcttcagtatatatgttttgatttccttgtgagtctttatatttcttttttatttttaaatctatattagaatttaacttatcagatatacccatctcttttaaagctttcttttcaagtactatctcatcgttatttttaggaagccttccatttattaatttatttaacttaccttttacataattttcatctactgattttaactgaaatgaatttccttttttatctaatacattccctaagttttgtactgtactagtttttaaaacatccttgtcgttttttaattttccaacttcctcgtaatttaaatcattaaattctgcatgatatcctccataaagtttatttacggcatttaaatcatttttagtttgagattctcttactgtacgtgtcccaaatattaaagctactcctaatgctactgctagtattaaaagtcccgttctaagtttattttttcttaaatatgctattgataattttaagtatattcccataaaatccccctcttttttataatttatttaaatatgttggaggatactttaccttttttaaatcctctctttctaatagcttattatcatttaaattataaatttttaatacaactttatttattttatctaaagcataaatttcatcgctataaaaatattgatattcatgctccgaatcatctttataaattaccttataaagaattccattataactttctaattttgctttttcttttgtaatttcacttatatcatcttttgaaactccttgttttaccatatatttattaatattttcctcagcttctttccaaggcttagaataattattatatataaacaatcctgtaagccctataattaatactaataaaatagctcgatattttttcatataaacctcctactttaataaaagttaccatattcaaattcattataatgaaatttaactatggtataaattttttaatacactaagacttcggaatatcgaagtcatagttacagcttagctgtaaagttttaatgtattttccagatttattaacttgaacgacttgaatcggtatatcattcttataaggaagttctacaagaccctcttcttcattaaatgttttttcaactacatcaaagaactctttctctgttaatttagtattagttagtgacttaaatatattgtatatagctttaacatatttatcactttcagataattccatattctcgggatattccttagcgcacagaatatgtagtgtcgccttaccctttttatagtcttcggatatagagtaatttagactttgaatagattgtgtaggagggttttcaaatcctcctatagatactacaaagctaccatcttgagatgaattagcaaccctaagaccactatctgttatagcttttgagaactttttagctgcatcttgtttagtctcatacactccttctagggtgttagttttttttgagtaatcttcaaagagtttaatggatttctcttcttcagttgcttgagcttcagttacaattgagtcttttgatgaatttccaaaaggtatacatactaccgttaaacctccacttatacttgaaactaatatcatagctaatatagatttttttactttcatatactttctccttccattatatttctacttctcacgtatttattaattaaacaccatggcactttcgtatgtataataaatatcctaaaatttataaattcttatactacaaaaataaggatgttacctttttctattaaaagataacatccttattttttagactcaatacatatgccccaactagcaccttaatcgacccaactgtcagtattttgattaagtggtatgcatatatttattataaatttatctttctcatcttcaaataataattctccattatatttttctaaagatgatttaatactttgagttcctattccatgtacaaacttgtccattttatctgttattaatttatttttcttaaacttaatattattaactttactgttttcacatttaattacaaaatatgattttgatatagttcccttaattctaatatacttttcaatattttcatcatgtattttatcacaagcttctattgcattctctaaaatattagcaaatatgcttgatatatctattggttttataaaattaacttttgaaaagtttatatcacaaataaatttaattccttttttactacatatatcacttttttcattaattataatatctaatataatattgcctgtattataaatagatttgaactctttaatttcatcttttaaattacttatatattcattaacttctttactattatttttaagattatctatacaacagatatgattatttatatcatgataaagctttttaactttcatatgagattcttgagtacttaaataatgagtatattgcatatctaatttatttttcataagttcatattgagtttttttcttattttcctttattactcttctaaacaataaaattattattattatacttgctactactagcttgggaattacaaactggtcaaaataactccattcatcttgtaaaataggcactgaatttctccaattacgtaacatctgatttaaaaatatattatttcctatattataaaaccccattacatatctaccaattatattaataacattaaccattaaagccatacttaaatatatgtatactcttttttcactactaaatagctgtaatcgattattaatatatataaataatacataaagaaatattattaatacataactacatatattaactttcatctcagtactataagatactaaaagagattctttagatgattgagaacaacctgctattaaaatatatataattctataagaaatatctttaattaaattataatatacattaaataaataaaataaaattgtgtatttaaaattatgaatcattaaattttttataatttcaaaaaatcctaatagaactaaaaataaaatgattataaatataaatataaattaaaaaaacaatacaaaaataaagaattttgacaaaattttatataaaataaatcatttacttgaaacctgataaaaaagtatatattattataatggacacttttttatcaggggggcaataatgaatcagatatatagagaaattatagaagatagccctatgggttatatgtatataaaagtaataaatgataataaaggtagatatacaggagtagaagttagagattttaataagtcatatgaaaaattttttggaaaccatgatgaaaatacaatcaataaatacatattaaattgcatgccaagacaagagaaactagaatgggaaaaaatatttatagaagcaaatgaaagtgaaaaatatacaaaaaaagtatatgtagaaaagataaatacacattttagcatagatatttatcgtgttgaagattatgaatttcatataatatttaataaaattagaaataagtatcttaaattaccttcattattaaaaaaatcgtcatatatgacttggattaaagatagagatggtgtatatgtagacgtgaatgaaaagtttttggaatttttcagtaaaacttataatgaagtaataggaaaaactgattatgatataatgcctaaaaattttgcaaaggaatttaccattcaagataacgatatcatcaaaaataataaactaaatacatatgaagattttataaactcaaattttaataaaattggatatttccaaactattaaatggccatttactgaatattataatgatacaattttaggtactataggtatatctatagagatgactaataaagttaaattatttaaaaatatagaaaaaaatgagaaaatatttttagagattgctaataacatagaagattctattattataattgataaagaaaagactcaatatataagtccttcttttgaaaaagtatttggaactcaattaggagaaacgtataacgatgtagaaaaatggcgtaaaaatgggcatcaaattgaatttgaaacaatgcctaaaaactatgaatttaaagagagttatagctttacatttaaaataaaaagaaaaggaaaagaagaacaatggatatttgctaaatttgtacctttattagatgaaaatggtaatgtagtgaaaaaaataggcatactaagtgatattactcaaaataagaagctagaattagagttagaaaaattaaggatggatttttttgctaatttatctcatgaacttagaacacctataaatgtaatagcaagctcacttcaagttctttatttaagaatggataagttagatgatggaaattttgaatattttaaaaaatatttaagaatagttgggcaaaatacaaatcgtttgttaaagttagtaaataatttaattgatactacaagattagatgcagggtgctttgcttatgcacctaaaaataaggatattataagttgtattgaaaatatatgtttatctgtttttgaatttgtagagtctaataaattaagtataatatttgatacaaatgtagaagaaaagataattagctttgatcaagataatatggaaagaattatgttaaatttaatatctaatgctataaaatttaacaatccaggtggaaaaatagaagtaactgtaaattgtaatgataatataaaaataagcgttaaagatagtggtataggtatacctaaaggaaagttagaaagcatattcaaaagatttgaacaggtaaaagataaattaaaaagagaaaaagaaggcagtgggataggacttacattagttaaatctttagttgaaatgcatggaggaagtatacatgtaaatagtgtattgggagaaggtagtgaatttataattactttaccagatcatttagtggaagatgaaaatttaaacttatgtgaatcgcctaagtgtttaagtaagataaatatgatgaatgtagaattttcagatatttatacattataattataaagttaaaatataaaaaggacaggttattaataacctgtcctttttgttttaaaatactaaatattcagaactgaaacacattatattaaatattaaattatatgtaaaaaaatgttataatgtatacattgatgcttagatttctaacgaatgtcagagaaatggaggtaattatgaaaaatgcaattaaggttttcaaaagagatataaaaaatctaataaaaaacccaatagctttaataatagtaacgggtttatgctttataccatctctttatgcttggataaatataaaagcttgttggaatccttacgagaatactagcacagtgccaattgccatagtaaataatgataaaggtgcaaaattagatggcaaaaacataaacataggaaatggtgttattaaagaacttaaaaagaacaaatcaattggatggaagtttgtaaactctaaacaaggtaacgcaggagttttagatggaacttattacgctatgattgaaatacctagcaacttttcaaaggatttaactagtgttaaaactggaaaacctataaagccaactatcgtttataaggttgatacaaaatcgaatccagttgctgggaaaataacagaagttgcagaagaaactcttgtaaatcaaatcaactcaaactttatagctactgtcaataaaactatcttctcatcattaaataagtatgggaaagatattgatgatagtaaagataagataatagaacttaaaaaagctataatacaacttgatgagcatatgggtcttataaactttgcacttgatagtgttaataataattctaaaaacttgactgaatttttaaaaagtatacaaagtactcttccacaagtaacaaatggaataagtgcagtatctaatagcaacttaaacactagtgagaatataagcaacataaaaaataatttaaatggatcacttgataatattaaatcaactttaaaccaaattaatagtcaaaatgatcaaataaaagatatagtaaataatttaaataattcagattctatatcaaaagaaacaatagaatcagctatatctcaaattaaaaatcagataaatagtagtaaatctcaaatagattctattattaagtatttaagtgattttaataaagttaagcctaatgaaaatatagataaattaattgagagtttaaacaaaataaaaactggaattagctcagaacaagatagattagattcacttaaagatcaattaaatgattctaaagaatctataaaaagtacaatagactctataaactctactgcgaatgatttatctaacaaagttaataattctataaatttatatgattcaaatgttagacctgaactaaacaaaacagcagatagtttagtaacagcaacatctgatgcatctaaattagtagatagttctaaaggattagtacaagctgttaatgacatgttaggatatgcatcaaaaggaagtaatttaacagcacaaatgtctaaggatttagattctaaattaaatcagtttaaagatacaatacatttattaagtacagagctaaaaaaagttaatgacaatgatttagatgccataataggaatacttcaaagtaaaccacaagttatgggaaattacatatctaatccatttaacataaaatcagaaccaatttatccaatagcaaattacggttctggtatggcacctatatatacaacacttgctttatgggttggaggattagtacttacgtcacttttaacaactgaagcagaaaagtttaatgaattgacaataaaagaaaaatatattggtaaaatgataacatttgtattctttgcaatgatacaaggatttatagtaggcataggtgataagtttgtacttggagttcaaactgaaaacttaatgttatttatatttacaacagtattttcttcagcagtatttactgttatcttatataacttagtatcactatttggaaatataggaaaagctataggtatagttcttatggttattcagatagcaggatctgggggaacttacccaatacaagtagaccctttaatatttagaatacttcaaccatttttcccttttacatatacactaagcaacttaagggaagcaatagcgggaccacttttaagtacagttatgtttaatgttgttgtattaacaggatttgcgattataacaatacttataggctatttcttaaaagaaagacttaatagtgctgttagaaaatttgaaaaagaatttgaagaatctggattgtcagagtaattatagaggtgaggatatgaagaaagtttttaaaatttatttaagagatttaaaacacatagtaactattccagcagcctttataataataggtgggctttgtttaataccttctttatatgcatgggttaatataaaagcctgttggaatccatatgtaaacacaggaaatcttccggtagctgtagttaataaagatgaaggagcttctgttggaggaaaatttgtaaatgtaggaaatgagattgtagatcaacttaagaaaaatcatagtataggatggaagtttgtagatgattggcaaggtaattatcaattaaatgaaggtaaattttatgctttaatagaaataccaagtgatttttcaaaagatttatcaacacttacaacttcagacccacaaaagcccaatataatatataaagctaatgaaaaagtaaatgcaatagctactaaaataacagatgttgcaaaggataaattagtagaagaggtaaaagcaaactttgtagacacagtaaataaagaagcttttgaatttttatcttcactaggcgttaaattagaagataataaaccacaaataatacaattaaaagatgcattagacagtacatataataatttagaaaaaataaatgattatgtaaaacaagcaaacactcatgcagatacacttaaaaagtatttaaatgatagtaaaggaaatcttcctaaaattacgaaagaagtaaaggaccttcaagatgtagtaaataatagtaaaggtttaattacagcttcacaagataatgtaaataatgccacacaaaatttaaatagtagcatggtttctataaatgatataaatagtaaacttcaaaatgaaattaataatttaaaaaatataaacgatagtgtttctaatgaagaaataaataaaactatagattctacgcaaaaattaatttcatcttctaatacatctatagataaacttttaagtggattagaaaaattaaataatatacatcaaagtaataaagtagaaaatataattagctcacttaatgatttaaaaactgtactttcttcagaaagtgataagttagaaaatataaaatcattaatacaaaatggagcaactaaagatcaaataaatgaacaacttaactctttatctgatttatcaagttcatttaataataaattaaatttaataagcagtagcttttcaactgatatatctaatgttttaaatagtgtaggcaatgctatgaattctagttctgataatattaacaatgtattagcaagtataaatgttatagtaccacagttaaatgcactttctaattatggtatatcaagtagtgatgttgctgtaaaacaagcaaatcatatatctaaagaacttgataaatttgaaaaagatttagacaaattaatagaaaaaacaaaagtattaacagataaaaatttagataagataattcaaacgcttaataaaaattcaaaagagatagcgtcatttatatcatcacctgttgaagtaaaaacagtagaactttataaagcaggaatatttggagttgcattaatgccattttactcagtgcttgctatatgggtaggagcgcttttatcaacatctatacttactacagagtgtgaagaattagaaggtgaaagaacaaatttacttcaaaaacactttggaaagatgcttacatttatgacggtatcattgatacaatcattaataattgcaacaggggatatatttatatttcaagctcctgtaagcgtaccacttttatatatatttacaatagtatcttcaatattatttacaacaataatatttacattagtttctttatttggaaatgtgggtaaggctattgcgatagttattatggtatttcaaattgctgggtctggaggaatatatcctatacaaaccaaccctaaaatctttgaagtattacaaccattttggccatttacttatgcgatagatggatttagagaagctatagcaggacctagcatgactgcagttcatcatgatttagttatgttagctatattctttatagtatttttattattagtaatatttaaaagagttttccataatatgactgagtttatgaataataaatttaaagaatctggattataaaaactaaaactgatatggaatatatttatcctatatcagttttttttatttataaaaacaaatttgaaattatttaaatatattagggaataatttatatataatgaaataaaagaggtgtagtatgaaaaaaacaagtatactagttttaatatgtgcatctatgttaagtataggttgtagccagtataaaaataaagacagcagtaaatctaataaagagttagtaaatgctatattaaaagaaacaaaatattatttaatatattaaataatattattgcgtaaattttaaatatactatattatattaaataatattgaaaatgagatacatttagacaagttcttaaaaaaggtaagtaaaaataaaaaaacttatataaaacaaagggataatgcatatatatatttattaagaataataaagtactgaatttacatgaaattctaaaaaaggaaatgcgaattataatttaatcaatggttaaatttataacaaaaacaatatttgaagtttgattaaaatggtgataaaatagagtagttatcatacagtagattataaagttagattgtgggggttaataaaatgcagaagatatatataataacaacatatacgggaactgctctttcttatttaataaaaagaataaccaaaactccttatgcacacgtatcaatagcacttaataaggatttaagacccatgtattcatttggaagattaaatcctaaaactcctttatttgcaggtttcgtagaagaaaatataaatgagggattatatgctataaaaacaaatacaagatgtagagtatactctttatatgtaacaagtgaacaatataataatttatataaaaacatactaaatgtaagtgcaaatagaaacaaatatgattatgatgttttagcacttatatacttatctagaaataaacctagagaagctgaatataagtacgtgtgttctcatttcgtagcagatatgctagagaaaagcaatataagtttatttgataaaccatcatatgcgataagaccaagtgatttttttaatcatagtgatttgactttagaatatgaagggttattaagtgaatataaagcgaaggaaaaaatatttgaatatagtttaagtagtgtataaaatttatttaaaaatactccttataatcgtgaggagtatttatttttttacaaaaaatggatataatgaatattaacaaatattaaaaaaattagaaaaattaggaaggagtaataaatgaaaaggtttttacgaacgtatgggttatctttaataattgtggggatatatgcaataatacaattgcctgtacttagattggatttcacttcattattttcgactttagctatattttttgtattagcaggagtattagacatgatgtttgataagggagaacaaacatctaaattagcaaaaacaaatttttcaatagctatagtattggtaatttatataattgttgttccatttataacatcatcaccgatattacattctaaagcgtatagaaatttattaggagaagttaaagaaagtaattttaataaagatgtaagtcctgtcagtgtaaatgaaattagattagttgatgaagaaatggctatgaaacttggagataagaagttaggagaagttcctgcaatagggagtgtatctaaacttggtaagtttcatatacaaagtatagatggagaattatactgggttgctccattagttcatagagatttgataaaatgggttactaatatgagtggtacaaatggatatgttatggtatcagctactgatcctcaagatataagattagtacaagatgttgatggtaaacctataaaaatagtttatcagccagatgcatatctacatcaggatttaaaacgacatatgtatttaaacggatatgttaatgtaggaatgacagattttactttagaaatagatgataaaggaaagccgtattgggtagttacgctttatgaaaatgctattggatatgaaggtaaaaatgccaaaggtatcgcaacagtagatgctcaaacaggagaagttaaaagttacaatataaacaatgcaccaaaatggatagatagaatacaaccacaagaatttataacagatcaaataaatgattggggaacatatgttaatggctttttaaattctgttatatcagaaaaagatgtattagttgctacagaagggacatctttagtgtatggagatgatggtaaatcttattggtatacaggaataacatcagctggagcagatgattctacaataggatttatgttagttgatacgagaactaaagaggctaagttgtatagacagccaggtgctactgaaactgcggctatggtatctgcaactggtaaagttcaagaaaaaaattatgaagctacatttcctgtaatgtataatatattaggaaaacctacatatgtaatgtctttaaaagataaagctggattagttaaaatggtggcatttgtatcagttgaagactttaatattgttgggataggggacactacagaagaagcgtataaaaattataaagaacagttaaaatcaaaaggaaataacatagaagtagaaaatgaaactaataaggaatcaaaaactggaataattcaaagaataaattcagatgtagtagatggaaatacgtcttattattttactgtggatactttaaaagattctatatttgtagtatcatctaaagtgtcaaatgaagttcctttaactaaggaaggagatagtgtcaagattggatatgaaaaaggacaatcaggttcaatagatgttactgattttgataatcttagcatgaatgataataaaaatgaagctaatatagacaaaaatacgcaagataacactactacccaaaataatgattagaaaaagaagtcgcatatgtatgcgacttcttgtattgttagaaaataaaaacgtatttaaatttataaaaaattttttttaaaaaagtaaaaaatagttgcaataacaactaaattaatgtatactgatttagttgttattgcaactatttggtgttttaattttagggaggctttaatatgaagaaagagtgtgaacatattggaagatatatatcccaaatatatagaaaaggtggatcatttatatctaaagaacttagtgatttaggaataggatcaggtcaagtaatgtttttattagaactttatagaggtgatggtaaaaatcaagaagaaattgcagatgcacttaatatagataaaggaacaactgcaagagctataaaaaaactagaaaaagaaggatttttaataaaagagaaagataaaactgacaaaagagcttataaaatatatttaagtgaaaaaggtaagtctactaaagatactatatatagtattatggataagctagaggaaaaaagaactaccaatttaaatgaagaagaaaaaaatacattaataattcttcttaaaaaaatttgtacaaaaatgtaaaggaggaaatatatgaggaatgaaaacatattagggacagattcaataccaaaacttttattaaaatattctgtacctgcaattataggtatgatggtaaatgcactttataatgtagttgataggatttttattggtaatatacctaatgtaggaccacttgctataacaggtgttggaatttgtttacctataatgactataattttagccttctcaatgcttatagggataggtgctactacaaatatatctataaagttaggtcaaggaaaaatagaagatgctcagaaaattataggaaatggtatatcattatcaataatcataggacttataataagtatattaggtatactatttggagatataatattaaaattatttggagcaagcgaagcaacacttcaatatgccaaagattatatatatataatcttagctggaagtatatttaatatgttagggtatacattaaataacactataagaggtgatggaaatcctaaactagctgctatgataatgattgctggttgtatgacaaatatagttttagatgctttattaatatttgtatttaaattaggtatacaaggagcggcaattgcaacagttatatctcaaatagtaacagctgtatgggggcttacttattacattaaaggtaaatctaatttaaaatttgaaaaagctagtttaaaacttgataagtcattagtaaaaataatttttgctataggatcagcaccatgtgccatgcagttagctacaagtttagttcaagttatatcaaataatgcattaaaaacatatggtggagatttggcaataggtgcaatggctactatatcatctatatctatgatattcttaatgcctatattcgggcttaatcaaggagctcaacctataataggttttaattttggggcaaaacaatatgatagggctaataaaacatttaagttatctgcattagcagcaataattataatgactactggatggttattagttcagactataccagaagttttagtaggattatttaataaagatcctaaacttatgaagatatcaataaatggtgctagaatatacttattaatgctacctataataggtatatcaataactggttcaaactacattcaatcaataggtaaagctaaaattgctatggtacttagcttacttagacaagtaattttattaattcctatgatattaatattgcctagaatttttgggttaaatggagtttggtatgcacaaccagttgcagactttttagcaactgttataacagcaattatactatataaagaattaaaaagttataagatagaaaaagtaaaagaaataattatataaaataaaaaaagtatagacgaaagtctatacttttttttataaagtgtaaattttattttaaagatttaatataatgaaattaagacttgtcataatatacatcaaggagaatatcataatgctagggatggaaaaggagatattagttttaatgagccaagtaaggtgtgcaacagaacaacaatttaataagtttttttctaaaagaagaaaaatagtaaaatctccttacaaaaagacattgaggaagatgtgtagagaatttactttaagaaagtacccatgcaatatagtatatggagagtataaagacagttctggaatatattatttaaatgggggaaaagtttataaagggaaagaacttttaaaagtaataataggctcagaagttgcactaaagatggaagcttcaggatatgaaataaaaaggttttatagaaatataactattgataaagataagtatgatatatatattgaatatttagataaggataaaaaattaagacaaaaattgatagatattaaattaagtgatgtttttaagggaagcaaatataaaaatttgccatataaaatcacaaattcgactatacctttttttgaaatacctgaagtattaataatcacacaagaaagactaatagatgaatatagaataaaacctataaatcaaaatgtaaaaataatagacctgagtttgaataatttaacatattatttataaatataagaccatttggtcttatatttataaatacataaattaaatataattttaaagattattaaataaaaataaatacgaaaacatacaaaaaaatatatttttccctaaaatgatatatttatgataatatatatatctataaggagggatttaatgaagaaaattatattattaatagctgtaatttccattatgactgttggatgttctaaaaaatctaaagatgataatgagtttagtttaggtcaagctgcattagaaaaaggaaactataaagaagctattgaatacttacaaaaagcagtgaataaaaatagtgaaaatgatgatgctagaactatgtacatacaagctatgaacataagtaaagctataaaatataaagaagaaggaaattatcataaggcaataaaactactagatgaaacagtaaaattaagtggtggtagtttagaatctagagaaaaagcaatggagatgaaagaagaatatcaaaatttattagagcaaaaactatctcaagcaaaaaaaagaaaagaaagtgcaaaagaatctattaaaaaagacacagaacgagttaataatgaggcattaaaagctcaaagacaagctttagaagagcaagctaaaaaacaagaagaaatacaaaaaaaagaaaatcaacaaaatggtatttttgatacaaataatcaaaatataactgataatatagtaaatccaggagatttacaaaataatactataataaatcaagatcaagttattcaacaagataataatcaaaattttgaaaataaccaaatgtcacaaagtaatataggattgggtaatcaataaaattatagattcaaaataaaaaagaggtattacctcttttttattttgaactttttatatttaaatttttatctatatacttgcataaatacactttaataatagcagctataggaactgataaaaatacgccaactaatccaaataaagatcctcctattaatactgcacaaattatccaaagtggactaagtcctacataatctcccataactttaggtcctattatattgccatcaatttgttgtagtacaaataaaaacaatgctacccaaagagcctttataggactataaattaaagtcataaaaattgggaaaatagcacctataaaagggccaaagtaaggtatcatattagttataaatataataaatgataaaaatagactactttttatatttataaaaaatttaaatcctataaaagcaataaataaacattgtggagaaaatataattgatatagttatagctaattatatagttaattttaacttttttaacttttattattctaatatattacttgtatattaaatttttatagattataattttaatttttgggtatatactaaaagacttaaaatttggaggtttctgaatatgaaatacaattataatttagaattaaataatatagtagaaaaaatatataaagaactgatatataaaatagctataaatgattcaaaaatagatttttcaaaggataaaatagataatactaagaaattactttctagtgaaaaagtttatataggaagcgatatggatgaatttataataaattatatacctaaaggtcatgaaggaaatttatttagagtttgcatcgcaaagtatcataatagacttcatcctagatttgaaaactacaaaggtgaacctatagttgattctagctataataaatttgcattacttctttgggaagaacatatgaataatttactaatttcagatgttcaaaaattatttactcaaaaaaatttcataaactttgtaaataataaattagataattatatagatgagttatcatctcgtattactgaatataaaaataaattagtaactatagattttaaaaataaagaaaatctattagagactatagcgaatatgatattaaatgaagaacttccttttgagctttctcactcaatagttgatatggacaagcttagagatgatatgactaaaatggctacatcatttgatatgtataatgaatttgataaactagaagacgatacaaaatactgtttaataaattactgtaaatataatccagatgatttacttaatgaattgacaagtaatcatggatttaaattagtaagtaatggctgtttaattaaaaataaataatataaacaaaggtagtataactattttttcttaatttagttacactaccttttaattatctttttataatatgtccaaagaagtttgtatctaaatggtcaaactctacatgtttttctcctccataagtaaagtatatcccatctacccattcacctttatactctctttgaagtaaactttcaactaaagtatagcaagttatatttgcaccagtgcttccttggaaaaatctattactccaaaatttttcattttgatcttcactaatatctatatatgctatattatcttttatttttaagcattttataggagcattttcaaattgtacttttgaaacttcacttataactaaatttaatttatcttctatagataacttttcatctattgatacacttcctgtaactatagtttcatttgtattagcatccttacttaaaattttaagttttgattgatttgtatttgaaacctcatttcctttattatcagtatcagatttgttttcaccttgagtcttatttacactcggtaccttattttctatatttttttctattctactacatcctgttaataaaaaaatacttataaataccaaactaaaaatttgtttaaactttttcatatgtatacctccatattttttatataatatgtatttaataaattgtatgaatttacatatgaaaatattttaaatatttttagtttatgctatttaactcagatactaattcttcatcttccttcgcccataaaagtgatctttcaactgctcttttccatcccttatataatattattctctttctttcatccatattaggtatgaattctttttctatttcccatttttctttaatttcatctacacttttataaaatcctactgatagtccagcaagatatgctgcccctaaagctgtggtttctataaccttaggtctatctatattaacatttaatatatctgattggaattgcattaaaaagttgttagcactagctccaccatctactctaagacattttaaatctatatcagaatcctcttgcatagcatttaaaacatccttagtttgatatgcaatagattctaatgttgctctaactatatgacctctttttgctcctctagttaacccaaatatagctcctcttgcgtacatatcccaataaggtgctccaagtcctgtaaatgctggaactacataaactccattagtgtcttttacttgatttgcataatattctgattgtcctgagtcatatattaatctaagttcatcccttaaccattgaatggatgctccaccaacaaatatacttccttctaatgcataattaacctttccatccactccccaggctatagtcgttagtaatccattcttagattcaactattttatctcctgtgttcattaataaaaaacaacctgttccatatgtatttttaacactacctttttcaaagcaagtttgcccaaatagtgcagcttgttgatctcctgcacatcctgatataggtatctttgcccctgctaacatttctccatctgtatatccatatatttcacttgatggcctaacttgtggtagcatactttttggtatatttagctcatttaatatatcttcatcccactttaattcttttatattgtataacatagttctagatgcatttgaataatctgtaatgtgaactttccctctagttaaattccatatcaaccaagtgtctactgtcccaaataaaagttctccattttcagccttttctcttgcaccttccacattttctaatatccagtttatcttcgtcgctgaaaagtaagcatctactattaatcctgttttttcttttatgataggttctaatcctttttcttttaatctatcacatatatctgcggttcttctacactgccaaacaatagcattatatataggctttcctgtgtttttatcccaaactatagtagtttctctttggtttgttatacctattgctgctatttcatctggccttacagatgaagtttccaaaacttctcttaaaaccccgctttgacttccccaaatttccatagggttatgttctacccaagaaggctttggataaaactgagtaaattctttttgtgcagatgaaactacattaccatatttatcaaataaaatcgctctggaactagtcgttccttgatctagtgctattatatattttttttccatatctatctccttaaagtcatcttattaacatactatgctttaagtaaatattaacaataaaatacatctactacaatgactttaaataaagttattttttaaacaagttatcttttttctattttataattgcaatttttataagttataggtgttccacttgttttattgttatgatattgtactacttcaattttgtgtataccttcatttaaatcttcctcatatatagttaaatttatagaattagatttacctagttcttctatcgtatttaatttttcatctatgtatatatagctagacttagaactatcaaaatcttttgattcaagacctaattgaactaatcctttataatcatctatgtatataactggtgtttctccatcttctgaattatcagtaggcgtagttattataattttacccttacccatttcacttgttaatttatttggaattaccttatcttcctttaacttttgatctacaactttttcagaacacccaactattaatataattactaaaaaaatcattggaaataaatatagtaatcttttcatataaacctccataaaatctatattaaagattattattcccaatataataaaaaaaaagcatgaattatataattcacacttctttttctaaatttaattatatagaaatttaaataatatacattaagcagcttctaattcatcttctgctttttcatttctatcttttacaaatttaagtatataatgaacaaccatacctacacctattgcaaatactaaatcaaatactaccgtaagtgtaaaagttataattaatactaaaacatcagatttgcttgaagataacaattctttaaaatgtgaccattctcccatattgtaagaaactactataagtattgctgctaacgtagtcataggtataagcttagcaagaggcattagtataaccattataagtaataatgttatagcatgtaccattcctgatatagggcttcttcctccatttttaacattagctgctgttctagctatagctccagttgctggaattcctccaaatattgaagaagctatattcccaagtccttgtgctactaattccatatttgaatcatgcttgtcatctatcatattatcagaaactacacatgaaagtagtgactctattgcacctaataaagcaatagtcatagccggctttattaattttgtaattgtttgtaagtctatatgtggtatttgtggttttggtatagatgatgatatttcattgaatctagtccctattgtatctgttggtaagttaaataaatttactactaaagtagatagtattaatactattattgatgctggtattttcttgtttaccttaggccagtaaactaatataaaaatacaagctattcctattagaaatgatgctatatcgaaagtggatatatgttgtatatagcttcctattttacctataaactcagctggtacattttttatcttaaatccaaaaaaatcctttaactgagttgtaagtaatgttactgctataccactagtaaatcctactgttatagtttgtggaacatattttattaaagatccaaatttaagtaatcccataactactaatataactcctgccatcattgtagcagttataagtcctgttattccataagttttaattacaccataaactattacaacgaatgctcctgttggcccaccaatttgaaccttgctcccacctaaaaaagatattataaatcctgcaaatatagcagttataagtcctttttctggagatactccagatgatattgctaaggctatagataaaggaagagctattatagcaactataattccagctattacatctttacctacttgctcttttgttaattcattttcttttatcattttaaataactttggtaacacttaaacacttccctccaaaactaattgttgcaacatttaatatattaatcctatttttaaataaagtctatacaataatcataaaatttatataaaaataaaaaaagatactccgcatccgaagtatctttttttatttttatatttcattcagtttttgtaataattcttctaaatctattccatgtatatatgctgcttgttctaaagtttccatttgagctgatggacatcctaaacatcccatttcatacttcataagtacatctacagattctggttttttgcttattaattcccctattaatatgtttttatctattttcattttaaattctccttttgatatatcgttcgtattttgttttaattatctgtgttttaatattataataatttcagattattttctgtaacataagttacatttttataatttaatataaaataataaaaattataaacttttattaagataaaattttattttacgttaaaattttacattctcctttattttctttttaatatttttatgataaaatatgttatatatttatacttgcttgaatataaatttaaatatgaaacttgtacataatataaatatattttaaatttcaagcatgacttgttatcataatttaaatttgaaacaatctaggaggattaatatgagcttaaaggacaaatttgcacaatcatatgctagatcaaaaacaatgactggtccagaaaaaaaggctaatgaaataatgggaaaactattacttagaaaaagtattatacctatgattataatgttagttatttggattggtggtatagctttaaaagttaatggctgggttttatttggtgttgaaatagctttagctgtgggagcttacttctatattaaaaaacaaggtgataagtatcaaaactttaaaccttttgtaggtaacttaataagtcttgagaaaaaaggtaaaaaagaatatgttgctataataaaacaaggtaaaaaagttgataaactacaaataaaatatggtggagaagacttagagaaagttaagaaaaatcaattagtacaaataagttataataaagatgaaaaaatagctatagttgtaactagataaataatttaaaggaaaagcttctacttatgcaaaagtagaagcttttttttactcatttagtacgtattttttatatatttttagtgcattagctaactgatccggacatgatgtttctctgtttttacacggtattctttcaaatgtttctattatttcatctattgttttaccttctattaaatttttaattcctaataaatttcctgcacaccctccttcaaatataacatcaactaacatgtctccatctaaatctaataaaattgattttgaacaaactccattagtataatatctatacatatacatcaccctattatatattttattaatatattatttataaagcataaggtttatgtgaatattttatgaaattttattaatatatatttttaataaataaattaatagttataattatatatacatattaaatttgtattgaatatctttaaaatttttgtatataatcttatagatttaaaaagagaagtattaatcctttctttttaattataaagtgaaaattatttttactatattaataaataatttaaggagtaagactatgaattttaataataaatttgcaaaaataataggtgtaagtgaagatggtataaaaaacttagaatacataacaaattataaaaataataatgaaatattatctacagaaaaaatatctataaaccaagatatagataaagattatgcagctaaaattttagatgaagtagaaattttatttataacatataattcaaaagaacaaagaacttgtgatatagtaaaagctgtaaactacatggcaaaggaaagaagaatagtatctataggtattgatgttaatcaagacaagaaaaaagttgagtttgattttaatgctgaatttataatgactgatgaaaatagaaacttaatatgtgaactaatagatatgatggttgaatctgtttcagaagagtgtactataaatatagacttaacagatttaaaagaaatattatctaaagaaaaaggattagctcatggatttattgaaagtgataaatcagtaaataaagaagaattagttgaaatgttatttgatagtatattaaaaacagatgaagatttaactaagaaaaaaggtatagtgtttataagccttggaaatgaatactgtgagatagaagaagtattacacatgttaaatgaaatgttagaaaatatacaaggtaagatagataataaatgtgatttaatatttacactagctttaaacgaaaacttaaaagataaaataagaatgggtatcttatataactaatattaaataaaaaagctgtctaaatttagacagcctttttttaattttaatttatatattatctaaagtcagctatattattttctatactcataaattgaagtatgctatgtaaaggaagttttttactttctatccccataccaaattgttcaaaagcatatttagcattttcaccgtaagtttttaatataccatcttctaactcttctaaatgtttatgtatgtaagattttatatcgtctatagtttttaaagcttctatttcttctccacgtaaaacatgtttaaatatttcaaatccttcacccttagatccccagataaatattctaaaagtaactaaagaactttctatatatattccacagcttatagagttcatatgatttatatcactatataaatgttggttaaaatcaacaaacccactaggtgcaacttcgtgaactttagcatcactatattctaaatcacttttagttaaattatcgtgtaaatctgaataccctaagctatttaacaatacatcagcaaatttagtagggtgtataaatactttatcactagttaaaaattctcttttcatgacttgctcctttattgttgtaaatttactatgttattttaacatattaatataatatttcaaaattaaaattattaactttgaactatattattatcataactaatccaatcgcttatgctaccaacataagttttaacattatatgaaagttcatcaagtaaagcatagtttatacaagcttcaatacaagaaccacagtaagttattatttctttgtttcttaagttattaaaattagcatcaacttcacttaaatcttttacgtatccaaaattatctatatttttatgccaaggtatattaatggctccaggtatatgtccaggttttgaataaagaggttcaactttacctgtatatctatcgttatctctagagtctattaatactacattgttattttcaatagaattttttatataattcatatcacaaaccatagtagtatttaaattttctttaaatgtagaattaccacgaggtagtggaattttgctagtggtaggaagtttattagatttccaagcattaaaacctccatttaatatatatacatttttataacccatatactttaactgaagaaatgtacgaggagagctatatatcattgtgtcataaataactatagtagaattcatttctataccaatgctagttaattttttagataaatcatatatattagctaaaggtctagcacctccatgaacactttgttttccacaaatatctttattgatatctaagtaaaaagcattaggtatatgttcctttttatagtactcatatccagcatttttattaaataaatcaaatctacaatctaatataaataagttagtagtatcactaaaatttgttataaaagaacagtctacaaagtttttcatatgcacacctccaaaaaattatatatatttataataccacgtatttaagaaattttaattattaagtttaaataaagatatagtttaaaatatcacctagtagagataaagtgttgtgtaaattaattaaaataatatggtattataaataatatacactcaaaaagtaggtgacaaagtgaaactaaatgaaaaagtaaaaaaattaccagagacatctggtgtataccttatgaaggataaagatgaaaatgttatatatataggtaaatcaaaatgtttaaaaaatagagtatcacaatattttacaccatcttatgcaccatctaaaaaaataactaagatgattagttttataaatgatatagaaataattacaacagatacagagttagatgcattaattttagaatgtagattaataaaaatgattaaacccatgtataatactcttatgaataatgataaaagatatgcatatataaaagttaatatagataaagaatatccagatatagaatgtacattacaaaaaactgatgataatttatattttggaccatatacatcagtatctaaattagaagagatagtaaatattcttagaaagtattttaaaatcagaagctgtaacagatatatgaaacaaaaagggtgtataaattatgacttaggattttgtatagcgccctgtaaatttaacgataagaaaagctataatttttttattgaaaaacttataaatacattaaatgggaaagattatagtataatcaatgatttaaacaaagaaatgcaagaagcaactaaagctttaaattttgaaaaagcaattaaatatagaaatgatatagaatctattaaaacaataatttacaaaagtgaagcaataaattatataaaagaaaataaaaccatattagccaaagttaatatagatagttttaaaagtaaactttatatattaaatgggatagaagtattttattcaaagttagtaaaaaatgaaaaattaaaagataataatttaaaaaatgagctttcaaagcatataaataaaagtttaaataataataaaaaaatatataaaaactatataaaaaaagaaaaattagatatgtctaatataatatactcttatttgaattacagtaaagattgtaattacataaaaatagataaattaaatgtagattattgtatcaaagttatttgtagataaatatatagatgtaaaaaaataaatctaaactagattttatttatacactttgatataataaaatagttttagtatataatataaattattaataaacagacgacagccctcttttaaataattaaaaatttttaaggagggtattttagataaaaatatcttaataaaggagacgctatgcaaaatatagaattattagcaccagcaggtgatttagaaagattaaaaacagcttttgtatatggagcggatgcagtatatataggtggagaaatatttggtatgagatctgctgctaaaaacttcaataaagaagatatggcagaaggtgtaagatttgcacatgaaagaggaaaaagggtgtttgttactgtaaatataatacctagaaatgaagaatttgaacaattagaagcttacttaaaagaattagatgaaataggcgtagatgcagttatagtaagtgatccaggtgtatttagtgtagtaaaaagagttataccaaatatggaaatacatataagtacgcaagctagtacaagtaactcaatagcttcaggattttggtataatcaaggagctaaaagagttgttatggcaagagagctttcatttaaagaaattaaagagataagagataataatccagcagatatggatatagaagctttcatacatggagctatgtgtatgtcgtactcaggaaagtgtgtaataagtaattacactacaggtagagatgcaaatagaggagcatgtgcacaatcttgcagatggaaatatactttagttgaagaacaagataacggagaatataaaaaagtattagatgatgtagatgcagaatttttctttaacactaaagacatgtgtatgatagaatatataccagaaattatagaaagtggtataaatagttttaagatagaaggaagaatgaaaactgcatactatgtagcaactacagttagagcttatagaatggcaatagatgaatatttaaaagaccctgaaaactggaagtttaatcctatgtggctagaagaacttaaaaaaggaagtcacagacactttagtacaggattcttcttagacaaaacaagtacaaaggatcaaaactacgaatcagcatcatatgttagaaattatgattttatcggagtagttagagggcatgatgaaaaaactggattaccaatagtggaacaaagaaatagaatgtttgtaggagataagatagaaataataggaccaggaaaagaaacagtacatgctactatattagaaatgtacaatgaagaaggagaaagtatcgaatcagctcctcatgctaagcaaatagttaaaatgaagttagatgtagaagtagaagaatattatatgttaagaaaaccaataacttctataaataccttataataaaaacaaaaccagaagctatataatagcttctggttttgtttttatatatttaaataataagtaatataagtcttaatccgtttatatattaataatgaaacattatatatttagtattagtatataggaggggattaatatagttaaaaatatgaaagaaattgttatgttggcaggagcatatatatcagtttgtataggctcagggtttgcaacaggacaagaaatattacaatttttctcagcacaaggtagtaaaagtatattagctggaattatatgtatggttcttatgatgtattgtggtgctagattatttgaaataggaaaaaacattcaattaaagtatagtaatgacatctttacatatttatttggagattttatgggaagtatatttaaaataattatacctgtattttctttatgtagttttattgttatgatatcaggagcaggagcaactattaatcaatattatggaataaataaaactataggtggaatcatattagcaataataacaatgatatcggttattatgggaatgaataaggttctagatatattaggaaatttagggcctataatatctattattgctataggggtaagtatagtttatattactaaaaattatcaaaatttaagtaatatagattatacaataaataatctaggtattgtaaaagcaattgacaattggcctatatctgcaatagtatatagtggacttaatataatatttgcaacaccttttttagttggagcaggtaaaactgcaaaaaatataaaaaattgcaaaagtgcaggtataataggaggatttatacttatattatctgcaatgtttataaatatagctattttagctgatatacaaaatgtacatatgcaagaaataccaactttatatatgtcaaaacaaatatcaccattaataggtaatatattttcattaatactcataggtggaatatatacaacagcagcacctttactgtggagtgtatgtaatagctgttatgaagaaaagtccaaaaaattcaatataatggctataatatgtactatattaggcatatttggagggatgcttccattttcttacttagttaagtttatgtatcctatatcaggatctgtaggagttttaattatattagctttaataaaaaaaagaagataataaatcttctttttttattaaaagatatatatacactaatacacaaacacaggttaaatctaataaaatcaaaatatataatattttgttataatatagaagtattaattaaaatatgctaatattaaaattggggaaggggtgaaggcgataaatatagcagatttttttttaataaacatacctgaagctttagtaatattttcatctcttagcgtaactgttgaaaaagagataagaaaaaaagatataatttatatggctttaatatactcagtaatatgttttatattaaaaaataattttccagtggggttaaataatatttttatgagtatttcaatagctatcataatatatttatattctaaggtaaaccttgcaagatgttgtattgcaacaattataactttatctacaatacttttttttgaaatgttatcaatcgttttcataagttttataggaattaatttagagagtgtattagaaaatcaaatattaaaaatattggtttattatatacctatatcagtaatgtttatagtaactataaaaaacaatataactataactgttttttcgatagaacaagctataataattgataatatttgtaagagtttaaatataattggtaaaattcatataaagatagatacaggttttaacaggttaggatttaaaatagaaaatgatgatattagtaatttaaagtatatattaaatttaaaaaatatatatgtagaaggaatttttacacacttagctctcaaagatgaaaagtcagattatgaacagtttaataaatttaaattattgacacaagaacttttaaaatacaaagatatacctataaaacatatttgcgacagtataggtatggtagcttataaagaatttcatttagatatggtaagagtaggagctagtatatatggatacaacagcagagaatctaatttaaatttaaaagaagctataagttttaaatctaaaattattcaaataaaaaaggtactcaaaggagaaggtataagctatgattactcttatatagcgcctaaagatatgtatataggagttataccttgtggatattatgatggaataccaagaaagttatcaaataaaggatatgtaacagttaataataaaacgtgcaaaataatcggtaaaatatgtatggatcagatgattatagatgtaacaaatttaaaaaaagaagattatgataaagatgttatattgtatggggataatggaccaaatgttttagaaattgccaatatgtgtgatacgaatagaaatgagatacttagtttattgtcaagaagagtagatagattatatatcaaagataataagattataaaaaaattaaattatatattgggagatgattaatttgatatatccaagaaagttaaataaaggagacactataggtataatagcaccatcaagcccatatagagctttgtgtaaagaatcattaaattatgaattatataatataaaaaaaactatagagaattttggatataaagttaaaatgggaagcacttgttatttaagttataaaggatatttagcaggtacagatgaagatagagtaaaagatatagaaattatgtttgaagacaaatctatagatgcaatattatgtcttaaaggaggatatggaactcctagaatacttgataaaattaattatgatattataaaaaacaatccgaaaatatttataggatactcagatataacagcactgcatatagcatttaatcaaatttgtaatttagtaacttttcatggaataatggcagcaacagtttctaattgggacgaatttacatataattcttttatggatattttagatatgaaagaaaacttagaacttaaaaatccagaagatgaagagttatacactttggtaaaaggtagcgcaaatggtattataataggtggaaatctatctttaatagcaagcactataggtactagttatgaaatagatgtaaaagataaaattttattcatagaagaaataggggaaagtatatataagatagatagaatgttaactcaattagagttatctggtaaatttaatgattgcaaaggtattatatttggagattttgaagattgcaataaagaaagggaagaagattatgacttatatgatttgttgttaaataaaattaaaaagtataataagccatgtatatataatttacaatcaggtcactgcaaacctatgataagtatgcctttgggtgtaaattgtgagttagatgctacaaataagaagataatactaacaaaataaatattaaaaataaaaaacattcgtatatatactgtttttagtatatatacgaatgttttttattataataatcgtgatcattgctatctaatattagcaaaatatgataaaattagacatgaatataaatgtaatttaaggggtgaatatatgttcaatgttgcaataataactttaagtgacaaaggctctaaaggagaaagaaaagatataactggagaaaatcttgtttattttataaataatgaaaataattatgaagttaaatattataatatgattcccgatgataaagttatgttgaaaaatgaaattataaaactttgtgatagagatatagatttaatattaactaatggaggaactggtttttcaaaaagggatataacaccagaagctacaaaagaggttatagaaagggaaataccaggtattagtgaatatataagaatgaagtcttctgaaaaaattaaaagagctatactaagtagaggaattagtggtataagaaaaaatacagttataataaacttaccaggaagccctaaaggtgctatagaaagtatagagtttgtaatagatgtaataggacatggaatagatatattaaaaggtgaagctacggagtgtgcaaatgatagacaagtataatagagagattgattatttaagaatttctttaactgataattgtaatttaaggtgtatatattgtatgccaaatgatgagaattttaatggtataaataaaatattaagttttgatgattataaatttataataaaatgtttttcaaaagttggtataaaaaagataagatttactggaggagaaccacttctttatgaaaacttagacaagcttataaaatatacaaaagatgaatgtggtatagaagatatttgtatgacaacaaatgctataggattatatgataaagtagaaaatttaaaaagcaatggtcttaaaaaaataaatataagtatagattctttaaatgagaataaatataagaagataactagaggtggagatttaaaagaagtattaaaagcacttaataagtgtattgatttaaatttaaaagtaaaggtaaactgtgttttaataaagggattaaatgatgatgaactttatgattttataaatatagctaaatacaaaaatatagatgttagatttatagaattaatgcctttaggtgaaggaattaaaatgtttgataaaggatatataaatttaaaagaaactctagataagatagatattttaaaaactacaaagtacaaagaaaaaagtgtagcatcatattataaaatagataattcaaatggtaggataggtataattactccaatgagttgctcattttgcagtaactgcaatagagtaagagtaacatcaaatggtagtattaagttatgcttgcattctagcgaagaaatagatataaagccttatttaagagatggaaataaattattaaatgttttaaaagaagttatatatataaaaccagaaaaacataatttagtggaaaataaaaagagtgatactaagagaaatatgtatcaagtcggaggttaatatgcttacacatataaatgataaaggatatgctaagatggtagatataagtggtaaagatgatactacaagaaaagctatagcaacatgtaaaatatatatgaataaagaaactatacaaagaattaaatttggtggaataaaaaagggagatgtattatctgtagctcaagttgcaggtattatgggggctaaaaatactccaataaatatacctatgtgtcatcagataaatttagttggatgtgatttagaatttaatatagatgaagagaaaaattatatacaagtgtttgcaactactaaatcagttggtaaaactggagtagaaatggaagctttaagtagtgtgtcaatagcagctcttacaatatatgatatgtgtaaagctattgataaatctatggttataagtgaaataaaattaatagaaaaaactgggggaaaatctggggattatagaattgatgaatagaatttaattgtggtatgtattttttaatatataccatttatttttatataaaaataaaaattataaaagagtaaactactatacaaatggaatttaatggtatataattaaattgtgttaaataaaaaacaaactaggatttgtttgaatacatattatcaagggggaatacaatatgagttatacattttttatgccaaatgtaagtttaatgggaccaggatgtgttaaaaaaatagcagaggagataacttctagaggacttaaaaaagccttaatagtatgtggaaaaagatcttctaagagtgaagaattcaaaggggtaactgatcttttaaaagaacataatatagaatatgtagtttatgcaggctctcaacctaatccaacagttactaatgttatggatggtgttgatatattaaaagaaaacgattgtgattttgtcatatcttatggaggaggatctccacatgattgcgctaaaggtatagctttagttgcaacaaatggtggaaatataaaagattatgaaggaataaataaatcttcaaaacctcaacttccacttatatcaataaatacaacagcaggaacagcctcagaaatgactgtattttctataataacagatgaagaaagacatgttaaaatggctatagttgataaaaatgtaacaccaatacttgcagtaaatgatcctgaattaatggtaagtatgccaaaatctttaactgcagcaacaggtatggatgcgttaactcatgcagtagaagcatatgtatcaaaagcagcaacaccaattacagatgcatgtgctcaaaaggctatagaattaataagtaataatttaagagatgctgtaaaagatggtaataatatagaagctagggatatgatggcttatgctgaatatttagcaggtatggcatttaattcagcttcacttggatatgtacacgctatagctcatcaacttggaggattttataacttaccacatggagtttgtaatgcaatattacttccagaagtgcaagtatttaactcaaaagtaagtaaaaataaattaagagatattgctaagtttatgggagtagacactagcaatatgaatgaagaagaaggagcgaacgcttgtataaaagctataagaaaattatcaaaagacatagatattcctttaggacttagagaattaggtgttaaggaggaagattttgatacattagctgataatgcacttaaagatgcttgtggattaactaatcctatacaagcaactcatcaagatataaaagatatattgactaaatcaatggatactgaagttgaatttgcttagtatataatagattttaaataaaaaagactaggataatatcctagtcttttttatttaaaattatccaactatacaaatttctttatcatggtgatttaaaatttcatgaccgtctttagttactaaaactaaatcttcaattctaactccaaattcacctggtaagtatatacctggttcaacagagaatatcattccttcttcaacacaatcagtattaacagaagatacatctcccatatcatgacattcaagacctatagaatgacctgttctatgagtaaagtatttaccgtatcctttttcagttatatagtctctagcagcagcatctatatcacagaatctaactcctggtttaactaaagctatagctcttttattagcttcaagaactatttcaaatacctctttagctttttgaggaacttctttataaaatactgttctagtcatatcagagcagtaatgatctttgatgcaacctatatcaagtattatagcatctccaacattaacttttctatctccaggtgtaccatgtggatcagcaccagtaggaccaaaacctataataggagagaaagagaatccatcagctcctaaatcttcatatatacctgataacttattagcaagctgcttttcagttaattcatcagatattaaagctttaagtttacccattgcttcatcatttaaaagagaagcttttctcattaaatccttttcctcttcatctttagaagatcttaatgtatctattatgtaagatgaattaacaaacttattttccttacataaatccattaaagctaataaaaatcttgatggccagtttttatcaacacctatagtaccagttttatctatgtatttagaaatgatttcaataggattttgagtatcattaaaccaaatcatttcaacccctaaatcttcactaacagggaataattcatttatgaacattttgtgatttccattaacatttaaatataatgctaatagtctttctcctgggtgtatcattttacctgttaaataaaatattgcatatggatcactaactaacatttgatctatgctatcagctttcattttatcaaggacagaatctagtctttgagttttcatatatccatctccctcttaaattattaatttttactacaactaaattttaccataaattagtattaaatgggaaaaaattataggtatttacatgttaagtatataaaatgtattttattaattctaaattaaaaaaagaaaggtatctgctttatatagtataagatagaggttaattataatataagagatataaaatgtagatgataaagaaattaacattaaatagattagagataggataaatctttttttattatatttgattaagtataaattatactcatcgatacgtattaaatactattatcgatagtttagccatttcatcccctccatttaattttgaaatatgatttttaacattatcacaaatccattatttattaataaatttggattaatatatggatattttggagtgaaataattatttaaacatccaacctaagtcatttcttaatttataaaaaattaattagtatttaaaaataaaaacatccaacttaatggatgctttttatttatataaatttaattattgttcatttccaagttttaattcatcatttattaaaggtagtttaacttcaaataccgtttcattactatcgctagtaactgaaatttctccaccatgtatttctataatatttttagtaatagctagtcctaaccctgaacccccatcatttctatttctagatttttctactctataaaatctatcaaatatatgaggtaagtccaggataggtattgtctctccataatttataactttaactattgccatttcaccttttttctcagttacaatatcaatatagtagccatcttttccatacttcattgcattagtaattaaattttcaaaagctcttactaatttaataggatcagcttctattatacatctatcttcggaaaaatttaatctgccttccatatgtgcttctttaaattgatactcaaaatgagatactatttgacctattaactcaaccaaatttattttaactttattaagtttcattgtattattttgcatttttgtaagatcaaataaatcgtctataagtatctttaaagtatttgacttttcataagctatacttgtataatatctaagctgaacttcatccttatacttatcatcttctataagacttaaatatcctattattgatgttaaaggagttctcaggtcatgagatacattagtaattaaatctgtttttgtttgttgagccattctttcttctattgttatatttcttaattgtgaaactatattatttatattatctgctagactttttatatttcctgaatcatttacatctattacatgttctaaattaccatttgccattatctctacactttctataagtgatactatatttttacttttcttatatgtgataagtatgtatattgatgtagtaacaactataaatagcactgtataaactaactctcctggtgaattatgctttaaatacataaaataatcaacaatatagtttattaaatcatatctggatgttctatataatttatctataattgcacgtaatgtataaagcaatactcctgataaaatacaacttattaaaagatcaaaaataggttgaaacatatacttatatattcgtgagttatatgatagtttatttttcaattttataaccaactccccatacagtatgtattattttagtgccattcatatatttttctattttttctcttattctactcatatgaaccataactgtattattagattgataatatttttctttccatacttttttaaatatatcttctgtactaaatactactcctctattagttgctaataagtataaaatatcaaactctctagatgttaaagttatttctttgtcatctacagttactctatgcttatttttatctatagttaaagattcaatatttataacattttctgtatcaacagtattattaaagtagtaagctcttcttaaaagagccttcaccctaactgttagttctaatggattgaatggtttagtcatataatcatctgctccagtcattataccttgaatcttatccatatcttcagatttagcactaagcataagtattggtatacttagtttctccctaacttttctacaaacttctatcccatccatttttggcatcattatatctaatacaattaattgtatattatctgattctaatatattaagggcttcttcaccatcactagcttttactaccttatatccttcattagaaagatatatatctaaaagatttcttatttctttttcatcatctacaacaagaattttcttttccaactttaactttcccttcatttttataatatttatatagctttattttcaacatattcttctaaagttactcctttttcaaaaatgtcctttgctatatctttgcctacatatcttatatgccatggttcatatttcttacctgttatagtttcttttccttttggatatcttattataaatccaaatctatgtgcattttctgctaaccattgagcttcttttgtgctttctacaaaccatctatcttcatttgtaacatctatagcaagtcctgtttgatgctcgcttgtcccaggtattgcaacatattcttccgctttctttttaccttgagctattactctttttatatatgtttccttttgagttttataagatctataacctgatgttgctaaaaagtttatactttcttcttcttttgctgttttaaataatttctctaaagcatcagcagctactttttctagttgcttttcttcttttatagtatcgtcaataaattttacatctaaagtcctaagttctttgggtttatatgatccgattttattatcattattaactaatagtatatcaggtttcttttctttaaaagtttttgtacttgtttcactactcatactcaagtttattgcatctccctttattataaacatactaaaagctaaaattgccgaagttattaatattaatttgttaaatttcatagtctattatctccttttgatttgatatatttattctaagatatagactttaagtaatttataaataattcttaagctttcttaagtttttattgtttaatcttaagtagggagaatttatttattgttatattatacttataccttaaatttcctaaattagtcaataaagcactttataagacttattaatcaaatctatattaaattaattaaagctataatcaattgattatagccttaattttaaatttatttaaagtacttaccatatggtctaaactgatttaatttatatatagtttcatctaatgaatttaaaattttttctaatttttctccaataatacttaaaagataattatataacctttcaccactttcttgaatagtaaatcctgataagttaaagttctgttacttctgcaaaatataaacctccaaaggttgacactgggtgtttaatgttatcactatcttcttttgtaacagaataaatacagataggtataattttaaactcttttgctcctgtttcctcctgcagttctcttgatgctgtaatacttatttcttcccctttttctctatgtccacctggaatttcccaagtttctctatctttgtgttttgctagaatccatttattttgaaatcttgatactattacagcaaataataaatcattatcgtctatttcatcccatttaaagaaattaacattaatcatataaaatatttccccttgtaatttttatatttagcaagtgcccactaaaacagatgtttccttgtaatttaaaaatgaggttttaatcaacctcattttttaactccataactttattcttaacttattatgagcataatcttttataggagcatttttaagcattagactagctaatcccattgctactacgaatactattacctctaaagcatacaatttacttgggttatttataaaataatcaactatccataatatcctttctccaaacttacttattatatccgcattgatataactaagtctagttatatataatacagctataattggcaatactataaataaaattatattggtttttatatcaattctataaaatatagctccaaacataaatcctaatgaactaaaagctagttgacatatgaacatcccaaaaaagcttcctattataccttcatcccccacaatcatatttataagttcagtttcattatctaattttacagtaccactacttacattgttagataatagattaattagctcctctattaaagttacaaatactaatgtagatagactaataattataatatatataatagatgcttttataaatgattttctatcggctcttatcctcatagctcctgaaaactcttttacagttatgcttaaagaaaatatagttggaaataaaattccaagcacactaagctgtgtcttataaagaataagtgattctcctaatgactcccctctacttagtccctctatcaaaaatgcacttacttgcaaagatataaaaattaatataaatatcatatagtatatataactatgttttaaaaacataatatgtggttttatcctattcataaacctttaccccctttttattaatgtttataaataaatcttgaagattcatattatctagttctatattacattcatttataattttcatatcaccttcaccaatatctccataataagaataagtagctatatttccaaaagacctgacttcttttaccccttttaatatcttaagtctttttaagtcctctttatttccacttatataataagattttgtatttatattttctacatagtcatttactaaaacacttccatcttttattattgctactttttctaataattcccctatctcctctattagatgtgtagatattattatacttctttttttatttacataactttctagcaaaatatcataaaactcttttctatttaaagcatcaagtcctatagtaggttcatcaaatatagttattttagcatttgaacatattcccacaatattagatacagatgttttcattcctcttgataattttttatatcttgccttttgatttatatcaaatacttcacaaagctttttttcaagttccttatcataattactataaaaacttgaatacatattaaatatagtttttactttggcttcattattgtaaaactctctttctctaactacacatatattttctaaaacctcaggatttattcttgggtctaagccaagtacttttatatctccatttttactcataagttgatttgtcattatgtttattaatgtagttttacctgctccatttttccccaaaagaccataaattttattttcttcaaattctatattcaagtttttaaatacttgtttatctttaaatttatagtttaaatcttttatctctattactctattcaaaattatcaccctttacaaagatttatttatcatttctaataattcagttttgctaattccaagttttttagcttcttttactagctctttaatatatacttctttgaaattttcttttctactatcacctattatctttttagccccttcacatacaaacatacctatccctctttttttgtataaaatattcttttcaaccaacaagttaacccctttaagtatagttgctggatttattttatatagctttgacagttctgtagttgatggaatttgttcattttccataataccttcagatatcacttcatcttctatcgcctttgctatttgtataaatattggttcattgtcattaagtattaatttcaacttaccacctccttacttggttagttacttaagtaattaactatatatctatatggtatataaatacattttataatgcaaccattttcacaaaatacttttagtcaattttagatataaaaaagcacctaacttttatgctaagtgcttttttattatctattttacatttagttttaatagcttttaattattttatagctttacctgtcatatgttctatactaattttcataacgctcgtagcatccttagctcttgatatgtatagtttaccctcttgtaaaaattcaggtgaatatttttctataagcttaagtaaagccatctctttttcttctccatcaatttcagttgcaataccaaaagctataacactttcatattttgtactaaatttacttggtaaaacttctgtatctccgactacattaaaagatactttttcatgattttttatattatcaattttgtgtcctacttttgcactatgaaaatatatacatttttcatagtatacataacttataggcacagagtgtggatatccattttcacctatagttgcaagtgttccatattcccctttgtttaatatttggtctatctcttctttaatttcaatttttctattttgtcttctcatttgtctaaacataaccaatctcctttgcagttaattttaaattttattacaagtatataataaaaatagtatatttatcaaaaatttatagtatttattatttcattaaatttttaaatatagcttcttgttctttcaaattatcactacttttccacaattgaatatcacttttatttcctttgtaataacacatcgatattttattagtatcttcattttcaattaaaacatctttacatttatttaattttgtatcatgtacgataaataatctatatccattttcctcaattaaataagtttttaaatttgtattttctttattgtaatctttaaatctatttcttttattatttttttagcctctttttcttcttcatgttcttcttttttcatttgatgttttaattcttttgcgaatttatgatcttcatgttcttctttttttatttctttatctatttccttacctaattttttagcttctttttcttcttcatgttcttcatgttccatttgatgctttaattcttttgcaaatttatgttcttcatgctcttcttttttatattcttttttgctttcatgtttatattttaagccttctacatctttttttagttcttcttcaacatgttttacttcttctttgaatttcattgttaacatctccctaagataatttagatttattataactacatagtagcaccagcaaaaaatattgtaaataagttttgttttttgtagaatgttttatattttcgaaaatattatatacatcaaaaatatgaataaaaaacatataaatatactaatgaataaaaattttcagtattctgaaaaaaacaatatacacaaagattagtcaaactctagaaaaaatatataataactaatataatatgattgtaggtatttataaagggggaatttttataaaaaaatatagtggagaaatagggttacttttagtatctttgatttggggaagtggatttgtagcaacacaactaggacttgaaaatggacttacaccatttcaacttatgacaggtagattttttataggggcatttttaataagtattatattttttaataaagttaaaaatataaataaaagtgatattatatctggaataatgctaggcgtatttttatttacagcattttcttttcaaacgtttggtcttagatacacaacatcgtcaaaaagcgcttttttaactgcagcaaatgttgtgatggtaccatttgtaggatgtctgttatataggagaaaaattgataaaataggaattatgagtagtttaattgcacttataggtataggaataatatcattagattctagttttagtataagttttggagatagcttaactttaatatgtgcagttggatttgctatgcacatattttttacaagtgagtttaccaaaaagcatgatcctgtagtccttacatgtatacaaatggcaacagcatttttattatcattattattacaaatattagtaggagagattaatactcctataaataaattaaccgtatcatctgtattattcttaggtgtatttaatacaactttatgttttcttgggcaaactatatgtcaaactaaagttgatggaacaaaaacagctatattactatcaactgaagctatatttgggatgcttttttctgtagtaatagcaaatgaggtaataacttcaagaatgataataggtagtatactcatatttactgcaattatatgtgcagaaaccaaattgtcatttttatttaaagaaaataaagatttagacttaatcaatttagataaagatttataaaaaaattagttatattaaaatatgaatattttaatataactaattttttttttagaaaattttaaaaagtagaaaattaaaattatatatgtaaaataaagcatattttattgacctaatattatagaatatttcggttgaatataatataatatcttatgtatagacaatgttttcaaagagaggggaagtattatgacaagacccacattagtggttatggctgcaggaatggggagtagatatgggggattaaaacaaatagattcagtaggtccaaatggagaagttataatagattattctatttatgatgcaataaaagcaggattttctaaagtagtatttataataagagaagaattagaggctgtatttagagataaaatcggtaaaaaaattgaaaatataatagaaactgaatatgtatttcaaaatataaattttggaataccagaagattttaatttacctaaagaaagaaaaaagccttggggaacggctcatgcaatttattgttgcaaagactttataaatgaaccttttgtggttataaatgctgatgatttttatggtcaaagtacttataaaataatttatgactatttagtaaatagtaaggataattttgaatatttgatggcagggtttgttcttgaaaatactttaacagaaaatggtaccgtagcaaggggtatatgcaaagtagatgattatagtaatttattatctataacagaaaggacttctattaaacagtttaaaaatggtactaaatatactgaagataatttaaattgggtagatataaaagaaggaagtatagtttctatgaatatatggggatttaaaccaacaatatttaatgaactagaaaaagattttagattatttttatataataacaaagataatattttaaaagcagaattttatataccatcagttattgatagtatgataaaacaaaaaaaagctaatgttaaagttttagtatctaaagagcaatggtatggggttacatataaagaagataaagaacatgtatgtaaaagtattaataatttaatgggaagtatatatcctgataaattatgggaggagtaaaatgattaaggaacatgattttaaaaatatagtaaaaaattttaaattcaaaggggaatttatagaggctaaaagccatacatgtggacatataaatgatacatttatattaatttttgaaaataacaataaagaaatagtaaaatatatactgcaaagaataaatactaatatatttaaaaaaccagatgaattagtggaaaatataaaaaatgtgactgagcacataaaatctaaagtaataaaagaaaatggaaatccacttagagagactttaaacataatagaaactttagataataaaagttattatgtaagtagtgatggaaattactttagagcttttgtatatataacagatgcaaaaacttatcagattgttgaagaacctatccatatgtataaatgtggaaaagctttagggaaatttcaaaaacaattatcagattttaaagttgaaaaattatatgaaactataatcgattttcacaatactaaaaaaagatatgaagcttttttagaagcagtgaatttagatccattaaaaagagcaaatttagttaaagaagaaattgaatttgtactagatagagctgatgattgtgaagtattagtaaatatgatagaaaaaggaaaaatacctttgagagttactcacaacgatacaaaatttaacaatataatgatagatgaaaaaactgatgaagctatagctgttattgatttagatactgtaatgccaggattagctgcatatgattttggggattcgatacgctctggagcaactacagctttagaagatgaaattgatttaagtaaagttaattttgatataaatttatatgaagagttttcaaaaggttttttagaagaaactaaagattcattaacaaatttagaaaaagaatatcttccatttggagctaagcttatgacttttgaatgtggtatgagatttttgatggattatataaatggagatatatactttaaaatacaaagagaaaatcataatttggatagggccagaaatcagttcaaattagttaaagatatggaagagaatatggataaaatgaaagatatagtatttaaatattcttaatagaaatataaaaaaggttaacttaaaggtttaatttaagttaatcttttttatttgttaattagaaaaagacaatataaaaataaataattttaacaattatatagttaattgaataaaatattaaaaataagttttactaataggagggagtatgaaatactatataaaagttgaaaatggagtgaaaatttttgtagaggatatcaactcgaaagggaaaaaaactatattatttatacatggttggcctttaaatcataacgcatatgaatatcaaataaatcaattatctaaaagtggttatagatgtatagcgatagaccttagaggatttggaaaatcagatagaccatctaatggatattcttatgatagatttgctgatgatattaaggtaataattgattcacttaaattaaatgatattttattagtaggacactctatgggtggggctatttccattagatatatggatcgtcataatggacatggagtatcaaagcttgctttatttggagcagctgcaccaagttgggtaaaaactgataattggccttatggatatactaaagatcaagtaaatcaatttattaaagaaacttatagtgatcgtccaaaactaattagagatgtaggagatttattcttctttcaatatctaacaagaccttttacagaatggtttagccaaatatgcttagaagcttcaggttgggcgactgcagagtgtttagtttctcttagggatgaacgattattttcgagccttaataaaataaaggtgcctacattaatattacatggagtacatgataaaatttgtccatttgaatttggagaatatatgaataatgaaattgaaaattcaaagttagtgccatttgaatatagcggtcatggagctttttatgaagaaaaagataaagcaaataatgaacttattaaatttatagagggttagttaatataaagaatacaaaacctacttatataatatacaatttagatacatttataaaaatatactaaaaaataaactaaatagaggaaaataacgaaatgggtcatataaatataatagagagaaaataaactgtaagaagaggtgtttatatgagtaaaaaagttgcagttatatataaaacaaaatatggaagtactaaaaaatatgcaggatggatgacgttgaaattagatgcagatttatatgaaattactgatataaggccgaaacatttacttgaatatgatactatagtatttggagcgggtatatacagaggaaaaataaatggaataaactttataaaagaaaattatgataaagtaagagataaagagttatttatatttactgttggaatggaaagtataaatgaatcaaaaaaagaagcgataataaaaaataacttagatgattttaaagacaaagatttcaaattatataattttaaaggttcatttgaatataaatctttaaatattttagacaaaattatgatgaagactcttaagaagcttatagaaaataaaaataaggtagatttaacagaagatgatttaaatatattaaaagggtttgaagaaaaagtagatttaactgataaaaaatctataaatgatttaattgaagacattaataaaaaagtaaatagctaatgataattgtttatttgacaattatcattagctattttatttaattatataaataaaaacattcttaaaaattcataataatcatttgtataaaaattaatagtttgagaatttataagtttaacaccaggataaaaagaagctttaaatgcatcttgatgtttcttaaatcttatttctatattaaattcatctggaagttttataatatgtctagataaatctccagacaaagatttaaacacaccttcttttatattttcaagtgcagtttgaggatgaatagatatagatgcatctccaattcccttagatacagcaactgtaacgatattaggatttaactcttttgcattttcacaaagcatttcatctccacttaaaaaagctacaggaacattataataagcactagtgtaggcgtttatcataaattcactagctatgttttcattaattttcacataatcatacttagaactattcatagtatgtgataatggatttccacattgactgccaccactatgataacctacaaaaagtgtagcatcaaaagttttatttatgcctgccatcataatatgtggatcattggtccatcctctaattaagtgagtattttgaggaagtaatgattgatttatacttcttgcacttccatgtgcatctttaattaatatataatcgcaattacatttatttgcaccattacaagctgaacttacttctttagtcatttgtaacttatgatattctccaaaagtagaattaagatgagtctcttcccaatttacaattccacacgtaccttctatatcagcactaatatatactttcattattttcctccatgcacaaatattattataaagttcatatctttatataatagatatagtatttggcatttaaaaatatacatattttattgataacttgcatatttttagtacataaaatatgtatttaatagatttgaggtgaaaatatgaatttactaagacctacctatgcacaaattaatctagataatataaacaacaatataaatgaaataaaaaattatatatcaagtaaagttaagttagctattgtagttaaagcaaatggatatgggcatggagcagttgaaatatgtaaaaatataaataaaaagatagttgattatatatgtgttgctacttaaaatataaataatttattttaataaagtatatttcacctaaagaacagatgctctatatgattatttaaaaattcgactcaatatattggattttaacgaatttatttattttaaacaataatatatatcattccataataaaaagtcgtatagagccttatataagaaattattacttatttatataaaattattaattaatgtttcaaataatataattatgtaaacctattaattattattttttatatagtaataaaaaataactatattgcaaaaaattgttatataatttaattaataaatatatgtggaggttattatgagttttgaaaataaattaaaaaaatatgcgcgtttatctgttgaaacaggagtgaatttacaaaaaggacaaatacttcttttgagaacacctatatcatgtaaagactttgctagaaaaatcgtagatgtagcttatgaattaggtgctagggatgttgaaatagaatggaatgatgaagaagcttctttaataagatatttaaaagctccaagtgaggtatttgatgaatttcctaagtggaaaattgaaaaatataatcatttactagaacaaggggcttgtattataaacatagattcatctaatccaacaatatttaaagatgttgatccatcaagaatgcaaagagttagtaaagcctatagtaaaagtatacctttatggagagaatctataataactgataaaataagatggactatagtatcagtgcctagtaaagaatgggcatctaaagtatttagtgatttaaatgaagatgaagctgtaaacaaattatgggattatatatttaaatgcaccagaatagataaagatgatcctataaaagaatgggaggtacataataataaacttaatgaaaaagttaagtttttaaatgaaaataattttatatctatgcattttaaatcagctaaaactgatttacatatagaattacctgcagggcatatttgggcaggtggcgcaagtagcgaccccaatggtatagaatttaatgcaaatattccaagtgaagaagtttatactctacctcataagtataaggtaaatggtatagtgtctaatacaaaaccatttatatataacggaactattatagatgattttactttgacatttaaagatggtaaggttgtggattacactgctaaagtggggtatgaatcattaaaatcattattagagttagacgaaggttcgtgctacttaggtgaagttgcactagttgaaaataactcccctatatctaatacaggaataatttattatactacattatatgatgaaaatgcatcttgtcacttagctttaggttctgcatataaaacaagtataaaaaatggtagtaaaatccctaaagaagatatggataaattaggtataaatgatagtataactcatgaggattttatgataggctcaagtgatatgaatataataggtgtaacttctgatggcaaagaaatagaaatttttaaaaatggaaattgggcataaaaaataggttacaattgtaacctattttttatttaaatctataaagattctatataatttataacttcttctattatccaatctggagttgaagctccagcagttaatcctatagtattataatttttaaaatcttcttcatttagttcatccacagtttctatagctaaagttggaacatattccatgcatatttgaactaacttttgagtgttagaactatgtttacctccaacaactaccatcatatcaacttcttttgatatttcttttgcagcttcttgtctaaccttagttgcagaacatattgtattattaaaaacaacttcttcaagcttatcagataaagcttttactatcttattatataaatccacatttatagtagtttgagctactatacaatatttattagatttttcaagttcaacattttctaaatcttcaatagtctttattattatagcttcattattacaccatccatttatacctataacctctgggtgcttataatctcctataactatgactttataacctttagaataataatttttagctatttcatgaattttttttacaaatgggcaagtagtatctataacatctaatccttttttatcagattctatataaacactctcccctaccccatgacttcttataatcatacgatttgatgtaggaacatcatttacttcatttatagttctcaaaccattttcttcatattttaaaacagcttgtttattatgaataagtggaccaagtgcgtatatgccatcattgcttttttctagttcatcccaagccattttcatagctctcttaactccaaagcaaaatcctgcatttttagctattttaacttccatttaaacttctcccttacttagcatatttatggtaattttcttttattacctctaaaacattttgagataatctttgataatcatctgtatttagtttttccttataatagtcttcaaaagatataggcttatctatatatatagttactttattaaatactttgtatgtagttattatagatacaggtattactaaagctttaccttttacagcaaacattccaagccctgctttagcttttaaaaatcctgcatctttgtttctagtaccttcaggaaacatacctatacatccaccatttcttaaagcttttaaaatgttttttacagtggatgctgtaggattatctctatctacaggaataacatttattttatttaatatatatcctaaaggctttatgttaaacaattctttcttagcaacagcagtaacttctctatttttatgcatagaagctgctaaaaatataggatctaaatttgatttatgattggcagctaatataatagatccttctttaggaacattttcaagacctattatctcaaatttaaaaaacaactttgagaaaactcttaaaactcccgttacaacattataaaatttcacattaatctcccttcaacctatcttattttacttataactgattctactacttcatctatactttttcctgtagtatcaatctctattgcatcacttgcttttactaaaggagcaaattctctatttgaatctatttcatctcttcttataacatctttaataacttcttctaaagaagtatcatatcctttttttataagttctttatatcttctttctcctctttcttcaggagatgcaactaagaaaaacttataatctgctttaggaaacacataagatcctatatctctaccatctaagataacagaacttttatttcctatttctctttgaacatcaaccattaaatatctaacttcttttatttgtgcaatattagatacattattactaacttctggagttcttatttcttcttttaatattttaccatctaaatatatattattatctttaaaatctatatcgctattttttgctatttcaattatttgatcttcattatttacatcaatatcattttgaagtactttgtatgttattgctctatacatagcccctgtatctatataatttatatttaatttatctgctactattttagctattgtacttttccctgctcctgctggtccatctactgctattactaaattcttcatatcattcactcctattcacttatatctggtcttaatttttttgcttcatttaaatatatatgttttatatcactttttttcttttcactgtttacattaaccataactctgatacattttctaagactaccttgtatacacttttcttcaaagttaagtagcggagtatcacaaatatttagcatatctctaactgctacagatgggtatactgaatctaaatcgttagtcattgtaaatatcatacttattatatcatctatatttaagtcattttcttttataatactttcaactaatactttagtttcatttaatatttcgtcttttgagtttttcttaactgtcgttgctcctctaattgctaatactttcattaatagtcacttcctgctaaatatcctgttgaaaaagctatttgaaggttatatcctcctgtttcagcatctacatcaataacttctccagcaaagaataaatttttaattaattttgattccatatttgatgcattaatttcttttacactaacaccgccactagttaccatagcagctttaattgttaacatttcttttattgttaatttcatttcttttatacattctataattttattttcatcttctttttttagttcattaggtttagcttcacttaaattaagtaagcttaaaatttcttttaaaaagttttgaggtagtattccttttaaatttgttaaaacatttttattaggattttctcttattatcctagttattttatcctttgaaatatgcggtaaaaagtctaatgttatttctatttcaccattatctagttctttatttatatatgaagaaaactttaaaacaccaggcccagatataccaaaatgagtaaatatcatatctccttgagtttctatttttttctttttaattttagttcttataattacttctttcatagctacaccttgaagatttttaacaaagttttcttttgtaactaaaggtattaatgcagggtataaaggttttatagtatgtccatgtttttttagtatatcaaacatgaatccatctgacccagttgtaggatgacttttaccaccagtagttattataagtttatcacaaaatattttttcgccattatcagttataactcctatagcttcattattttctactattaaatcacaaacctttgtattatacattatattaactttattttttaaaaggtctttttttagtgtatctataacttcatctgctttatcagattttgtatatactttctcatcatattcaattttataatctaaattatttttactaaagtattctagtaaatcataatttgaaaaagtataaaatgaactatataaaaacttattattatttacaactttatcaaagaaatcttctatatttctattattggtaatattacatctaccaccacctgtaagtctaagttttttccctatttcattatttctttctattaatattacttcattttgttttgaagatgaaattgctgccattattccagcaggaccagctccaacaactataacctttgccatatgtatatctccttattcaagtgctgagttattaattttctcattgttttttatatgagttgtatcattcatttttattataactggtccatagtttctgaattctactatattcaaagctgtattatcttgttttattctatatatattttccattcctgaatttaagaaagataaaagcataactctaactgttactgagtgagtaacaagtagtatatttttattatcatacttttcattaagttcatttataaatttatctactctttcttttattatatgtaaattttctccttctggtatttctactaagtgtggttcatttctccaagtagtatatacatcagcatacttactttttatttcatctattagaagaccttcccatttaccaaatcccatctctctaagtgcagaagttttttcaacttcaactcctaaactttttccaagtatatctgcagtttgaacagctcttcctaaatcacttgaaaatatgtagtctatttggtgattttttactaaactttcagctaactcagttgcttgttctattcctttaactgttaaatcagaatttccatgtccttgagtcttacctaaaatattccaatttgtttgaccatgtcttactatataaaatgtatttgccataagtagcctcctatatttgtacgtatttatttttaacattcatcaaaattttattatatcataatttgacaaatttaaaaacttaaacatataaaactatctttaaggacaacatatatgagaataattataaaggagttttatatatatgaaacacaaatttaaatatttgataagtatagttattgtatctagttttttattaggttttagcaataaagttattgcactatcaaaagataatgttatatacaaaaacatatatatagaagatatagatgtatcatttttaaatatgaaagatgcaattgatttggttaaatctaaatataaagaaaaaactattaaattaacttatgaagaattaaaagaatttataaaaagtttatataatcatccaaaatttcaatcctttcaaatatatttatactattatatctttttgacaattaaatttcactataaataaaaaattatatatattaaaaaattagtttggaatttgttgaaaacgatatctcaaagtggtaaaatttatacaaacaaataaacaacaaattgttagatacaacttaagaaatatttaattctatttaaaaatatcaaatataattggggaggatttattatgataaaagaaagattatccatgcttagaaagtatatgaatgaaaaaaatatagatgcatatataataccatcttcagacaatcatcaaagtgagtatgttggagattactttaaatgtagagaatttatatcagggtttacaggttctgcaggtactgtagtagtaactatggaagaagcaggtctatggactgatggaagatactttatacaagcagaaaatgaattaaaaggaagtactataaagttatttaagatgggagaagaaggggtacccactactgatgaatacttatataacaatataaaagaaggtggagtattaggttttgatggtagagttatctgtgcaaaagaaggttcaaatttagaaggtaaattagcgcaaaaaaatataaaaatagtttatgaatatgatttagttggaaaggtatgggaagatagaccttctctatcaacagaaaaagcatttttactagatgtaaaatttgcaggagaaacatttagctcaaaattagaaagacttagaaatgccatgagagagaaaaatgtaacagctcatgttataacaactcttgatgatatagcttggttatttaacataagaggtggagatgttaaattcaatccagtagttttatcttatgcattaataactttagataaagtctatttatttgtagatgaaactaagttaaatgaagaaatattaaatgaattaaataaagaagatgtatgcataaaaccatataatgatatttatgaatttataaaaactttagacaaagatgaaaagatactattagattcaacaaaaataaactatgctatattaaataacatacctaatgaagttattaaagtagatgaatttaacccaactatgtttatgaaagctcaaaaaaataaggttgagctagaaaatataagaaacagtcatataaaagatggtgtagcttttactaagtttatgtactggttaaaaaataatgttggtaagatagaaatatctgagttaagcgcatctaagaaattagaagatttaagaagagaacaagatggatttatagaaccaagctttggaactatagcaggatatagagaacatgctgctatgatgcactatagtgcaacacctgaaacagattataaattagaaccaagagatttattcttaatagactcaggtggacagtattatgatggaactacagatataactagaactatggcattaggtgaagttaatgatgaacttaaaaaacattttacagctgtagttagaggtatgataaacttatcaatggctaagtttttacatggggtaagaggatataacttagatatattagcaagaagaccgatgtggaatatgggaatagattataagtgtggaacaggtcatggtataggatttttattaaatgtccatgaagctccaaatggatttagatggagaatagttcctgaaagatttgatagtgcagtacttgaagaaggaatggtaacaactaatgaaccaggtatatacatagaaggttctcatggtataagagtggaaaatgaattagttgttagaaaagcagagaaaaatgaatatggtcaatttatggaatttgaagttgttacattggctccaatagatttagatattatagatgtgaaagaaatgaatagagaagaaagagaatatttaaattgttatcataaattggtttatgataaaatatcaccattcttaactattgaagaaaaagaatggttaaaagaatatactagagagatataacataaaatatttaatttaaataggtatataatttgtataaattatatacctattttttatttgatttattataaaatctcttgaacaataacaaaaaaatcaagtaaattttctctatttaataaaaattttaaaaaataagaaaaataatacgaatatattgaaaacgatctcacgaaatgataagatataattgaataaaaagtgtaaaaagattatgtagaataataagggggcttattatgttaaggggaaatttggagaaattaagaaattgtatgaaagaatatggtatagatgcatatataataccatcttcagatagtcaccaaagtgaatatgtaggagagtattttaaatctagagcttatatatcaggatttacaggttctgcaggaactttagtagtaactatggaagaagcaggactttggacagatggaagatattttatacaagctgaaaatcaattaaaaaacacaggtattaagctatttaaaatgggagaagaaggggtacctactacaaaagaatatttatgtgataaaatggctaataactctaccttaggatttgatggtaggttaatatctgcaaatgaaggaaaagcactacaagaagctttaaaagataaaaacataaatataaaatatgaatatgatttagttgataaagtttgggaagatagaccattactatcaacagaaaaagcttttttactagatgtaaaatatgcaggagaaacatttagttcaaaacttataagacttagaaatgaaatgaagcttaaaggtgctacaactcatattataacaactcttgatgatatagcttggttattcaatataagaggaagagatgttaaatatactccagttgttctttcgtattcattaataacaatggataaagtttatttatttatagatgataataaattaaatgacgaaataataaatgagttaaataaagaaaatgttataataaagccttacaatgatatatatgaatttgttaaaactatagatgaaaaagaaaatgtattattagatgatgaaaaggttaactattcaatatataataatttgccaaatgaagttaaaaagataaatggacttaatccaactatgaactttaaagcagtaaaaaatagtattgaactagaaaatataagaaacagccacttaaaagatgggatagcttttactaagtttatgtattggttaaaaaatagtgtaggtaaagtagagatatctgaaataagtgcagctgaaaaattagaaagtttaagacgtgaacaagatggatttatagaaccaagttttgctacgatagcaggatataaagaacatgctgctatgatgcactatagtgcaacacctgaaacagattataagttagaaccaagtgatttatttttaatagattcaggtgggcaatattttgatggtacaacagatataactagaactatagcgttaggagaaattagtgatgagttaaaaaaacattttacagctgtagttagaggtatgataaatttatcaatggcaaaattcttatatggagttaaaggatataatttagatatattagcaagaagaccaatgtggaatttaggaatagattataaatgtggtacaggacatggggtaggatttttaggaacaatacatgaatcacctaatgggtttagatggagaatagttcctcaaagattagaaacagcaactcttgaagaaggaatggtaacaactaatgaaccaggtatatatatagaaggttctcatggaataagaatagaaaatgaacttataacaaaaaaagcagagaaaaatgaatatgggcaattcatggaatttgaagttgtgacatttgcaccaatagacatagatgcaatagatgtaaatgagttaaatagagaagaaagagattacttaaataactatcataaattagtttatgataaagtgtcacctttcttaactaaagaagagtgtgattggttaaaggactatactagagaaatttaatctaagggtatactaaagtagctttgtatatgcaaagctactttaatataaaactaaatattatttaagggggacttgataaatgtcaaaaacaacatctgcacctacaaagcatcctaaaggattatatgtttgtgggttaacatttacgtttgaaagattcgcatactatggatctaaaacgttattattactattcttatcgtactcaatatctcagggtggattaggaataaacaacgccgatgcagcagctatagcagcaaacctagcagcattcacttacttagcaccaatatttggtggtatgatatgtgatagatggataggagctagatattgtgtaattataggatcagttataatggcagcaggatatgcactaggttattttgcaacaagtgtaatgtgggttcatgcaatgataattttaatatcaataggtactggtttctttaaaggaaatttaaatgcgttagttggggaattatacgatgataatactagaaaagatgcagccttttctttattatatacatttgttaacttaggatcatttataggatcattaactataggtatattatatactaaaacttttgcagttatagaaaatggacaagttattgaatatggatttagacaatgtttcatgttagctgcaatagttacgttacttgggggattattatttacttgcactatgaaattcttaggagaagctggtaaatatcctcaaaaaatgcttgataaacaagctggtgacactaaaggagaaaaatcaccagatagacctttaactaagaaagaaaaagacagagtaaaagtaatattcatattatcatttttctcaattttcttctgggtattttataaccaagcaggttcttcattaactttatatatgaaagattatgtaaacatgcatgtaggaagctttgagatacctgtaatgtggatagaaactgcattaaatggatttttatgtgtagttttaggaccaataatggcagctatatggactatgttatctaaaagagaaaaaggtgacttaagtatggctcaaaaaatagcactaggatatgtatttttagcagtagcatttggatttgtaatagctgctgaactttcaagaggagtaggagcaccttctactgtaaaaactagtgttatttggttaatgttattcgttttattccaaactataggagaaatgtgtttctcaccattaggtaactcactagtaagtaaaatagcaccagctaaatatttatctttacttatgggggtttgggcatgtgctactttctttgcaaataaagcagctggatatgttcaaatgataatagagaaaatgggacttatgcaaacattcatttctatacctgtaatattaatagttggtactttcatattacttggattcaataaaaagttaactgctatgataggtagtgatgatgaggaagctacagcttaatgatataaatttaaagactagggtattccctagtctttaataatttttgtttatagatcttaaatattcagtaggtgaaaatccataaacttttttaaatttatttgaaaaataatgtatagagttaaatccaagtatctcagatatttcgctaatagtataattagattcttttataagttctttactcttttttaattttaaatcattgatatatagtttaactgtagtatctaagttctttttaaataacaaatgaagtttagaactacttatattaaatttatcacaaattgtttttatatctaggtaatcatataaactatcatttataaattgtaatatattatttaaaagagtatcatcataatattgctgaactttgttaacaggttttattattgtactttcaaaatccatactaagaattttaagaaccaactcttttaagtaacatattgaaagctcatcacagtaaagatgagtagaattaagttctttcataagtttgcttattatagtgtggatttctttagtaggggaaaatactttattagaaatcaatgaaatatcgttaaaatccatatcaaagcttacagttaaataagaacaagactttttattgtctgtatactgactatgataatcattaggagaataaaaaaataaatcaccttgagataatttatattctactccattaactttggtataaagaattcccctatcaacataagcttatgttgataggggaattctttatagctgattatcctataacatttattattatgcttatatcatctataataacaagtacactaacttcaaagataaaaaaagaagttatgttatctaatatgagagaacaaaggataattattttatataaaaatataaagaatttattaaaatcacgaaataaaaatgaaatagtagatatatgtaatataagtttgatgaatatattaaacaaatcaatagctacttcaatatcagatttggatggaaacttgaataatcaagtagtaaatatttataaagatgaagatgataataaattatttaaatctacattagagatagaggcatttaaaaaagcctttgatttgggtagggaaactggtataaatactgacatttaccaagatacaaaagtttttaattatcctataaaaggtcaaaattctattttaggggtaataggagtagcttgttctgatggtatagcattagatgaaaatgaaaaaattttattagaatcaatagctactcaagttgctcttgcaattgaaagagaaaatttgtttgaaaaaacaagaatagcaaatttaaatgctgaaactgaaagattaagaagtaatttactaagatcaatttctcatgatttaagaactcctattacaggtataataggatcttcttctgtaatcttagaaaattataaagatattgatgaagaaattaaaaaagaacttataaataatatttatgacgatgcaagttggctttctagatctattgaaaatgtaataagtataactagggtagatgaagatagattagaaattaagaaaagcttagaagtagtagaagaaatagtgggagaagctatacatagagtaaagaggttttcaaataaacgaaaaataattgtagaacttccagatgaagttattatcgtaaatgtagatggattattaatagagcaagtaattatgaacttaattgataattcaataagacatacaccagaaaacttagaaataaaagtaaaggttagtaaagtagaaaattatatacaatttgaagtagaggatcaaggaagtggattaaaagaagaagatttacctcatatatttgatagattttatacaaagagtaaggaaaaatctttggaaaaacgaggtataggtcttggactagctatatgtaaatcaattgttgaagcacataagggagatataaaagcatttaataataaaatgggaggagcaacatttagatttaaaatcccatatacaaaggagtagaatatgagtttaaagccgttgatattaataatagaagatgaaaaaccaattagcaagtttataaaagtatcacttgagacacagggatatgaatgtatagaaacagataatggaattaatgcagtatctatagtttattctatgaatccagatgtaataattttggatttaggattaccagatattgatggaatagaagtaataaagagagttagggaagtaagttgtgcaaaaataattgtagtatctgcaagagaacatgaaagggagaaggtatatgctctagatagtggagctgatgattatttaacaaaaccatttagtgtaccagaattattagctagaataagagtttctttaagaaataaaaataacctatctataaatacaaaagaaaaagataatgtttttgaagtaagaggtttaaaagtagactttgaaaagtatgaagtaactgttgataaaaataatattcatttaactcctatagaatataaaattatggagttgttatgtcaaaatgctggtaaagttttaactcataaatttataataagtaaaatttggggtaattatttagaaactgagacacaatcatcacttagagtgtttatggcaagtataaggcgtaaaatagagaaagaccctgctcagccagaatatataaaaacagaaataggtgtaggatataaacttatagctgaataatatattaatgaaatctttatgcatttataattatcttaacacaatctttataccctatttaatataattaacataaaaataagaaataaatatttatgttaaggagtaagaaaatgaaaaaggatgatttagagtatgtaattattgcggggtgtagtagatttggagctaacatagcaaatgtattatctttaagtggaaaagatgttattataatagatttagatgaagattcatttagaaaactttcacaagattatagcggatttaaacttataggtgatgcaactgatatagatgtattaataaatgcaggaattaataaagctactatgctagtagcagcaactaatgatgatgatgtaaatattatgatatctcagatatctaaggttatttttaatactaaaaaagttatatcaagattatatgatgatgacaaggaagttgtatataaagactttaatataacacttctcagacctaccagtttaactattaatgaatttgaaagattgctttatataaaagaaacaagcaataaaaataataattcatttaaatcaataaaaaatgataaaataagtagtttgataagaaaagtaggtgcatattaatgaatattttaattgtaggtggaagaaaaaaagcagagtttttattaaagtcattattaaataaaaatcataaagttacctttgtaaataaagattataaatattgtaaagaattaagtgagatatatgaatgtagtattatttgtggtgatggatgtaaaaattatattttagaagaagctggggctaaaaatgcagatataataattgcaatgacttctaaggattctagtaatttagctatttgtcaattagctaaaaaaatttataacatagacaaaacatttgccacagttacaaatcctaaaaatgtagaagtttttaaagctttaggaataaatggagcaataagtgcaacttatatagtatctgatgttatagaacaaatggctacaataaatgatatttatgaatttgtaccaattgaaaatggacaaattagactactagatattgtagttaaagataattcaaatttatgtggaaaatatataaaggatttaaacttatcagataaatctataattgggtgcataataagaggtaataatagtattattcctaatggaaatacacaaataatggttaatgataaacttataatattatgtgatgtaaatgttcaaagagaagtattagacaaagttttagaaagtggtaaatcttatggaatgtaaaagatttaatcaatggggaagtactatttattatataggaatttttacatcaatatctgggtttatattattattaccactaataagtattatattctatatagatgaattaatttatgcacctagttttttaattccagcatttatttctatagttttaggattaattttagcaaaaaaatttaaaggatataaagaaagaactttatcggttggagaagatgcagtaattgtagtaagtggatggatattagcaacagtattttctgcaataccatttattattggacaaaatttaaattttacacaagcatattttgaagctgtaagtggatggacaacaactggtctatcagttatagatgtagaatcagctccccatatatttttaattcatagaagtataatgcaattttttggaggagtaggaattgttttagtaatgctatcagcattatcatctacatttggaatgaaactttataactcagaaggacatacggataaacttcttccaaacttaattaaatcttctagagttataatttctatatatttaggttatgtggtttctggaacaatactatatgttatatttggtatgcctgtatttgatgcaataaatcattctattgcagctttatctactggtggattttctgtaagagctaatagtattggatattatgataatgtttttatagaattgataactattatattaatgatattaggtacaacaagttttgcaactcatttattacttgttaaaggtaagtttaaggaaattttaaaattaggcgaaataagatttatgtttttagttttaggaatctttataccacttgttacttttgtttctttaaaagatttgtatacaagtttatataaaggtattagggttggattatttgaggttgtatcggctttatcaactacaggcttttcaactgtaacatataataactggccatcttttgcaatacttataatgatagtagcaatgcttataggtgggggagcagggtctacatctggaggtataaagctttatagagtttacttaattattaaaaagttaatatggaatataaaagataaatttttgccgaaacatcaagtatatagaaattatgtatataaggcagatggcaaaatatttataaataaatcagatattttagaagtatataactatgcgtttatatatttagtggtatttattttaggggtatttattatgttagtatataattacccactacaagatgcaatgtttgaatttgcatcagctttaggaacagttggattatcagtggggataacatcattaaatgcaccaccaattattttatgggcagaaattataggaatgttattaggtcgacttgagatttgggttatattaatagccatagttaaaattgttaaaaataataggaaaagtaaataataagagtgattaaaagagctagtaatttcactagctctttttaaagttatagcataatattttattttttcatggatattatatttttactaagttcatttatactctctgttaggctttgaagttttccttctattcttatcagtagatacatactgattgctataggaaatcctacattggctattagagtttgaatttctgagttcatttaaatttcctcctttaagctaggtggcttcgggtaagttttggttatatagcatcttccttcactgtaaagcctaaaaggcaaggctttaacgtttcgtcagattgctatataaactaaaactttacccttcgcctttattataaatttagtttgttatgtaagtgtctttgaagccttttgatatggcttcgttttttagttttagggcattatttttatccttaaatgcacctatggttactttgtaaagtggagttttgggtggtgtttctttgttgataaagttaagtagagtagaagctatggtttgagctactttttgtaggtagtcttcttttttacataaatcttctatttctgggttagatataaagtctatttctattattattgctggcatttttgtgttttttaggactgagaacttttttgattcttttactccacgatttggtgtgtttaagttttttgatagatttgaagttagatttttgcctagtgtggagattttgctgtttaggttataaacccaagtttctgtgccttttgctgatgtgttagtggatgaattcatgtgaaggcttataaagtagtcgcagttttctttgttggctttggtgcacctttgtaaaagagtgtagtaggtgttgttttcacgagttgttattactttttcgttggatttttcaaggatttcttttactagtagtcctatttttaagattatatcactttctttagtgttgtttttaccaagagctccggggtctttgccaccatgaccaaagtctaaataccatttcataggttacctcctttattttgtttactatatggtatcagaggtttcttatttaatatatcaaagtactttaagaatggttaaaaaaattatattaaaaatgaaaaagagtgtacctaatgaaatatagtgatttcaatagatacacttttttacacatatttccaaaatcttaagacttggtgttttaatataaaaaactgtacaaaaatggtattttttgcttcttgtacagtttagatagtaaatatattattttaaaaaattaactaaaaaatcagttttaatccaatacaaaattccagtgaaaattaaataaaacataccttctaggggaaaatatcttagttttatttctttaattccagatttaattttctttactaaatcattgtaaaaatcaatatcctttatatctttaaaatctggcactgaaatataaatctctctaaaatttagattcatgatatagtcaaaaataaaaagagtatatctatttaaattattaaattaattatactaaattttttctaagctcttcttatgatatatccaaaaggaaatatgtctattacgtagaatatattataaattattgttttttgattttaatcatcagatttttaatagtaatactgattttacttaaattaatgataagattataattttctaagttaaaaaggagatttaaaatgaaattaaaaaaagtgcatatattgggattaataattgtaggtgggttaatatttacgagtttagataccttcgataattctcaaaataaacttactaacctagatattaatgaaaataaatttgaaataaaaattaatgaaaaaggtcaaacttatggcagtaatttagctaatacagagtacggtaatgaaccagacttaatattagttgaagcagataatggtaaaagtggatatgtctataaagatgatttttacgacacagccaatcaacctaaaaatccagaagaagcagtagcttatactaaaatggtagaaaaaaaagtaaaaaaacatggctattataaatctattcctgtttatgaaaaagatggaacaacagtaataggttcttttaaaatatgttaaaaaagttatagtacatactttaaatgtaattaaattgcaaactaagagagcaataacattaaaagttattgctctctttttgtgttagataatactctttaattacatctttaaattgactaccacacctttcaacctctcccattactttatcaattccttcttttgtattaaaccaattatgtttatttatgccttgagtttctgtgggatatactataaattttgtatttggataaacactttcataacacatgagacatcttcttgcatgaaaagccttacaacatattattgctgtatttacatcaatatctaactcatcagtaattttttttgaaaaaatagcattttcaaaagtatatgtagctttatcttctcttaatatatattgttgttttactccatttttaatcaacacatcatttaaaaattcccactctgtatcataaattttattatatacattagactttgaacgaggccctggaaaatatcctctattaacaccaaacttccctgatggtagtataaatgatgcatatccatcattccaaagcatagctgctgtttctgcaatttctgcatatgacccacctggaataaaaataatatctgatttttttagttcatcacttataaatataaatttagtaatatcgtcaatatatttcatttatccccctccgatattttttattcctatagtttatcaatttatttaaattataaccttgaaagacttatttagttacattaatcaattataaaaaatagcccttaaaatctattttttaagttttaagagctttatgtttatttaaaatttatttcttatcttttttattgatagcaactatactgcataaaatagcagctcctatagcaatccaaatagcaatattcatttaaaatcctctacccttcaaatttctatttatatattaaatacacaaattaattcataattgatacctatttataatttaattattttttctcccaatatataatccgtgcttactatatcctattaagttaggattttcacaagtatctaaatgaaatttaatccataaattaaattcttcatctgtaaattcatttacacttgctctaagcatatctgctattccatcagtccctatatgtataatttttttaatttcattttcatccatcatcttttcaataattaatctactatcctcatcataaccttcataataatttttaattttttcctctaaactcttcatactaacctcccctaataattatttatactatcaaacatatactttctttaaattgtagttgaatgtttataatttttcatcctaaactaaagtctaatcccccaaaatacattttacatatagttaacttattttaaatataaattactttaaacacattattttatttactacaattatgcctgagactatacttaaattaaaacctttatttaaatatcgggaggtagtaaatgagtagattaaatttaattttaccaaaaaaagaacacaaagaaattattctagattataaaaaagagtttcttgaaaacaaagatagtatggatggttcagctggattaagcactgccaaaacttttgaagattggtataaagcagttcaagataatttaaaagaagaaactgtaagagatggattcgttccatcaactacataccttgcttttaacaatgaaaataaattagttggcatgattgatattagacatagattaaatgattatttattaaattttggtgggcatataggctatagtgttagaaaatctgaaagacaaaaaggctacgcaactgaaatgttaaatttagccttaaaagaatgtgtaaatttaggaattaaaaaagttttaattacctgcgacaaaaacaatattgcctcagcaaaaactataataaataatggtggtaaactggaaaatgaaattgccaaagaagatagaataacgcaaagatactatattactttgtgctaacatcataaaataaatatttatcatattttttacatacataacactttacttaatttatgttataatatgtctatatggcaagtaaatcacaataacacactcattaattagtttatttgctattattattaagggcaattggatttttttaatctaattgcccttaaattatataaaaaaacatattcagtgttaattatatttaattttaaaaatacaaaataatttatatttttaagtttatttaatatgataatatatttacatattgattatttcaaaagggagtaggattatgaaaaaaagcaatttttgtccaaaatgtaattctaaaaaaatagttaaagcatatgataagacaaggtttaataatgccctaagtatcaattcttttaaagttgcaacatctactaaatatatttgttgtgattgcggatacatttaagaatactttgataacttaaaagatagaaatagtatttatgctaaatttaagggggataacaatgaataataaaagtaatgataaattaggaaaatttattttttacttttcaatactaacatcattgcttattatatatttctgcacaaagaatggaaatattaaagaaaatttaaataacggaaattggtttaatactttaggacttattctaataaatatattaaatatatatggaggaataaaaagtaaaaatgataatgaggatgtaatttttaatacatatagaataaaaggttgtatgtttatgttaacttccataataatatttgacttcattccaagattgtattttacactagtataatctataaactaattattttttaaaaaaagagggtatagtatttcactatgccctcttttatacttccatataagggtataagctaatatatacgacaaataactaaagatttatattaaggagtaataaacatgcatagcttaacacaactattaaatgattatggatatattattatttttgtagcattatacttagaattgatggcactccctttaccagggaaattgctaatgagttactgtgggtttttagcttttcaaggaaagttaaattattcaacaagcatattatttgcaagtgcaggaacaatatgtgggattactacttcatatttaataggaaagtttttagatatagagattgtaactaaatatggaaaatacgttcatatacactcaaaacatattaaaaaagcaactaattggtttgataagtatggcaataaattattaataattgcttttttcatacctggtcttagacacattacaggttatgtatctggaataacaaacttaaaatataaaaaatttgcattacacgcatatttaggagctttaatttggacttttacatttatatctctaggtaaagctttgggtcataactataaactacttcatacatatgcatcaaaatatttagttttaggagtaattcttatagggattatagttactattgtatatttatataaaaagtacaatataaatataagtgaatttatctataagaaaataagtagtattttaacactttataattctcttggtaaattaaaattgatactaattcttgtagcaattggatatacatatcttcttgtaaaaggatttgaactaatacacaattttatgaaccataaactagatttatttgataaagtcacaacaataattattaaagctattttttcaaaggagataattaaaagtataaatatatttagatttatttcttttatagacataggtatttttacaatagtagttttaatagtttggatattatttaagaaagaaaataaatataaaaatataggttttgtgcttataactgtattaggtggcacagttataatagagctaataaataaaacttttgaatttaataatttgcatgttacaatccgtgagtttattaaatatagcttccctagtgaagatatatttttcacatcaacattaattggaacaatattgtactttataattaaatacaataaaagtttaattattaaaaatatatctgtatttatttctatattaatttgtttagctatgggaatatttgatatttctttaaatatccaaaatccaagtggtgtaatagctggttatttatttgcaacactatgggtgatatttaatatagttgttttgcagctatctattgaaattccaaagatagaatctatgaaaagtatgtaaaaaaatcaaagagtttagatttgataagaaaatataaagtattcatcaaataaaaagatggcttataagccatccttttattactataataaattaaaaatttaacactattttaaaataatttagtctaatacagcttccttaagtacttcccctattgattcatttattactaaagtattacttttattaatatttatatcatctctatttattacaacaatatttttacctttgaagtaattaataaatccagcagcaggataaacaactaatgaagttccaccaattatcaataaatcagcactacttatagccgatatagccttcttaataacttcatcatctaaagcctcttcgtataaaactacatctggttttacaatagaaccacattcttcacaatgaggtatagttccctctaaattaagcataccgtctaagtcataaaatttcccacagctttcacagtaatttctatgaacagatccatgtaattcaaaaacatttttgcttcctgccatttgatgaagtccatctatgttttgagtaattgtagcttttaatttacctcttttttcaagctctgcaagtgctatgtgtgcattgttaggttttgcatctttatatatcagcttgtctttataaaaactaaaaaattcctcagggtgcattacataaaaagaatgagaaactaattgttcaggggtaaatcttttatttattttttcattaaacaatccattagaacttctaaagtctggaatacctgattctgtagaagttcctgctccaccgaagaaaacaatattgtcactttcatcaattagtttaactagtttttctattttagaattcatattatcatctccaaaattattatttctatttttatattatctcataaatatgcaaaaaattaaatctagttaaaacagtacattaaagtatatattctttaaaaatatcatattaatattaaatttttataaaaaaatatgtcgaaaatagttaattaaagttaagttttataaatatattaaaaaataaatttcaattaaattattcataattaaaggttttaaagttaatatgaagaaatatacaaacaaccaataaatgaatctttttaaataagctttataacatatcaaaaagcatcccagagttaaaatttaaaatatatggaatcaatttgaatttatatatattataaatgctattgtatggttattaatgtttatatcaatagagagagatattaaaatcgattcaaaacaaggaatattatataaagaaggtttaatattagagaatggtagattatatcgttttagcagtgtaaagagctatgagtttaaaacttcttttaaaggaattaagtatagagaattagtattaacttttgatgataataaagttaaaactgtatatatttataaagatgatattgaaaaatttaaagaattattgaaataaaactaataaaaatataaattgcggcatttttatatctatcaaaaatgtaaggaatatttaagattgacgcaaggctattttaaggttgagcatgtataataaacttatcaaataaataagacattgggagtgattgtatatgacaataatattaggaactttaatgatagtaccatttatattagcagcaggggctggactattaaatgatgaattaaaaattgcaaatgaacaataattaaatttatataaattgataagcaaaaaatacttatataattagaaggttattagtattaaaaccgtagatgatattactaatgataataatgtagaaaaagaagaaatatatagtaaagattatagtacagaatgaaatttttcaaatgaagttttaataaaaaataaagcagatgaaaatgcctttaaatctcgtaaaattactggtaatgaatagatattgtaattgattaaaattgtatagaagaagtttatgaaataactaaaaggaagagtgtgcaatacatcaatccttttagttatttttatttactttaaaatattcattttgtacaaatctgcaaaaaagtataactagtaaaaagaaagctatataaccaacttattttaaagtgtctatattagggattacaactaaatttataacagcttgaaattgactagatttttttgagatatattcaaagatagttttagtagagtttaatttggtttgaaaaatataaaatcctgatatcaacattattgctacaatcaaacaaaatattttagatttaaaattaactttcatattatacccctatattttatattatgagtaaattgtagcagaataggacaatattttcagtgtgtaaatttatacaaatgacgggaataatatacgaaagatataaaacgacaaaagtgaagtcattgaaattaagtaattctaatgacttcactttttattttactctaaatcttgaatattcatcctatctatagcactgtttttctttatttttttacgactaaaataataaattgctaacaatactagtgtagggatattaaataaaattaatgttaatataaaagtaaaaattccactaacgtctaaactatctatagagaaagtaaaactaatcagtaaaatagaaaatataaaactaattgatggaaaaaccaaccctaaaaatttattttcattactagaaagtttagtttgagctattataacaacaactattaataataagctaattaaaatatttgtaattaataacatactatttaccttctttctttaggtttttgtattctgaaattaaaattttagcagtatcaaaatctagtttatcttctaatgctaatttttttatcaacataatataaggttcattagttttagaatcatttaattttattttttgaatcaacttatccaatctcaatcttacagttggataagttactccatacaaagtagcaacttcttttaatgagccagatgaaagtataaatttttttatgaaatttatatcttcctcatctaagttttctatccattctggtaatttattcatatgtatcacctcttgcataaatttaaagactttaatataattaatataaattttaataatattaaagtcaatactaaggttatattgaataaagttaaaaaattaaaaaaataaattttaaatacataaaggagaataaaaaactaatgaaaaaaaagcacaataagatatttataggagcctttgttattatgattgtattacttggagttgtagcaagtaatattatattaaataaaacctataagactaaatatgaagattttaattcattggataagaagatgtttgaacaattatcaaatatatataatcaatttgagaaaaatagtgataagttatggaatgataattatagactaaatgaattaccaataattttaataagaactaaccaagataaaggcgttatgagaaagtatgcatatgctattaatgttaaaggaataaaaaatagtataatttcagagaaaatagatatgcctaaatctttaaatttgcctccagtttatagagttagtaaatttgatatagacatgatttcaacttggtttccttcaaactttgggactttagacattgatggagaaaatgtattttattttaagtatcatcataaaatgatagaaaatccagatttatattttgacttttcatcatttttattacatgaatcattccacgtatataatcaaaaagattggacatatgataaaaatgatggtgaatatatagaaaactacccagaaaataaagaaaactatgcatttattggattagaatttaaacttttagataaatgtatggaaagtgtcaataaagaagaaataaaaaagtatttaaaagattggactattgtacgtacttatagatacgaaaagtggccacagttaatggcagaaacaaatacagaagctatagaaggagttgcaagatatatagagtatagatacagtaaattaacaggtggaagattaaccgttcttgcaaataaagaaaagccatatcatgttactttctcacatgcatttgattgctttgcagatggtacagcaaaacctatatcttacttaaaaagacctattaagtatgaaacagggtcagcactaggtttaataatggataaattaggtattaactggaaagaagatatagaagatggaaaaggcaaagatggaaaaactcagtatgaggtattaaagaagtattttaatgtttcaaatgacgatattacagaaggtaagatgaatgaaataaaacaagaaaatagttataacgagttattaagaaaaggacaaaatctatgtgatttacaaaaataaaactatatactttttttaaaataatttggcttaatttttggctaccttattttattttaagtagtattaaaaatatacttagaaatataaaaaataattatttacatttatataaattgaatataatcaaaatcatataaataaaaccattcaatcaatagaaaatgctataaactaatagacctaatataggtctatttttatatgaactttaaacatatattctagtttgataatttaacttttatttaattgtaaaatgttaataatatattatatagtaatttgtatttatactaatttgagaggtgaataatacatatatgattatttttataaatatacttgtagtattttttcttgtatttttaaatggatttttcgttgctacagagtttgctatggtaaaagtgagaaaatctaggatagaaacattagcacttcaaggtaataaacgtgctaagaacactttaatagttgttaaagatttaaattcatatttatcagcttgccagcttggaataactttagcatctttaggtctaggatgggtaggagagcctgctgtgttacgtctattaatgccaatatttaatctatttcatttaccaccaagtgcccaacattcaattgcatttattattgcattttcaattataactggttgtcatattgtatttggagaattggttcctaaatcactagcaattgtaagttcagaaaaaatagctttaagcacagcttttccacttatacttttttataaagtaacgtatccagttatgtggatatttaaccatagtactaattggatattaaagatatttggactttctcaagttgatgaacatgaatcagttcatactgatgaggaaataaagttattgattgaagaaagttataagcatggtttagtagataaaactgaattaactcttgttgataatatatttgatttttctgataaaactgtaaaagaaataatggtcccacgtactgatattataaatattttcatagaagactcttttgatgatattatatcatacacattaaatgaacagcttactagatatcctgtatgtaaaggcaataaagacaatgttattggatttatacatataaaggatttatataagcaaaagattgaaggtaatggccaagatataaaaaatattattcgtgagattaaacttgttccagaatctatgttaataagtgaacttcttaaaatatttaaaaaagaaaaagtacaagtggctttaattattgatgagtatggagggactgctggattagtaactatcgaagatattttagaagaaattgtgggtgaaattcaagatgagtttgatgaggaagaagatgcaattattaaaactgaagataacagttatattgtagatgggaaggtacttattgaagatataaccgaacttttatatataaaaattgaagatgaaaacatcgatactataggaggatgggcttatattcaattagattcatatccacaagttaatgacaagtttacttataaaaattatgagtttattatattaaaatgtgatagaaaaagaataaacaaattattgattaaggatttatctgataaataataaaaatatagttatgagcggaatataattagttgttataagcgcaataaaaagtgtatatataaataataaaaactaagatagcgaggagcatatgaaaaaaacattacatgaatatgaagaagttataaaacagcttcctataaaagataaatatgaaaaaaatgaattattaatagatgatttacttatagaaaaaagtgggaatatagaaatatattatgctccacataatgattatttaaactcaaaagctaagatatttattgttggaataacacctggatttcaacaaatgagcacagctatttccactgctcgaaaagaactagagttagaaactaatattgaagaaattcaatataaatgtaaggtggctggtagatttagtggaagcttaagaaaaaatataattagtatgttagattatataaaacttaatgaggcgttaagtataaatagttgtactgacttatttgaagacaaagattacttactacatactgtatcattggtaccttatcctgtatttgtaaaaaaacagaattattcaggacatacacctaaattattaaaaagtgagtttttaatgaaatatgtatatgataattttattaaagagcttaacaacattgaaaatttaaaagatatattaataatacccttaggcagggatgttgaagatgtactgtataaattatcggaagaaggaattatttgtgaaaaacagattcttaaaggatttccacatccatcaggagctaatgtaaatagagttattcaactggaagaaaatagagaaaatttaataaagcaaattaaagaaaatagtgggttttagtaaagtatataatatatttaatactcacctaacagctaataagtaattactcagtttttgtgttgaggaaaatatctgttttattatgcaatgtacgttggataagttagtgaagatatattttaaaatgaatttataaataaaaggtgatatctaatctaaaaaggagctttattgaaatgaagctccttttttacataaagaattaggtaaatcaatatttaatcaattggaaaatatagtgtatttgcattattaatattgttagttttaattaattccaatagtaaatgatagagacttatttgacaaaactataggaaataacagaaaaaattataggtgttacggattgatgaatttaaatagaattagaaattgaggatgagagaatatagaatataaaaaatacgtaggtttatattacctagtagggaatgacaaatttaaaataaaatctggagaaatagatataatagcaaaattaaatgatgaaatattatttgtagaagtaaagtctagaagtaatataaagtatggatatccatcagaatctgtaaattataaaaagaaaacaaagataataaatgtagcaaaatactatatattaaaacataaattagaagaaatgccagtaagatttgatgttatagaagtttatttaaaagataataaaataaaccatatcgaaaatgctttttagaaataattaaaaaaagaggtaaataaatgttaagtatcataaagtctagtacattattaggtattgaaggaataatagtaaaagtagaggttgatataacaaatgggatacccagttttaatatagttgggttagcaggtacatcaataaaggaatccagagaaagagttaaatctgctatattaaatagtggatataagtttccaaactcacgaatagtagtaaatttatcaccagctgatatgaaaaaagaaggtgcatattttgatttacctatatccataggaatactgagaagtcttataaaagaagatgataaatatatggatgaaagtgtatttataggtgaactatcactagatggtaaactaagaaaagtaaaaggcgttttatctttagttataaatgccaaaaataagggtataaaaagaatatttttgcctaaagaaaatgaaagagaagctttatttataaaaggtatagatataatccctataaataatttaaatgaatgtataaggtttataaataaggaagtagatataatttcaagtaaaagagaaattattcataataaagaagaatatgatgaggattttgcagatataaaaggcaattactttgtaaaaagaggtgctgagatagcagcagcaggaaatcacaattttttaatgataggtcctccaggttcaggaaaaaccatgatagcaaagagaataagaactatattgcctgaaattaatgaagaagaaattttagaagtgagcaaaatatatagtgctgcaggacttataaaagacaatgaaggaatagtaaaatctaggccttttagatctccacatcatactgcaactaggcaatcactaattggtggtggaattgatgcaaaacctggagaagttgtacttgcacataaggggatactgtttttagatgagatagcagagtttgataaaaagatattagaaacattaagacagcctatagaagataagtatataaatgtatctagagtaaagatgagtttaagatatccatgtgatactatttttataggagctatgaatccatgtccttgtggattttatatgtcagataaagaatgtaaatgtagaccttatgaggtcaatagatatttaaataaaatgtcaggacctttactagatcgatttgatatgtttatagaagtaaattccataccttatgatgagtttaatagtaataaaattgaagaaaaatcaatagatataaagaaaagggtagataaagctaggaatatacaaaagaatagatttaaatatgaaaatatagaatttaataatgaaataaaatcttctaaaattgatttatattgtgtattgactaatgaggcaaataatattttaaagactatatttaataaatataatttaggcaatagaagttacataaaattaattaaaatggccagaactatagctgatttagatgaaaaagaatttatagaacaaaaccatatactagaagctttttcttttagaaaagcttactataactactttatggctgaataaaatagttttaacttagaggtgaataatggataaaaaagatacatatttatggctattatctataggtggaataggaaataaaactattgaaaagatagaagatagtgtatcaaatattgaagaacttatagatttttcagataaagatatattaaaattagaaaatataaatttaaatattaagcagaatatagtaaaatataaaagtcgtacttacatagactctataaaagagaaattacaaaagtatagtgtaaattatatgagtaaagatgaaagtatatatccttctaaattaaagcatatttataattgtccaagtatacttttttacaaaggagatgtaaatcaattaaataatttatcattagctatggttggatcaagaaaacctacatcatatggaatatggtgtgctcaaaatatgagtgaaaaactatctaattgtggtataaatataattagtggtatggctataggaatagatgaacattcacataaagggtgtataaaaggaaaatcaaaaactatagcagtattaggttcgggagttgagaaccctcttcctaaaagtaatttaaagttatctgaaaaaatcctagaagatggaggacttttaatatcagagtataatgtagaacatcctgtatctgtaggtaattatcctgctagaaatagaataataagtgggataagtgaaggggttatagtagttgaggccgctaaaaagagtggggcattaataactgttgactttgcacttgagcagggtaaaaacgtttttgctataccgggtaatattaattcagatatgagcaagggttgccataaaataataaaagaaggagcaaaacttgttgatgatatagaagatataataaatgaatataatttaaataattttaataaaatacctaataatagtgataataagccattaaagggtgttcaaaaaagcatttttgacattataaaaatgaaaggaagcttgcatatagatagaatttgtgattatactaatatgaatatacaagatataaattgcattttaaatactcttgaaatagaaggaatggttgtagaaatgcgaaataagatatatagtgtaaaatagaattaaaaaattgtgggggtgtggttatatggcaaaaagcttagtcatcgttgagtcgcctgcaaaagctaaaaccatagaaaaatttttaggaaagagtcattatacagtaaaagcatcagtaggtcacgtaagggatttacctaaaagtaaattaggagtagatatagataataatttcgaacctcaatatataaatataagaggtaaaggggatgtaataaaggaattaaaaaaagaggcaaaaaaatcaaagaaagtctttttagcaaccgaccccgatagagaaggtgaggctatatcttggcatctagctcatatattaggcctagatgatacagaaaactgtagaatagaatttcatgaaataactaaagatgctataaaaaaagctataaaagatcctagaaatattgacttagatttagtagatgcacaacaggcaagacgtgttttagatagattattaggatatcaaataagtcctatactttggcaaaagataagaaaagggcttagtgcaggtagagtacaatctgttactacaaaactaatatgcgatagagaaaaagaaatagaagagtttatacctaaggaatattggactatagaattagaagctaaaacaaaagaaggagaaaacttaagtttaaaattctatggtgaagatgataaaaaggtagaacttgaaactaaggaacaagtagacaatatattagatagaattaaagataaagatttaattgtaaatagtatagagtctaaatcaagaagaaaatcagctccaaagccatttacaacaagtatgcttcaacaagaagctgcaaataaacttggatttacgactaaaaagacaatgatgattgcacaagagttatatgaaggtatagatatcgaaggtgaaggaactgtcggtttaatttcatatataagaacagattcaaagagaatatcagaagaagctaaggaaaaggcaaaagaatttataattgaagaatttagtgaaaaatattataagtttgaagaaaagaaaaaagcaaaagctgaatctaaaaaagttcaagatgcacatgaggctataagaccgacatctgtagatagaactccaaacaaaataaaatcatctttaagtagagatcaatataaactatatgatttaatttggagaagatttgtagcaagtcaaatggaagattcagtatttgacactttaaatttaacttgtaaagttgataatattgtatttaaagcaacaggctcaaaattaaaatttgatggatacactaaagtgtataattttacagatagagaagataaattacttccattagtatgtgaagaagataaattaattactgaaaatgttacacctaaccaacactttactcaacctccagcaagatatacagaggctagtttagtaaaaacactagaagaattaggaataggaagaccatctacttatgctccaactatagctactatacttaatagagaatatgttgaaaaaaacggatcaagcttgtgtccaactgaactaggaaaaatagttactaatatattagaagaaaatttccaaaagtttgttgatgtagattttactgcagatatggaaaatatgttagacgatgttgaagagggaaatatatattggaaagaagttgtagctgatgtatatgcacctttaaaagaagcaatagaagtagcaattgaaaatattgaaaaaataaatatggatgaagaaactgaagaaatctgtgaaacttgtggatctaatatggttataaaatatggtagatttggtaagttcatagcttgtaaaaactatcctgagtgtaaaacaactaaaccattagttaataaagttggagtgaaatgtccaaagtgcaataaaggagatataatacttagaaaatctaaaaaaggtaaggctttttacggatgttctaattatcctgaatgtgattttatatcatggaacaaaccaactggagagctatgcagtgaatgtaattcatatttaatagaaaaagtaactaaatcagagacaaaagtaatttgttctaataaagaatgcaaaaaagttaaaaatttagaaaataatgataaaagcagtgaaaatagcaaataatgtgttgaaaagcaattaatagtattgaaaaagattttaaattatgataagatgacaattgctaaagcaagaacgttatgcaatataaatgtattaagggttataaaagtagccaaacttcatgaggagatgattaatagatggcgagtcaaatgctagagaaaacaagaaaaataaataagacattacaaactagtggtggtagtagtgtatcttttagtttattagctgaagcattaggtgaagttttaaactctaatgcgtatgtagtaagtactaaagggaaaatattaggcgtatatcttaatgttgaaaaagatagttcagttatagaagatcaagaaacacataagaaaatgtttcctgaagcatatacaaagagcttactaaaagtagctgagacaaaagaaaacttaactggggatgaaatgattgaattattcccttatgaatcagaaagaaaggataaatacctaactatagttcctatattatctagtggacaaagattaggaacattactactttctagatatgatgaaaagtttacagatgatgacttagtaataggggaatatagtgctacagttataggtcttgaaatattaagatctatgggagaacaattagaagaagaaatgagaaaaacagctgtagttaaaatggccatagggacattatcttactctgaattagaagctgtagaacatatatttgaagaattaaacggaaaagaaggcttacttgttgctagtaaaatagctgatagagtaggtataacaagatctgtaatagtaaatgcattaagaaaattcgaaagtgctggagttatagaatcaagatcattaggtatgaaaggtacgcatataaaagtacttaatgataaattaatagaagagttagaaaaagtaaaatctaattaatgataaaaaataaggcatccataattatggatgccttattttttatcattataaattattttattaaaaagtattaaactgaatgcaattaagagacttagatatatatgtaatttaaaattatgttaaaataaagatagtgaataatactccgggttacgtaaatatgtaatagatcacattataggaggaatattatgaaaaattgggatatggatcaagttttaaataacataccttttcctatatggataaaagacttaggaaaaaatactaaatatacaaattatgagtttaataaattatataaaataaattttaaaaataaaaaagagaattgcaaaatgatttgtaataaatgctctagtcagaaattgtgttatgacacaatagatagggttatagaaaataaagatttatgttggtttgaaatttctataggcaataaaataactaaatgttacatgaaacccttttttgatgaaaatgaagaggtattaggaattatgggaatccttatagatataactaatataaaggacaagcaaaaatattatgaagaaagagaaaatgtgtttcgtacaataataaatactataccaggatttatattttacaagggtaacgtttttagtgataaaggaaatagtaaatcagatatagaaagtatgataggaaaaaatgattttgaaggtagtattctatccgaagatgaagaaataataaaaaataaaaaaattaaagtatatgaaagaagaataactgattctcatggaaatttaaaaatagaagaaattactaaaacttcagttacaaatgaagatggacaagttttgggaatcttaggactagcaagtgatattactgaaaaagtcgaacttaaagagaaacttagaaaaagtatatatatagataatttaacaggggtatataatagatcttattttgagaaaaaaaaggaagaactaaataatagtaaatatatgccgattggtattataatgggagatgtaaatggattaaaaatagtaaatgatacatttggttatttagaaggagataaatttttaatagaaatagcaaaaatgcttaaatctatagcaagcaaaaaggactttatatttagatggggtggggatgaatttgtaattcttattcccaattgtgatgaatctaaatgtgaaaaaataattaataatattactaacgaatgtaaaagaaatcaatttaatttaatcgaaatgagcatatcattgggtgcatctataaaaaactctttgaatgaggatatatatgaaaatttaaaagaagcagaagagaagttgcacagacaaaaatttttaaaagaaaaaagtatcagaagttctataatattttcattatgccaatctttacatgaaaaaaatgttgaaacacaagcgcacacccaaaggttagtcaaatactctattgaaataggaaagtatttagaatttacaactgctcaattagatgaacttgaattagttacgaaacttcacgatataggtaaaattggaattagtgaaactatattattaaagaaaggaaaacttagcgaagaagaatttaaagaaataaagactcatacagaaaaaggatatcgaatacttcaagcatcaaatgaattatctaatgtagctagaggggttttaactcatcatgaaagatatgatggaggagggtaccctttaggattaaagggtgaagaaatacctataatggctagaattgtaaatgtagtagactcatatgatgctatgataactgataggggatacaataaagtaaaaactaaagaggaagctatagaagaaattgaaaaatgtagagggaaacaatttgatccgaatatagcagatatatttataaatatattaaaaaaaggaagttaggatgaaaaatttaaatcaataggatatttacaattaaacgtcctagtgaggtgatatatgaaatataataaaaagatactatatttagttatatttatattttttgtgattatatgtttattaggtcatagagtagttgaccttagcaaccttgaatctagggaaagagatacaataaacaaagcaaaattacaaatacaaaaggggaattatgatttagcagaaaaaaatttagaatacattttaaatgataagcataaatttaaaactttaagtaaagatgataaattcgatgttttaaattacctaggagttataaatacacttcaaggagaaacagttagtgcattactaatgtatgaaaaagctgataaatatgtaagtaagataaataaatataaggtagagatgaatactgctattgcttataggcaaattggtgagtatttaaaaagtgcagaaatattagtgaaaataataacatcaaaagataaagctgatggagaaaatgcacatgtaaaaacatattcattgctaaatctagcagagatatatttacaaattggaaatactgaagaatacagttcaatacttgaaaaagcagaagattacatatataattcgtcaaaagagcatagagatgatttgttaattatatattattcagacttaattataagagatatatatagaaataatctggataaggtagattattattttaatgagataaataagttaaaaaataaaaataatgaagtatattatactgaaaataatatgtttaaaactagagcatatgctatgtattatgaaaaaattggtgaagtagaaaaagctataaaatgttttgataaacttgaagaatatgctcaaaaacaaggagatacatttattgctcaattttcaattagaaaaagaattgaaatatataaaaaacttggagataaagaaaaatataatgagttattacaagagttttataataaagatcaagagatactagatataaatgataaacagtatgactttcatttaaataataaaattttagaacaaagcaatatcggtgctatgaaaaaaacagtagtattatttatacttattgatttaattcttatagccgtagttatatttatatatgaaaagatgagaaagtcaaaaacagactctatgagagatgctttatgcaacacatacaatagaaggtatcttgaattatacaaaataaaagcgaggaagggtgattttcctctaactgttttaatgatagatgttgattactttaaattatataatgataattatgggcatcaaaaaggtgatgaagtattaaaatgtatatcaagagttctaaaaagtagctgtcgtagaaatgatattgtgtttaggtatggtggagaagaattttgtgttgtacttaaaaatactattaaggaagaagccattgctttagctcaaagaataaaagaaaatgtagcgaatgaaaaaattaaacatgaatattctaaagtagatgattatattactttaagtatggggattactacagtatattcaaaggaaaaccttagaaagtctatagctttagcagataaagcactttacatgtctaaagaaagtggacgaaataaatacacttatatataaaaagtataaaaacgtaacttaggttacgttctttttttttatttgtatatataatgagtacataagataaatacgaaaaactggaggaaatattatggaaaataaaatgttttgttttcaatgtcaagaaacagcaggttgcacaggatgtactaaatttggtgtttgcggaaagtcaccagatttagcaagaatgcaagaccttttaatatatacaacaaaaggattatcagaagttactacaatacttagaagcgaaggtaaaaaagtagatggacaagtaaatcacttaataactataaacttatttacaactataacaaatgctaactttgatgatgcaatattctatgaaagagtaaaacaaactctagcaactaaagaagagttattagctactttaaacaataaagaaaatttatcagaagctgcattatggaatgcattaagcaatgaagagatggatgctaaggtttctgtattagctaaattaaagaatgctatactaggaagcggagaagaaaaagtagcaatagatgctatattagatgaaaaatctactaaggttggagttttagcaactaaagatgaagatataagaagtttgagagaacttataatatatggattaaaaggtatgtcagcatacatgaaacatgctaatgcattaggatatgatagcgaagaaataaatgcatttatgcaaagtacattagctaaaacattagatgatactttaactgtaaatgagttaatagctttaactttagaaacaggtaaagttggagtagactctatggctttacttgatagtgcaaatacaggaacttatggacatccagaagtaactaaagttaatataggtgttagaaagaatccaggtatattagtatcaggacatgacttaaaagacttagagttattattaaaacaaactgaaggaactggagtagatgtatatactcactctgaaatgttaccagcacattactacccagcatttaaaaagtattctcactttgcaggaaactacggaaatgcttggtggaaacaaaaagaagagtttgaaagctttaatggtccaatattaatgactacaaactgtatagtacctccaacagatagctataaagatagactatatacaactggagctgctggatatgctggatgtactcatataacaggaaactcagaatctgataaggatttctcagttataatagagcaagctaaaaagtgtgaagctcctaaagaaatagaaactggagaaataataggtggatttgcacataatcaagtttttgcacttgcagacaaagttgttgaagcggttaaaactggagctataaagaaattcttcgttatggcaggatgtgacggaagagctaaatcaagaaattactatacagaatttgctaaagctctaccaaaagatacagtaatattaactgctggatgtgctaaatacaaatacaataaattaccattaggtgatataaacggaatacctagagttttagatgcaggtcaatgtaatgactcttactcattagcattaatagcattaaaacttaaagaagtatttgaattagaagatataaatgaattaccaatagcatttaatatagcttggtatgaacaaaaagctgtaatagtattattatcactattatacttaggcgttaaaaacattcatttaggacctacattaccagcattcttatctccaaatgttgctaaagttttagttgaaaactttggaattggtggaataactaatgttgaagacgatttaaaaatgttcttagagaactaaattaagatttaaaaaagagatatctaatcaaaagatatctcttttttattataaaaatataaaaagctttaaagtactttgttaatattgattttccatttgtaaattttcattattaagtatattagtaagtagtaataaatataatctagtatgaatcaatctacatatggaggtactttatgaaaattgttgctaaatctataaagtctaaaagagcgaatgtaagtaacataccaaatacatttgcatttacttttgttagaaattggttgtcagataagaatcatgcaaaagaaagagaacaatattttataggaaatctatcttcccaagaagttaatttaattatgagagagataaaatggttagctaaaacttataaaaatttagatattataactatagaagatagtaaaggaagtattacacaggtagtgttataatagctgttttaatgattatagtttagatattttatttaatggatagtaatggataagttgataaagatataataaaagaaggtatcttaaattaagataccttcttttattatatctttacactatagttcaaagctgaacatttatttcttacatatttactattaaatgtaagatatctcaacaaaacaaataaaataaaacaaagtcaggagtatgatatgtaatctatcacacaatgttcaaacataatgataaaaaataaggcatccataattatggatgccttattttttatcattaattccgaaaaatattaatatgtataagtatacacatatttaggagggattaaatgaataagtcaatggtggcaaaacatgctatttggcctaaagaagaagatataatatttaatttatcggaaagagcacaaattgatgaaagtatatatggaaaagaaaatgtaataaattctactataggagcgcttatagatgatgaaggaaaacttgtagcattaaaatctgtatatgatgaatataaaaaattagataatactttaattgcatcatatgcacagatagcgggacaaaaggattatattgaagctgtaaaaaaagcatgttttaaagattatataccaaaaggccatataaaagtagttgcttctccaggtggaacaggttcaataaaattggcaatatttaattatacaaatgaaaatgaaaaaatattagtacctaattggcattggggtccatataatattatttcagaagaaataaatagagatcttataaattatgatttattcaatgaaaaaggaaattttaatttcgattcatttaaagatcaattcttaaacatatcatataatcaggaaagagtttttactatatttaatacgccggcacataatcctacagggtatacaatagacgataaagaatgggacaaaatattagacctttgcaaaaaagtagcactagaagataaaaagaaaataatactatttgtagatatagcatacatagatttttcaggagaagatggtaaagatacaaggaagttttttgagaaattttcaaacttaccagaaaatatattagtaataataggatttagtatgtcaaaaggatatactgcttatggtatgagaagtggagcttgtatttgtgtatcatcagatgaagaaatagccgatgaattttattattcctgctcacattcagcaagagcaaattggtcaaattgcaatagaggggctatggaacttttaacatctataataaatgataaagaaaaattaaaaagatatgaagatgaaaaaaacaaatataaaaatttattaaaagaaagagctaaagtatttgtagacaaagctaaagagataaatcttgatatacttccatacagggatggtttttttataagtataccatgtgaaaattctatgaaagtatgcgaaaaagctatagaaagtaaactttatactataccacttaaaatgggaataagatttgcaatatgtgctgtaagtaaagagaaatgtgaaaaagcacctaaaataataaaagaagcaatagattttgtaaataaaaagaattaatttatataaaacttaaattaaaaatttaaatagatttaataaattacatatagggggataaatatgaaattattaatgactggtaatgaagctatagctcgaggagcttatgaagcaggagttaaatatgcatctgcatatccaggaactccaagtactgaaatattagaaaatatagctatgtataaagatagtatactcgctgaatgggctccaaatgaaaaggtagcacttgaagctagcataggtggttctatagcaggggctagaacacttgcttgcatgaagcatgttggagtaaatgtagcagcagatccattatttacatttgcatatacaggggttaatggaggaatgatattagtttcagcagatgaaccaggaatgcactcatctcagaatgaacaagataatagaaattatgctaagtttgctaaaataggattatttgagccatcaactagtcaagaagctaaagatatgataaaagaggcttataaagttagtgaaaaatatgacacaccgatattatatagagtaactactagattgtgtcattctaaaggaatagtcaactgtgttgatagagaagaaataaaaattaaaggttatgtaaaagatgtgaaaaaaagggttacagttcctgcacatgcaagaaatttaagaatagaagtagaaaagagattagataaattaaaagaatattcaaatactacagaacttaattttatggaaataaataataatgaaattgggataatatcaagtggtgtttgttatacatatgcaaaagaagtatttaaagataatgcatcttatttgaaacttggatttacaaatcctatgccagataaaaaaataaaagaatttgctaataaggtaaaaaagatttatgtaatagaagaaaatgataaattcatagaagatcaagtgaaatcaatgggaatagacgtaataggaaaagatatatttccatatacaggagagatgactccagatgtaataagaaaatctatttttaatgaaaataaagaaactataaaatataatgaagatttagttgtaggaagaccaccaacactatgttcaggatgtcctcatagaggatttttttatgagataggtaaaagaaaaaatgtgatgatatcaggagatataggatgttattcattagggtttgcatctccttataatgcattagattctatagtatgtatgggagctagtttaagtgtaggacatggagctcaacaagtatttaatatgaaggaaaataataatatgagagttgttggagttttgggggattcaacatttttccatacaggcataaattcacttatagatatagcttataataagagcaatactatatctgtaatattagataatagaataactggaatgacagggcatcaacaaaatccaggaacaggatatactttacagggtaaagaagttgaagagattgacatagaaaaattagttttagcttgtggaataaaaaatgttaaaactatagatccaaataatttagaacaagttaataaaactttagattgggcattagaacttgatgaaccttcagttattataactagatggccttgtgtacttaaaaaattatctataaaagacaaaaaagaatttgaaggagtatttaaagaaaaatgtgacgtagataaaaagttatgtataggatgtaagttgtgtataaaatcaggatgtccatctatatcttttgacaaagaaaataaaaaagcttttatagataaaactagttgtgtaggctgtgaagtttgctcacaaatatgtcctaagcaagctatatataagggggataaataaaatgacaaatagtatacttttagttggagttggagggcaaggaactatacttgctagtaagcttttgacaataggacttatggaagctggatatgatgttaaaatgagtgaaatacatggtatgagtcaaagaggtggttcagtatcttcccaagttagatatggaaataaagtttactctcctgttatagaaattggaggagctgatatattagtttcatttgaaaaaatggaagctttaagatggttaaagtatctaaaatcaggtggaaaattaatagttaacgattataaaataaattctatgccaataattacaggaaaagctaattatttagaagatgaaataaatgaagagttaaaaagagttggtgcaagattagtagatgcatcaaatgatgcaataaagctaggtaatcctaaaactatgaatataatattgcttggaagtttagttaagtctatgaatcttgaaaatattgactggaacaaaattataagtgataatgtaaaaaaggagtttatagacataaatataaaagcatttgaggtgggaatgaatttagtaaaaggggagtagcttatggggtataaaatattagcaataaatccaggttcaacatctactaaaattgcagtatatgaaaatgagagaatgattttttcgaaaagtataaaccatagtgcaagtgagttagaaatttataaaaatataacagatcaatttgaaatgagaaaagaaaaaattttaaatgctctttgggaaaatgattttaatatatgcgatttagatgccatagtaggtagaggaggaatattacctccagttaaatcaggagcttatttaattaatgaggttatggtagatagattaaaaaatagagcaattgttgaacatgcatctaatttgggagcacttatagcttatgaaatatcaaaagaattaaatataaatgcatatatatatgatagtgtttcagttgatgaactaactgatgtggctagagtattaggatttccagaaatagaaagaacatgtttaagtcatgcacttaattcacgagctatggctattaaatttgcaaaagataataaaaaagattacaaagatatgaatttaatagttgcgcatttaggtggaggaataacaattgctgcacatgaaaaaggaaaaatggtagatgtagtttcagatgatgaaggtccattttctcctgagagaagtggtaaaatacccgtaaaaaaagttgttgatatgtgttatagcaaaaaatatacacacaaagaaatgttaaaaaaaatcaggggaaaaggtggtatagtaggtcacctaaatactgtagatattagagaagtagaaaatatgattgaaaataatgatgaaaaagcaaaattagtatataatgcacttatttatcaaattgctaaagggataggagaattagctacggttttagaaggtaatgtagatgctataattttgacagggggaatagcatattctaaaaagttgactaaagaattagctaataaagttaagtttatagctcctgtaaatatacttgcaggggaaaatgagttagaagcacttgcttatggagcgcttagaatattaagaggggaagaaaattacagacaatatgaagaaaaagaattattagaaagttatagtgtaaattaattttaaaaaggtatcttaaatatattaacagataggaaaataatatctgatagtatgattttaagataccttttttgtagatgtataagtttctatttgcttacaaaagtttcacaagaagcatcattcatatttatatgaatagattcagctttacaagcaccactataattatgtttacaattagttgctgcacatgatatagaatttgtttgtgcaatagtagattctgtggcattattagtaaatgaactatattctccttcttggtaagttgagcaagttgtttcgctagtagtattagctttacttccatcaacttttattccagatgcataacatccgccacttctgttataagtacaagttgtagctgaacaagttatagggtttgacatattaaatacctccaaaataataaattcatagtcattaatgactatgaatttattatttgattatttgaaaaaaatattagtaatatataaaatttaattatttaaacaattttcacaaagtatattaacatcatcatatgtttctcttcctaaatatttatttatatgataaacgtttaggttttcgctacatccacattttgaacactgattattataatgatttaaagccttttctttgaaaatttgccagtgtaaagattttaagtaagaattatagtcaactctaagattagattctaaaaatttaatataaatagcatctaaatctgaagtattaaaatttgtattttcagggtcaaagttttcacacaaatctgcatttaaaggtatatcatctgaaattatacatttaatattatatgtgaaatctttattaggaccttctagagaaagatgcttgcaatatgaacaacattttttcggtagtttttcttctaaattttttatcttagtattcataaatataccctccaatattggttatttgtacaagtatattaataaaatttaataattatgataaaaacttatttcaattaatttatttcaaaggaatatttaatatcaaaactgaataattaataaattagtaaaataaagttaaaattaattaatttaaaaaatatttatttggagaggattatgaagtctattgattattacaattttttatcttttcattaagaacacttaattctgaatattttttatttattacactctttattgtatttatatattcaacagttttatttatcttattatctacatcttcaatttcttcattagatttagtcaatgaattttctaaattctcttttttaactttaacatctttaatttggtttagtaataaattattatgatctattgactcattaacttgcttatctaaatcttctatttcttttatatagctattcacttcaagagtctttaatttatcttttatctctaaatatttaacagcttttttttgctgaatctctagaggttttaattgattttctatttcaatatatatatcttcaattctatttaaattttcttttgtgttttttaaatttctctctgcttcttgttttttatatctatatttagaaattccacaagcctcatcaaatacttttcttctatttacaggattattactaagtatttcatccactttaccttgttctattatagaatatccatctttacctattcctgtatctagtaaaagttcttttatatcttttaatctacatgctttattatttaagaaaaactcactttctccacttctataagctcttctttttatagttatttcactatattctaattctaactttttatcgctattatctatagttaatgcaacttcacaataattcatagctttttttgtatctgttcctgcaaaaactacatcttctaatttatcccctcttaaactttttatactttgttcccctaatacccatcttacagcatctgatatattacttttaccactcccatttggtccaactatagcagttataccttcattaaaaagtacatcggtcttagtcggaaaagatttaaatcctttaagttctaatctttttaaatacaatatctgtctctcccttcaataataaaactaaaggttatatatttgttttaaaacattatatatctcattaatattaatctctatgagttttttatcatctataataaaacctaatttgtctatatccaaatcatcttccttagttttcaatgaaattccatatttttcttttaattctttaacattagattttttatttcctaatattctagatacatttttcttattaactaacacgttaatattttctttaacctcatatttatttattaaatattcaatgtaatctccatacattttgctttcaactaactctctatacgctggatgataaggcccagctaatacttctttacctatagctatatcttctgtagcttgtaatccaactcttatgacatttatattatttgtgtaaaatagtactagtacttttttgacaatttctatactttcgtctagcgtaaatggtgtatatttattttcaactaataatttttcaagtcctgtttctttaactactaatgtagggtatacccttacacaatctggatttaattttataaattctttagctgtatatatacatttttcttcagtatcagatggcagtcctatcatcatttgaagaccaagctttattccgtatttttttataaggttagcactttcaaatacatctttatcactatgacctcttacactatcaattaaaactctatcatctaatgactgtaccccaagttctattatactaactttatattcttttaacatagttagtatttcatcatttatacaatctggtcttgtagacattcttatatcacttactatatttttatctacatattcttttgctacagaaagtaaatttctttgtatatccatatctatagctgtaaaactacctccaaaaaatgctatttcaatacttgcatctttatctatagtagttaaatattcttcaattattcttctaacatcatcactagtaatatctgtacttactcccgttatctttttttgattacaaaatatacaatcatgtggacaacctctatgtggaacaaatataggtattattctttttttcatattacatcatccttcttaatgcttgttttgcagctgattgttctgcttcttttttactttttccttctccacgtcctaatacttcatcatttaacttaacttgcattacaaatcttttgttatgatctggtccaatttcttctactaaattataagttatgttgctatctccttgactttgtacaacttcttgtaaatgagtcttatagtctctgaagattcttccttttatagagtcttgtattatttctttcatatgatctaaaacaaatactttagcttcttctattccaccatctaagtatatagctgctataacagcttcaaaagcatctgctaatatagatgcacgttctcttcctcctgtggcttcttctcctctacctaaaagaatatgtctacctaagtttatctccttagctacatcacttaaagactcttcacaaactatattggctcttaattttgttaactccccttctggaagttttgtctcatttttaaacaagtaatcacttattactattcctaatacagaatcacctaaaaactctaatctctcattaaacgagtatgctttattttcattagagtatgaactatgtgttaaagcttctaatatatactctttatttttgaatttatattttataatatcttcaaaattagatatattacttaatatgcttgattttattttcatttaactacctccagcttaaatctctctagactatagtgtactatttttctaaaattattgcaaaacataaaatataaaagcccatgaaacttatttgatttcataggctttataaattattacactataaaattttacttttcatcataacaatcacagtcagaatctaattcatcagctgataaaattattgattggcaattagggcatacaatatcaacaccttcatcatataataaatcttcatctatttctacaaaatcattgcaacttgggcattccatttctatataattgaattcatcatcgtcgtcatcgtcttcagcttcttcatatatgtcatcttctatatctgctaagtcttcatctatagattcaacatactcaataagttctatttgttcttcttctaattctactatagcatctgcgaaactttctaaaacatctacaattttatgtattatttttccttcttttgtatcttcgcttatgtctagaccttcagcaagaccttttaagtatgcaacttcttcatataaatatttcattggtacccctcactttcataattttgtttatataaatttaaaagcccatatatctattattagatatataagcttttatatacatgttattattaaactcttgataaatattctccagttcttgtatctatctttattctatctcctatatttatgaataaaggtacttgaactactgcaccagtttcaactgtagctgatttagtaacgttacttgcagtatctccttttattcctggttctgtttcaactatttcaagttctgcaaagtttggagcttcaacttggaatggttgtccttggtagaatcttattgttgcagtttcattttcttttaagaatttgattgcatcttcaaccttttcataatctagtggtatttgttcaaatgtttcgttatccatgaagtagtataactctccatcattgtataaatattgcatttgtctagtatctatatgagctttaggaaacttatcacttgggttgaaagcttcttctcttatagctcctgtttttaagtttttgtacttagttctaacaaatgctgcacctttacctggcttaacatgttggaagtcaactattaaacatggttgtccatccttctcaaatgttacaccttttctaaaatcacctgctgttaccatatttgtccctccataattttacgatttttaaaattctaattctattaattcctttggtgatgaattgattacttcacatccatcttctgttattataagtaaatcttcaattcttacaccaccaaaatcttctatgtatatacctggctcatcacttattaccatattaggctttaatatcttttctcctaatgtattaacatttggaagttcatgtacatcaaggcctattccgtgtcctaagccatgaccaaatttatcaccatatcctttttcaattatatattgtcttgcgatattgtcaagttctattccactcatattagctttagcgtgttctatgactttaagttgtgcctctaatactatattgtatatttctttttgcttatcacttgcttttcctacaactatagttctagtcatatctgaacaatatccattatatacacatccaaaatctattgtaacaaaatcgcctatttctattactttgtcactagcaactccatgaggcatagatgatcttttccctgaagctactataaaatcaaatgatactcctgtagctccttgctttctcataaagaattctaattctaaagctacttcactttccttcattcctggttttatgaagtttattatatgcataaatccattatccgcaatttttgaagcttgtcttataatttctaattctttttcatctttaatagctcttagatttaacattaatccatttaatggaaccatttctgtatcatataaatttttattatagtttgaatatgtagcaaaactcatcttatcatcttcaaaccctaatctttttatattcattttcttcaagaaattagttatagggtttgttctagatatttcaactatatcaaaattattagtttgatttttagcttgttgtgtatatctaaaatctgtaaataatatatttttttctttagttattattatagacccagctgtacctgtaaatccagatatatatcttttatttttagaatcttcaattaaaactgcgtctaggtttaatctcaccatttcttctcttaattttaaaactcttttttccacttactccacctcataattaattattgaatttatccctaaaatgtaactataaaatccaaaacctgaaatttgacctatacatgcacttgcagtaacactttttgtcctaaattcttctctattatgaatattagaaatatgcacttctacaacctttgtacttatagatcttatagcatctgctatagcatagctatagtgagtaaatgctccaggatttaaaacaattccgtcaaatttacaattagcttcatgtaatttgtctattataaagccttcatgattactttgaaaaaattcaaattcaatagtatctttaaatgtttttcttatactacattctaaatcctctagagtattttttccatatacattaggttctcttttccctaacatatttaggtttggtccatttattattaatatctttataacattcacctaacctttttcataaaacttatttacattaatataataacatattttgttaaatataaacaagtatatcacttaccacttggtctacatttttattattgacatttactcttatattggcagattctttgtatttatcatatcgtttatttaaaagattttttatagataattttaaattatcatcttcttttaattttggtcttttctctatttcatttttaaaaataattatctttttcattttataactccttgtgtaaaattatttttaaaaactaaagttattattctcatatacttattaaatctattcacttttaactatttaaatttgtatattattacaatatgtataaagataattttcttcaagttttaatatttattgctttaataaaaaagtacccattttaatgagtactttatacttatataaattctacactatttacctgctatagataatccttctactataactgatggcgaacccacactacttattggaaaacttagatcatttcctataaatttaatgttttttaataaatcaaaaaagtttcctgcaacagttatttgttctaccggatattcttttttcccgtcttttatataaaaccctttagctgctaaagaaaaatcacctgttatagagtttgctccagagtgaagtcctgcaaaatctgttaccataattccttctttaacctctttcataagctcttttatactagcttctcccttttctatataaaagttcgtaggctctacacttaccggagaagaatacgatgctttaaatccatttcctgtagtttttacattagctttatgagctgtttttaagttgtgtaatagggtatttaagactccatttgatactatatcttttttaaatgttgcaactccttcatcatcaaaaggcgttgatgctaaacctttatctaacagagggtcatccactattgaaacaatattagatgctataacctcaccttcttttcctttcaataaagataatcctctttgagcagcctcaccactaaatatatctgcaaaagtttcaagtaaagaagccatagcttcattgtatattatagttttgtaattacctgaagaaatagtacttccacctaatttagataaagcttcttttacaccttgctttgctatttctttagtatctatttcttctaaagaatcagctatcttatatcccattccatcttgcttttcgttattatcttcaactataggaataacatatgctataattaaattccccttattacttaactctaaacctttagtattatatattccatttttagaagaactataagatactttacaactacttatattaactactttatcactatattctttagtttgtttttctaaatctaatacaatttctattaatttcgccgcatctatgttttctagtttttctgaataagtttgaactttactataatttttgtcaccttcatatataaactgttcatcagtactctctatgcatttagatgcttcctttgcattttttataagcatatctatagccttatcatctaaaatttcagtatatgaatatcccatcttaccatttagcattcctctaaatgacaatccaaaagatttatctaaattatacttttctacttcaccttcataaactgttatacttatatcttcaccatcagtgtaataaatttcacagtcttcaaaaccttcatttaaagctttctcaaacagtatatttttaaattctttaaagtccataactattcctccgatcttccacctacagtaatttctttaactcttatcataggttgccctacgtttgttggtatacttcctgatgatgaaccacacataccttgagcttgagctaaattatttccaaccatatctatattcataagtacatcgctacctttacctattaaactagcacctcttacaggttcttgtatctgaccattttttacaatatatccttctgctactgcaaagttaaactctccagtaactggatttacagatcctccgcccatttttttagcatatagaccattatctattgactttattatatcttctggattgtcatctcctggtgctatgtacgtgttagtcattcttgatgttggagcatatttataactttgtctacgagaacttcctgttggttccatattcattcgtcttccatttaatttatctatcatatatgattttaaaattccattttctattaatacatttttctttgtaaagttaccttcatcatctatattgctagatccccaatgattagctagtgttccatcatctattgctgttacttttgttgaagcaatttgttctcctagttttcctgaaaatactgaatttcctttagctactgatgttgcttctagtgaatgtccacaagcttcatgaaatataactcctccaaatccattgtctattgcaacagtcattttacctgcaggacaatttcttgcatgtagcatagtatgagctgttcttgcagcttcttttccatagaaaattgggtctatttcttcaaacatttcaaatccttttgctctgcctggcccttcaaatcctgtttgattttcatttcccttagaagctacagcacttatcccaagtcttgttcttattctttcatcttctatatataaaccttcactatttgcaactaatattttttgtgctttatctaagtaagttacatttacttgtgatatatctttactataatcttttgcacttttatacgcttctttcattacttttatttttttttcatagtctatagcatttggatataattttatgttgtgcatattctcatagttaacactattatttataactatcgatttctcttcttttaaactacctagtgccaatgctgctttataagctgtatctaaaagagatgataaagagttatcattagtataagcataaacacttttgaaatttttaaatattcttatgcctataccataacttcttccacctagtgcattttcaactttactatctattaatcctatagaattacttattgtatcctcttcaaatatttctgcaaaatctccaccagttatcaaacactttgataaaaccttagaagctatttctcttgaaatcatattattcctcctattttttcactattactttaattgtatcataaaaaaagttactggcatttataaccaataactttttttatcaaatccagcttcttctgcactcataactttattacttgtgcaaagtggacaagctattctttcttcataacctgttactttatatatagttccacaagttgcacacctaaatgtaaagtataaattattatctatttgttcttcttctaatataatctttattacattatcttttcctatactttttgctattttagttcttgcactatttaatgtttcattaaattcttccgctgacattttcatttttttagcacaagtttttatttttattttttctatatccactaattttatagcttctatctcttcttttttaagtttcaattctatttgttttgtattttcattcatatcgtcatcccctatattaaaactaatttagtggcatatagctatacattataatatgtttattttagtatatagtgattatttatgttatagatacatctttaaagtattaataaaaataattattttaagaacttttttaatttctgtaacatttcaagcttttaactatactttaattattaactttaagtttttaaacttactaaggaggcgatagtcatgtacatcaatcaaataatagccatatctatatttttactggttatgatagctattatatctgaaaaagtaaacagagctgttgctgctgtggcaggtgctttgcttatgttaatatttaatatcgtatcatttgaaaacggacttaaacatattgatttcaatactattggtgttttaataggcatgatgctttttgtatcagttgtaaaaaactccggattatttgagtatatagcaatcttttcatcaaaaaaatcaaaaggtgatccatggaaaataatgctttgttttatggtattaacagcaattttatctgctattttagacaacgtaactactgttttgttaatcggcccaatgactatagttataactcaaatattaaaaataaaccctactccatttttaattactcaaatattagcttctaacataggtggtacatcaactttaataggtgatccaccaaatataatgataggtagcgctgctaatttaagttttatggattttgtagttaatcttggccctatagttataatattactatttgctactattatctgttttaagtttgtatttaaaaaacacttagttgtagaggctatatataaagaagaaatattatctctagatgaaaataaagcaataaaagataaatccttgcttattaaaagcataattatgatgatatttattttgcttggatttgctcttcacaacataattcacattgaatcaagtgtagttgcactaacaggtgctactataatgatttttataggtaaacaagatgtagatgaaattctttcaagtattgaatggtctacaatagcattctttggaggtttgtttattgtggttggtggtcttgtagaggtaggtattataaactttatagctgaatacttaataaatgctacaaagggtcacttaataattactatgttagtaatcctttggttatcagctataatatcatctttcctggacaatataccatttgtcgctacattgataccactaattttaaccatgcaatctcaaggtgttgatgtaactccaatttggtgggctacatctttaggtgcttgcttaggaggaaatggtacattaataggtgcttctgctaatattgttttatctaatattggtcaaaaaaatggatatccaataacatttaaagagtactttaaaataggttttccgcttatgattttatcaataattatttcaactatttatctagtaattcgtttctagtaaaaaattttaggaggtttataaatgagcattttaaacaacgcttatggagacactatagaagctcgacttagatacatcggtgctactgaaataagaaaagttcatggaattttatattttattgagtttgaaattgataataacttaaaagtttcctatacttataacataaatgctaaaaataaatattttttacaaagaatcaaaccgtatcctataccggaaggagtatttgaaaaagaatatgaagttgtttcatttatagaaaaagatataaaaaaatttaccaatgctaaaaaaagtaataactttgatctattcttaaaaatcaacaatgaactaaatactatctgtctggacatcgagaaactatttttaaattacaacatagataaaatggatttagaaaaattaaaagctgaactagatgatatactaaatctatttgaaaattctaaaaaaagatcacccaaaatcaatatggataataaataaggagatagattacctatctcctttaaatgattttaattagatacatttttcaaatttacttttttatatctattaataacaaaactaattgatgctgatataaccattcttgttggagtgaataaaattaacgatattactatagattttaataaatatataaaactaaaatttctttccatacttaataataatatatcaaaaaacatagtaactattataatgttcatatacatatatgtattttctagctgttctttttttgtcttaattacgagtacaggggtagccgactaaacacttgggttaaagtcccaactgcatatattggtgtctagtaccactaagaagggcagagagtagtaatatcgcactacaacaaaaaagaggatagggtggcaacactttgtggagatactcaacataccgtccattgtctggggtgttgatggatgctttaaatagcaacggtgagtattttaaactgtactagtccgaacgttccatggtcgtatacatggcggggctctaggaaattctagtaggcataaggaagtttctctacactagtatgtagggaaactctgtccattttaacaaagataggaaattctatactttggatttcgatatttcaaggtttttatagggtgaatttggtttagcgaagcgataaccaaagagggagcgaagctcccttatataaacctcgtagagcgagtaaactcttttttaagagtataacgagctatactcttattacttatgatatacttaacataacttttgacgtcaaaatgactccaattttcataagaagttatgttaagaaaacaagagtattaagaggtgattttaaaatggaatttgcatggaatgctcaaaaaaataaaatgagtgatgtaaaaggcaaagagctggagcaagaaagaaaaggaaagatttctaatgcagaaattaatttagataaaacatataaaaattatgatttagttaaaagcaatcttaatttatatcagagaataaaagaaagagttaaagatgttagacaaaattctagaattcaaaaaaattcagtagtttcgtattctaatatcattacagtaaacaaagaaacctttaaaaaatggggcgaggacaaatcaaagaaatatttagaggaagtatataattatttttgcaatgagtttggaaaagagaatgttgtttctgcaaaagttcatttagacgaaactacacctcatatgcatttacattttgttcctataagctctgagggcaaattacaggctcgtaaagtaatgaccccaggaagaattaataaagtgcattcagaggctgtaaaatggcttcaggagcgtaattttgatgttgttagaggtaaaggtgcaacaggaagaaaaaatattaaggatatacataaatataaatctcaaaagctaaaagaagatatagaagatttagagaaaaaaaagatggtattactctcatatattgaaaaaattttaaaggaaaattcacttgaagttcctaaagaaaaagaaatattagatgacatatcttttaaatttaaagaatcattattttcaaaagataaattgatgataggaagatccgacttagatgacattgtaaattcatacaaagatttagtaaatgaaaatttaaatttgaaaatgcaaaagcttgatttagagatgaaaaataatgaattaagttttgaaataaaatcgttaaaagacaaggaagaagatttaataaaagatagaaaatatatgcttaataagagagataagctagatatgaaagaagaaaaacttattttcagagaaagtttaattgataagagagaaaaagctattggcgaagaattaaaacaaaaagatttagaaatagagagagaaaaaaataaaactttatattataaagaccaaataaaatataaagataaatatatagattatttaaaggattcatctagagcagatggatttgtaataaaacatttttcaaatgaacacggaaatgatgctattaagtgttttaaaatggattataaattagaagatatgtgtttagtagttatttcgagtaatattaagaatgtaaaagaaaacaatgtttataagctaaataatgctattgatatgattgattctatagcagcattaaattgtaaagataaatataatctaagctatgaaatatatacaaataaatcttgtaaaattagaattcactcaggaaaaacagattttaaaaataaagattttaaaaatcatttgatagaagaaaaaaatgatttgaatgagtttttatacaaaaaaatatttataaatgctttaaaagatagtgttgaaatgaaaaatagagaaaaagaaattagtaaaaagagaacttttaaatcaagagataatgaattgagtttataagagcacaaaattaaataatggtataatacgttaataaaatatatagaggtgaagagatatgaatgctaaagagcaggtaaacaacgctaagaagtttattgagttttggagagataaagggtatgaaaaaggagagagtcagaagttttggatgtcattacttcaagatgtattaggagttgatgatgttactaattacataaattttgaagacaaggttgtaatagataagacaagttttattgatgcatttatcccaagtacaaaagtattaatagagcaaaagagtataaacaaagatttaaggaaggggataaagcagtcagatggttctttccttacaccattccagcaggcaaaaagatattctgcagaacttccttattcatctagacctagatggataattacttgtaatttcaaagaatttttaatctatgatatggagaaaccaaggagtgagcctgagtctatacttcttgaaaatttacataaagagtattacagattagagtttatagttaataatgagaatgaaatattaaaaaaagaaatggaagtatcaataaaggctggagaagttgtaggtcttttatatgatgctttgataaagcagtataagaacccagataatataagatcacttgaaagcttgaatatgttatgtgtccgtatagtcttttgtctatatgcagaagatgcaggcatatttggaaaacacggaaaatttcatgattatttaaaaaatttaaatgtgagggatgtaagaagagggcttattgacttattcaagactctagatacaaaagttgaagatagagatccatatatggatgaagagctggcatcatttccatatgtaaatgggggactatttgaagatgagaatatagaaataccaaactttacagaagaaatagtaaacttaatacttcataatgcaagtgaagactttaactggagagaaataagtccaactatatttggtgcagtttttgaaagtacattaaatcccaatactcgtagaagtggtggaatgcattatacttcgattgaaaatatacataaagtaattgacccattgtttttaaatgatttagagagagaattagaagaaaaaaaggctttgaaagttgaaaaagtaaggaaagaagcgttacttcagtatcaaaaaaaattatctgaattaatatttttagaccctgcttgtggttctggaaatttcttaacagaaacgtatttatctttaagaaggcttgaaaataaaactctagaggctatatatgatgatagacaaatattcttagatgatgagttagtaacaggagaaagcgtaataaaagtttctatcaatcagttttatggaattgaaattaatgactttgcagtaacagttgcaaaaacagcaatgtggattgcagaatcacagatgatgaaagaaacagaagaaatagttcataaaaacttagattatttacctttgaaatcttatgtaaatatagttgaagagaattctcttagagttgattgggagagtattgtatctaaatataaattaaactatataattgggaatcctccatttttaggagctaggtacatgaataaatgccaaaaagatgatatgttagaggtatttggtaaaataaaaaaacttggtgatttagattatgtaagtgcttggtataaaaaggcttatgactatatcaaaggtactagaataaaggtcgtttttgtttcaactaacagtataactcaaggtgaacaagtagctgttttatggaaatcattagaaaatttgaaaattcattttgcttataaaacttttaagtgggatagtgaagctagtgaaaaagcaaatgtacattgtgtaataatttgctttgcagtatttgacattaaagagaaaatattattttatgatgatacattcaagaaggtaaaaaatataaatccttatttacttgatgcaaaggatgtatatattgaaagtagaaataacccaatatgtaatgtaccaaaaatggacagtggaagtatgccaaatgatggaggttttttaagtaaattttcagaagcagatattaatgaaataattaataaatatcctcaaagtaaagatttatttagaagattttatggagcagaagagtttataaagaataaaaaaaggtattgtttgtggttaaaaggagtatctccttctattataaataaaattccacctgtggtggaggctatcagaaatacaaaagagaaaagacttgagagttcaagagaagcgactagaaaattagcagatactccatatctttttgcagaaataagacaacctgatacagattatttattagtaccaacggtttcatcaggaaatcgtaaatatattccaattggttttatgagtaaagaggatatagcatatagtattgtatcaatagtaccaaatgctacattatatcattttggagtacttacttcaaatgtacatatggcttggatgagagcttttgcgggtaggattaaaagtgattatagatactcaattaaggtagtatataataactttccttggtgtaatccttcaaaagaagataaagaattagtagagaaaacagcacaaatgataatagatgcaagaaatatgtatccagaatgttcatttgcagaattatacaatgaacttacaatgccaaaagagttaatgaaggcacatagagagaatgataaggcagtaatgaaagcttatggattttcagtaaagaacatgacagaatctgaatgtgttacagaattagttaagatgtatgaaaaacttataaggtagggagcatcttaagagtagaggtatcaaaatgaagttatgttttaaattatggtaggatagagattttaaaataaatctataaaaaattctaaatttatgaaaaaaaatacataatttcacaaataactattgttatattctaaatgaaactataaaatatatttatagataaaattaaaaaaaaagacccatttgcactctttaaagcctgagaaactttaaagacgttgtacctaactgtttgcccagtatcggtaatccaaataagtctttctaaaaactatatctagtttttatatataaactgtaaaccaatgagcagttaaatactactcaaacggctaatcagttaatatcttaagatataaatcattatattatatcttaagaataatctcaataacttatactagataataaaaaaattttagaaattcatttgaaattacggctacttctaacagttagaagtagcttttttaattttatataaagaaatattaaaaactgaatagatagggttttataagggagagtgtttgacctagagcaaaccgaatggctttataatctattatttcatattttgctatatacatagctattattataaatataataactataaaactcccaatacctttattaatattatttatttttttaaaataagtttcatttgtgtaataccctataagaaaaaatggtaaaaatactatagtcctagatagtgataaaaaatcttcgcccatcttatctaatcctatcaataatcctaatataaaactaataggaattataaattttatatttgttatatatttaagtgatagcctccaaaaaaacaagctaattagataccataaagtccatcctggatatactatagaaaacatatttattcctgtagctaaatatactccaatataccaaagtgtattaaaaaatatataaggtattaaaagttttctaactatatcttcattagattttgtactttttttagataagtacccagatataaatacaaatagtggcatatgaaatatataaatatatatatatgcacctcttaatatgtaattttgatttatgtagtattctattgtatgcccaaatacaactgcaaatatcaagataacttttaaattgtctacaagatagtttctattttgtatatttttatattctttcaattttattgccccttttctctagtttaaaaagtctaaaattatcttcgactctttactctcattccctcttattatatttaaaatattactatgatacatattatctaatagaactaatctagttaattttgaattattaattttttctatgaaactaatagaacacttagggtttattagggtatcttgttttccatgtatgcaaagtacaggtatttgttcatcgcctttaatcaaattaattggattctttaaattaaaatctttattatttatataattttttataattgccttagcatatctttgagtacatttactaaaatctaatacccctgatatagatacaaactttttaaatatatttctatctatattatattttttatgaaaacatctattaaacactagattagctgcaagctctcctcctgctgaaaatccaacaacatatatcttatctctatttcctttaacatatttattgcttaggaaatgcttaaaccctttaaatatatcctctatttgtgatgggtatgtaaaatatggaacaagcctatatgaaattaaaactacattatatccctttttataaaaaaattttccaacataagaataccttctagggctaccatgccaccaactaccaccatgtacaaaaaatattataggattattttccttataattaaaaaccctataatattgtcttttatggtttccatattttatatcttcactaaatatatctctatcctttagatttgcttttacagtattgtatattaaaggaaatttaaataaattttcttttattcgatacatattcatagtttgtttatctcctaattaatttatattaagaaatgtctcaaatatttgagacatttctatatttatttattcatatatgtcactacatccaaagattgtataatttcaatattaggtatatctccaattacatatatagtgtatatttttttatcttttaattgtatctttttatttactcttaatttatttctattttcataaatccccatatcactttcttctatattaaaatcatatataccacttggaacttgtgcataattagttctcttcccaaaaggtatttcatctatcatcttaacattatttactgttaaatctatcggttctgcagttggtgataaatgtgctatcctaaactttgattcttcattatctatgctttcatttggatcttcaaaaactgcaagcatcatcaaattaggaaatatccctgttataactaaagtccctacatttcctcctgctataactaaatcttgttctagtattagcttatcttgatttccatattcataaacctttacagtgtaatctccaggtaatgtaggcgtatatggagtaaactccttataaccaacatttgaaaatactgatatatcattcatagatatatctatcttattactatttggtgtagcatttaaaattcttatatatgatgattcattattaatccttactttcatatatatctcccctttataataaaaacataatttattatatgtatttattatattatctgctactataacacttagtaaatatattacctgggtaataaaaccattggtatcactatatctaagctatttttctctttcttttatcatatagtgatattttttaacacttatacgtgtcatttaatgtgtttttttattttaaaataaaaaacttctataaatgtatcatctatagaagcttcaaattcttatttaatttatttgctaatttgcatttttatttattgatattactctactctttttgttattatctttatttttaactttgggtgattttctatttttaaatttttcaattaaattttctatcattcggactatattatatttatatgctagctcaaatttactacagtatttccctttgaagaatatttcatctggtataccatttttatatatgtcgcacaaaggcttaccatcttttagctggacaaggtttttactttttaaagtatacttgcatttgtgacatcttctaactctaaagtttcccatattcttccccccatgaaaatataatttataaattcactctataaatatatattaccataaaaaaatactttttagtacaatctttgatattttaatatcaaagattaaatttttactatattttgctacttgccatagttttagatactatataatcaagccattttatagtatcctgcataacttcttctttatttatttcatttagcatttcatgtcttcctccgctatataacttaaacttaatatcttttattcccacttttttgtaattttcatataacttaattatccctttcccaaattttccaaccggatctttatctcctgcaaatatatatatgggtaaattcttatcaactttatctatattatttatatctttaatttctttaaataatctaaacaaatcataaaaatatccattgctaaaaactactccacaatttttattatctatgtacttatctacttccttttcatctctacttaaccaatcaaactcagttttatttggtttaaaatgtttgttaaatcttccaaaagctagcttatctatcaaatatgccttattatctcttccttttacgcttgttaatatttttgataaaatcaatcctatatcaacttctattccatgtaacccattagttcctgaaagtataactccatctatttctctgctataattcataatatatttttgagctgcaaatgaacccatactatgactaaataaaaatataggtaaattatcattttctttcttaattatatttgttaatttatataaatctttaactacacagttaagtccatctttatctgctaattttcctatatcattaattgactttacacttttaccatgacctctatgatcatttacatatactatatatccatttttatttaaaaaactagcaaacctttcatatcttttagcttcttctgacattccatgtgaaatttgaacaatgccctttatattttctttaattttaggctcatatttatatacatatatgtctaaatcctcttcccctttaaatgtaaaattactctttaacataaactcctccattaattctttatataattcctaatattatacattaattataagattattatatcatatatcaatggattatgttagttttctaagtattaaagtttaaaacaaaagactacataaaatatttgctaagtaaaatcaattagcaaaatcttatatagtctttttaaaattatatatccattttcccttcgtatttaccgcttccatttgctatatggctttttctattcatggtttttttactatatttagcttctccttgagatgctatctttgcatttacttctgtattttcatatccatgtatacctaattcagtagctatttcttctttattgtcattataaatttcaacttttcttaaattttgttttttcttattagtcattattcatcttcctttctaaaatgtacttatttttattatgcttaatttatcaaattaaattctaataaatcatgtacaaaaaataccatgtaatttatatattctaaattaagctttctttagtaactataagtaaaaatgttaaattgtatttgtataaaaattagatttcaaataaaaaaagtatagatataaatatatctatacttttattttaaatctatctttaatatattttctaaagccttcgctactccattttcagtatttttatcagttataaagttagaattttccttaactatatcttcagcatttcccattgcaacccccataccagcatacattatcatagataagtcattatgattgtctccaaaagttataacttcacttttgtctactcctaggtatttagctaaactttctactgcacttcctttattaactccttttttcataatctctatattatcaaaaaaagatttagttaattctatatctttaatatttttcaattcattttcaactttagaaagtaaacttaaatcactttctattattaaaaattttaaaatatctctttcttttataagttcttttatattatcactttctattatttttatatttaaatcttcttgcatttgatactttctaagccactcatttatataagtagtaaatatagtatcatctgtaaaacattgataatatatattatgcttttctaatatatctataatgttatcacataaatcatactctattttgcttacataaattacattaccattttcttcttttattaaggctccattgcaacatattataggggttttaatatctaattctcttgcatattttatagtcgattcatatatcctacctgttgctatagccacctttatacctttgtcagctacttttttcaatgcatttttattttcatcgcttatttcatgttctccattaagtaaagttccatccatatctgttactattaatttataagtcatacttcctccttaagccgtaattttttatttttttacatattctacatttacccaataaatcctttatattctcataatttctatataaattaatagtataaatatataattaaactgcagctcttatagtttctaaagtatttaattctattatggttctcattttttctctatgttctaaaaacttattatatactttatctgatatttcagtatctccatatatattccaataatttattttacttaatttatatcttccatatcccataaaacctactacgtctttaagtgttaaaagttataatttatgatattctataagtaaattaatttaccgagattttaaaggttaaacttaggaggatttgtatatgtcaaattttttaaaaacacatattagtataaacaaatatatatggaaacttttaaaagtttttaattcttctgataatccaaagtttatattgagactatcaaatatctctaaattttttaggattattattttagggttgttagggttagtagaagttcctgttctttataaaaattacagataaaaaatataaaatactattctcaaaaaacatatttaaagatatctagtaaaaaagtccttataatccaagaaaatgaattctaagggctttaaattttacgggtagtttacatatttacattagtattcttatataaaactgatattgccgctgctataagtatcatacccataaaagcgggtgcggcatggccaagtgatacatagatttgacctccaatgataggtccaatcattcttgctaaggcctgaatagattggctacctccttgaatccttccttgttcactagaatcaacagacttagatagcataccattaaatgaaggtccaaagatagaatcaccaaaaccaaatataaacattccagcgataaaaagagggtagaatgaaaataaagatgatgctgcaataagactataccccataatctccgaaaccattccaagaattgctatctgtttatcattaagtattttcaaaagctttggcattataaaaccttgtgaaatgatatcctgaaagcccataattgaaaacataagtccaattagtgcaggcttccaattgaaagtatccattgtaaattgtgaaaaaactgcctgtaaagatccgttgggtatccaaagtaagaatgctgaaataagtagcatttttaagtttttcatagaaagtatatttgcaagttgtgtaaatggattcattcttacaaaggtaatctctttaagtctattattaatatcaagactttcaggcatacaaaatgctccataaacaacatttaataaagttattattgctccaaaatacataggtacagaataaccaaacttggcaagaaatccccctagagttggtccaataaccgttcctagacctacaactgcactgatccatccaaagtatttggttctttgttttggaggaatgatgtctgcaaaatatgcaaagatagtgcttatgctacctcctgttataccttctattatgcgcccagcaaatagtacccatagtgctcctcctataccaaaaactaagtacccaattgcagaccctaaaaggcatactaaaagcaatggacgacgaccatacttgtcacttaaagctccaagtacaggagctgcaaaaaatacgcagaccgcataaacagaggtaagcagagtaacgaatatagcttgttgtccaggactgtttgtataaggctgaactaaaaatgggacgacaggcattatgatactaaagcctattccgcaaagaaacacagagataagaccaaatatcaaagcgtgtttatctattgtttgttctgtattttgtttatcctttgatttaaatttgaacatttaaattctcctttcaaaagttattgttttggttccttggaaacaaatttattataatgttattttgtttccttgtcaacaaaataataacgaaaaaatacagcccgttctcaatagagttgggctgtttgtattttattttcattatttaaatttattttgacttaatatctataccagctttctttatttctgaatccaaatgcttactatacttttctatgaaactaagcatactgtcaaattgttcctcagttatttgttcaaatacgactttatcccgttcttgaaactctttgtgcagtttttcatggattttataaacttctttcccttgctcagtaagtctaaaatagatttcttttttgttatctggtttttggtagctttcgataatgcctttttttaggagcttcttagttattttactcatcgcacccctagtcatataaaaggactctgcaagttttgttacgttggaatccacatttcttccaatgtattcgatgcaatgtacttcagaagacttataacttttaagactatcttccatcttaaacttattaagccaaaccatcttgttaaataagtccctaaaacccattatgacctgttcttctttgttcatgacttgtcctcccagccgttggcgtattaacaatattatattaaagttttgtttctatttcaacgatattagaatataaaggtatatagctattctcatatttgagagtagcttttttaattttaagataagatttaattaggatttaaagtaaaatataagggtttaaataaaaaaatatttatgtgtaactaatgttacggaaatttaatggtagaaattgtattctatgtataccacgtaaatatcatcaaattggaggtagatactatgaaacatataaatatatagtaaactacctcccaaaaatcttagtatataaatatttataatataacaaatactttcttaaaataaattattgtaaataaaatatataaaaaattaaaaaaaggagacaaaataaaatgaaagcttttgtagatagagacacttgtataggatgtggagcatgtgaaatgacttgcccagaagtatttagtatggatgatgaaggtaaatctgttcctgtaaaagaagatatatctgaaaatttattagaatcagctcaagatgctaaagacaattgtcctgtttctgctataactataaattaattataaaaataaagggagaaataaatgattaatccaaatttagcaagacaacataatgagctttacaaattattagctgaaatgaaatctttaggatataatatagaatctaatgctgataaaatcgcattaaatataaatttattagctggaaagattaacattcacttgcaatcagaagataaatatttatattcattacttttaagctctcaacatacagaggttagaaaaattgcaaaagattttattgcagagatgggtcatatagctaagacctttaatgagtttaaaattaaatttaatactaaaaataaaattttaaataatataaatgaatttaagttagaatatccaaagataatgaatgctatttctaatagacttaataaagaagataaaaaattatatgtactattataaatataattaaatacataataaaaaagagagggtagttagtataagatgactaattatcctctcctttttattatgggatgaagttttgaagatacacaatttttgctaaacagtttcattaagctattaatgcaactgtttaaattattcaataaggtttatactataagaaagtttacagttgttatatatggtaaaataaactataagtaattaaattatgaactagaaaatataaggagattcaaaagatgataaataatgataccaacaaatcttgggctattagaacatctacagacgaattactaaattttattatatttacaggatgtatgtataacttaattgatgacaaacatttcaatgaatccaatagaccttggcctactagtatattaaattcagattgtaaaaatttgaataatgataaattaaaatcacaatggaaactatggtttaacagtgttatagataaaaaaagtaataatatcaacccaaacaaaatgtgtacacttattactcaaatatataatgtaaatgattttttagaacttgaatatatagaacttagagaatgttgtaaaaaatcatatccatttttcattgagtggtggaatatgcaagctggaggcaacgcagctatttctttctatgaaattatagggggtgataaattttgtaattatattgaagaattagaatgtaaattgaataaaaaagctaagatatttaatctttatatagatatagtatatacaggagtacctgatgtattagatgtaaatgatgaatatataatagtaactcctaatggatatataagtttagataaaaagtggtggatagataaattaattaagctaaatgtattttaactatattgctttacaacatagtaatttaaatgataatatatagctatattgtaaagcaatatagctatataagaaggggagtgattattttgaaaaatacaatttcttctcaaatgttaaaaggtatactcgaaggatgtatattaaaaattataggtcaaaaagaagtctatggatatgaaatgaatttgaaattaaaagaatatgggatttcaacagtatcagatggaaccatatatcccttattattgaaacttcaaaagcaaggattaatagtaggtgagatgagaagttcagatgaaggtcctatgagaaagtactatagccttactgataaaggtaaattacaactagaaatatttgagaaagaatgggaagtactatcaaatagcgttaacaatattttaagcattaaataaatggggaggataatatgggaaacgcaaaagaacttatagaacttaataatacatacagagaacaattaaatgaagaaaataaagaattttatgatgacatattagtttatattagagcaaaaagtttttttaaagatgaaagacaggtggaagaatctttacttgaaattttaacagatattatagaagctcaaaatcaagaagttaaagctagtgattattttggaaaaaatccaaaggaaattagtgatgaaatattaaaaaatacaaataagatgtcttttaaagatatgattaaattaattttgagtactatgggattatatactttagttacagtactaccaaaactaataaatcctagtgaaggtttagatttaggtaaattttttataggtttagtaattacatttttatttgcagaatttatcataaattttgttggtaatacagtctactcaaataaatcaaaaaaatttacatttactatagttgctttgttttgtatatatatatgtttaattatatcaatgaaacaatttatacctactatgcttgaaattaaattaacaggagctgttggtattaccataatttcaatattgggagttgttggaataatatatgggttaaaagaaaaattattttattcatttttacctattattttagtaacttgtactttaggtatattaaatagattagagtttaccaagtttttaattaatgaagaacctggcaagactatatctatattagctatggtaatagcatttatattaatgtatttaataacgtatttacaaactagagataaaaaaaataaagaatcacaaaagtaaatatttttaaaatagctaaaaaacagaagcgttaaacaaaatgatatttataaattattttcattacccaaggatatagatgtactagttgtaaatgataatgaacaaactatacttgaaactatatcaatgttatatcatatagggataaatcatttgaatttaattccttataacaaagaaaaagaatataaaaatattaaagtttgtataactcctggagaagttaatttagtaccaagttatatagatgaagtaattgatatagggcatagatttattgatatatctacttttttacaaataataactaaattgaatatagatgataaagatataacagagaggttaataaaatattctgaggatgttataagccttcactctggtgtaaaccatacatataaaaacttaacagtagaaaatgatgaattaaaatctattataaatttatctaaaaatggaatgatattaatttccaatgatggatacataaaagtatgcaatgaaagtgctaaaaatatattagatataaaaacagatatagctggagaacacatcaagaatttagataatcgagaaatagtttcaattttagagtcaaaaaacttagatgatgaagtatttaaatttagaaataaatacataactgtaaatagacacaatataaatagttttggaaaagatataggaatgtatttttgcatacaagaaataacatatataaaaaagttagagcaaaacttaagtaaaatgcttagagataaagggcaagttgctaggtatacttttaatgatataaaaactaactctgcaaatatggaaaatactaaaaatttagctaagaaaatttctaaatccgattatactgttttaataactggagaaagtggtacgggaaaagaattgttagcacagtcaatacacaatgaatctaatagaagtaatcaaccatttatagctataaattgtgctgcaatgcctgaaaatttacttgaaagtgaattatttggatatgaagaaggtgcatttacaggagctttaaaaggtgggaaaaaaggtttatttgaacaagctcataatggaactatatttttagatgagatcggagatatgcctatgtatcttcaaattaaattacttagagtacttcaggaaaatcaagttatgagggttggaggtcaaagtgtaatagatgttgatgttagagttatagcagccactaatagagatttattaagtatgataaaagaagagaagtttagatctgacttatactatagaataaatgtattgcctatacatattccacctttaagagagagaaaagaagacataaacatgatgcttgaatattttataaataaagatataaatataagtgaagaagtacaagatataataattaattacaattggcctggaaatataagagaacttagaaatatagctatgtatataaatactatggcttcaggagaaaaagttcttttaagtgatttaccacataatttgaaaaatataaaaaaagattatagcaaggaaattagttatttaaaagataaaacttgtattgaaaaaactgtagaggttatgaaatgtattaagagacatagcttgctaaacaaatcctcaggaagaacaagtatattaaaagagcttaatgaagacaatgtgttaattacagaaggtgaagttagacatatattagaagtacttaaatctatgaatcttatagagtcagggataggtagaaaaggtagtgaattaaataaaaaaggattagaaatacttgaaaatataaaataggttataaaataggtttagtaattaacctattaaacctattttatataattataaaaaataaatgtatttagattattgtagctttcacgtgaaacgtttgcattttaaatttagtaaatatgttaaaaatgctactgtataagcatatatatttaaatttttaaaataaaataaatttgaagttttagtattggcataatagttgctattatagttaattataaataaagattagatatatctaatccttatttattaaacgtaaattttatataatgattggagtgcatttagctatgaaaagcaacagaaagccaataataggaattacaggaagtttaataattgatgaaggaggaatgttccctggatatgaaagagcatatgttaataatgattacgtacaatctgtagcaatgtgcaaggcagttccttatataataccaatggtttatgatgatgaattaataaaagaacaggtagaaaatatagatggacttatattatctggaggccatgacataaatccattaaattggggagaagaacctcaccaaaaattaggtgggattttacctaagagagatacttatgattttaagttattaaaatatgcattagaaatgaaaaaacctattttaggaatatgtagaggagaacaagttataaatgtatttggtggaggtagtttatatcaagatttatctttaatagatggatgttatataaaacacaatcagggacatttatccaatgtatctacacatacagcaattataaaagaaggtaccaaattatataaaattttaggtgaaaaagaaatccatgtaaatagtttccaccacttagctgcaaataaaatagctaatggttatatagtttcagcattatctaaagacggagtaattgaagctatagaaaaagaaggagaagattttgtaataggagttcaatggcatccagaaatgatgactagagattatcctataatgcaaaagttattccaagcattagtagatgaagcaactaagtaaataatataataaatttatggaggaacactatgggagatagtaaaaaattaggattttggagtattgttcttttaggtattaactcaattataggttctggtatatttgggttaccaggagaagcatataaaatgataggacctgcaagtatagtagtactagtattttgtatggtacttgcaatatctatagctctttgctttgcagaagcaggtagttggtttgatgaaaatggaggaccttatctttatgctaaagaagcatttggtgattttgtaggatttgaagttggatttatgaaatgggctataggaatgatagcttgggcagcaatggcaaacttctttgctataactatttctacagtttggccacaagcggcagatccatttactaaaaatgttataataggtgtagttttaattggacttggaattgtaaatataatgggtgttgaagcatctaaagttttaaatgatataataacagttggaaaacttgttccattaatattttttatagcagttggtatattctttataaaaggtaataattttacaccatttgtaatagtgccaaaaggtgaagctacaactactgcatttgtggcagcatctatatcgttattttatgcatttacaggatttgaatctttagcagttgcagccaaggatatgcaaaatcctaaggaaaacgttccgaaagcattgatgacagtaatggcaatagtatctatagtatatatatttgtattagcaataagtgtaggtatattaggatcagatttaagtggagcagctacaccagttgcagatgcagcaaaatcgatggttggtaatgtaggcgtttatataataacaataggaactgtgatttctgttggaggtataaatatagcagcatctttccttactccaagatcaggggttgcattagcagaacaaggattagttcctaagtgtatagctaaaaataacaaaaaaggggttccatatatagctataataattactgttgttggaacacttttaatagcttggtcaggctcatttaaattcttattacaaataagtgttatatctagatttatacaatatatacctacttgtatatctgtattagtttttagaaaaaaatataaagataaagaagttaagtttaaaataccaggaggagcttttattcctatatttgcagtagcaataagtgtctggttattaatagaagctggaatgagtgatcctatgaaaattgtttggggattaggtggattactagtagcaataccattctatttttacatgactaaaatatataaagaaaaaaattgtaattaaatttataaataaaaacctatttttaaagtaaagttttagattacaaaaaacttacttataaagtaggtttttttattttataaaatatataacttataaaagatttattttgaaaaaacaaaaacaaatagtatagtactagtagttgtatttactgactatgaaaatcataaatttgttatattttaatgtatatagaataaaccatatgttaaattcataatatatggtttattttattattatgataaaatatattaaaacttgaaattgataaggagaattaatatgcttaagatagccttatgtgaagatgaccaattacaaagagaattggttaaaaattatatagataggtcacttttaaatagaaattacgagatatttgaatttaaaagtggagaggagttaatagccaattatccgcaaaaacttgatatattatttcttgatatacaaatggaagaagtaaatgggatggatgcagcgaaaaaaataagaactttcgataataatgttgaaattatttttataactggaatttgggactatgttcaagaaggatatgaagtaagagcatatagatatattataaagcctattgattttaatagttttaaaacacagttaaatctttgtataaaagagatagaaaatcagaaaagacctagtatagttgttacttataaaggagaagtaaataaaatagatataggatctattgtatatattgaaacagataataggaatacattaatacatacaaaggaaaaaagctataggtctaatatgggaataagcaaactagagaaatatttagaagtatcgacattttttagatgccataatagctttttaataaatttagaatatataaataaaataggacaagatagtgtttttttagaagaatatgagatacaagtgagcagacataaaatgaaagagttaaaaattcaatttactagttttttaggagataaattatgattataaataaaactttcattgcactaataacaagtttaagcttaacaactatagaatggttatgttttaaaattttaatagattatatgagtaatcaaaaaacatcaaaaaaaataagatttattacctttttagtatgtgtattagttagtgtattatctactaattcgttaaaaccattagtttatataattgcaggatttttattttataaaaccaattatacagaaaccttattatcatatgacaagtggttagatatgcagatagacattattatttaactaatggtagtactactaaaaatgtttatatagattataaactaacttgaatggagtgaatttagaatagtatgttatatgttattgcatataactagtaaaaatgaccttaaaattcatttagataaattttaaggtcattaactttattctaaatatgtaagtttttaaagtgaaattctaagactagttatttcaatttgtaattaagatattcataagcatcttttaaccatggatgaattaccttaatttcattttgtaataaataatcaatataataaagagctgaatgctctaaagacttatccaaattatataataatccttctaaatagggtggatttccactttggtcccattttatcttatctgagacaaataataataaatctagtttagaaggctctttttttaatgtagtatgacattcaatcgctgataaaattgaagtatcattaattttaaaaatctcttgtgcaattacttttgagattttttgatgtatgattaaaggtagttttctttcctcatcacaaatttcaattcctaaaatatttgcaacttctattcttttattatttggaataactgcacttatatcatggagaagcccagatatttctgataactctgggttaatagaatatctacatgaaatatcttttgcataatttgcaacttcaatagaatgagatatagtatctaggcagttatttaactttagaaattctgtcatacttttttttatatcatttgtaattttaggaacctttaaatttattgaatttatgctcatatataaatttccccctaataaacttaaatttacaatttataactaattattaatttaattatatcataacttaggttatttaatatttttgtgtatatttatattttttattagacttacaattttattaagattataataaattggatagcaatattttataatgggggaggttagaatggaacaagtaaaaaataataaacaaaagaaacttacgattggattatttattgtgtaccttctagtactaacatggattgtattatttaaaatgaatttttcatttgaagatttagtcagttcaagaagtattaatttgataccttttggtgattctatgattgttaatggtagaattgatattaaagaaataatttataatatgattgtatttattccttttggaatttatgtatgtatgataaatgataagtggagtgttttgaaaaaaatattatctatagctggggttagtttgtcatatgaagtattacaatttatatttgcaataggagcatttgatataacagatttaataggtaacacatttggcggagtcgttggtattgcaatttattattttattggcaaattatttaaatcaaatcgaaaaatgaataaagtacttaatatgattgcgttaattttaactatattaatagttttatttttaacacttctaattgtagtaaatttataaatttaattagagtaaataactaattctttattttaaaatatctgttaaaaaagctcttagaattcatttgtttggattttaagggcattaattatatgggagagaggggcatttaaatgataataaatttagataataaatatattattaaacaaatatctttagaacaaagttctcagatagaaaagttatataatttatgttcagattatcatataatttgtagcggtagagaagccaatgaacaagatataaaagatatatttacttatacagataagaaaaaaattgaagactctttaactttaggaatttatgaatcaagtgaacttatcggattaattgatatatttaaaaactatcctaagattaatacatggtcaattgggttattattactagcaccaaataaaaggggaaacaagttaggtagtttagttcacaatgagttaaaaaaatatgctttaagtataggggcagattcttttagtattggtgttcttgaagaaaatattttagctcataaattctggaaatcactaggatataacaaagtgaaagagtcaaatattaaatttgggaaaaagaacatatagtatatgtttatgaactaaaattaagtgactagatttataattgcaatctgtaattttggtagattgctatataaatttcaactttagcatttgccgttttgcattacaagtttagtttgttatgtaagtgcctttgaagcactttgatagggcttcattttttagttttaggtggtattttttgtacagtttagatagtaaatatattattttagaaaattattaaccttaatattacataattcctagctagtttttagagtataatatattattttttatattttactcccaaataaacacatcttaatccattttcaactttttttgtatttaattttgtataattactaactagtctcaaaaatcaaatgacaagtggttagatatgcagatagatactattatttaactaatggtagtgctactaaaaatgttcatatagattataaactaacttgaatggagtgaatttagaaatgagtaagtataaggattggaagatgatagattggattatagtaggatttgtaggtatatcttttatagaaatacctgaacatttgtatactcttcctacaatggtaattgtttatgattacccatataatatccctataatcatagcaggtgtatttttaatatattgctttttatcaggagtatattggataaaaaataaaaaaataaatatggtagttcattattgcttattagcaaccatgtatataacatttgttatgctatatgttattgcctatgagtcggggatgtaaaataagtattatacgtaaatttgataaataaaatatctaaatttagaaaatatccaatatgatagcatggttttaaaaattactcatgattgttttatttagggggtgattacttgaagaaaataactagatcatttaaacgattatttttattatcaaatgttgtaattataatatttttaatttgtattgtttttttacttattaaaaaagattattttcatatgacgctatcacttggaagttttgtagtaattttatactcgaaatttcaatggcataaagcatataaagagtttattgagaaatttaactaactcataaaccgaaaatttaaggattgttaaattaaaatttattagattttttatagtttatagattactatttcatataaggggggggaatttatgaaaaaagttattaaagaatctgatttaattaggttaagattaacacaatatgaagatttagagtttgtaattggtgcagaaaatgaatctgaaaatgctcagtatatagggaattggtctaaaactcaacatttggaatcactttcgaattctgatatattacatctgataattgaagatagtaaaaaaggaaaacctataggttacataatcatggctggcttagacaatcctaaccataacattgaatttaaaagatttgtcatttgtgacaagggcaaaggttttggaaaagagacgttaagattaattaaagaatattcatttaatgaattaagagcacatagattatggttagatgtaagatataaaaacaaaagagctcaaaatgtttataaatctcaaggtttcaaagaagaaggaattcttagagagtgtattctttataagggaaattatgaatcattgatagtaatgtcaatattagaaaatgaacaataaattttattttaaaatatctgttaaaaagctcttagaattcatttatttggattttaagggcattaattatatgggagagaagctaatgaacaagatatagtgggagttttatgtttatagcatcttctttcactgtaaagcctaaagtgcaggctttaacgttttgtcagattgctataaacataaaacttgttcttcgttgttttttcatttttatttgtttttagataagccatattttttattaatacgacctagggtaaatgtgtaataagataaaattaatataaaacatccactagcaatagttatagggaatgatttgaaaaacattaaaaagcttaatgaaatagataaaacacttgttattaaaaataaagaaaccatagattttgtatatttttttaagtttataaattttttatcagatttatttttataaaagtatcttagttgtgatatagctaagattatacaaaatagtccataagcaaaaaacagaaaagcaacaaatctcataaaatcctcccttagataaaatgtattaatatttaaatattaaaaatgattttaacatttaaagaagaataaagttaaaatttggattaagattgagatattatggagtgaaatatgaattttaattattaattatatttaaagtatatattgatgtataataaaataaaaaatataattttaagaaaggtaacaataggcttgaatataaattatgaaaaattttaaggataggaggataaattatgtttttcataatgggagttagtcaaagtcaaaaaaaactagactacaaacaacttaacatatgcaaatgctgcggcaaatattcaaacattgaagtatacatgacttactggtacttcatgttcttctttattcctattataaaatggaacaaagaatactacgtcaaaactacctgctgtaacaaaatagctaagatagacgaagaaattggcaaaaaaattgaaaaaggacaagctataagcattgacacagaaaacctagactttggttgttatgaaaacagtgtaaaagtttgctctgtatgtggataccaaactacagaagactttacttattgtccaaagtgttctaataaattataaaaataaaaaagtaaaggaacagaatactatataataccatttacataattggataaaaaatggaacgtcattaatttgcgttccatttttatatgcattgattccagcgtcctaatatcttatttttaaaagatgataactgtataaaaaatgtatcaaaatttgaaaatattaaaattgagaataattagaatatatagaacatattccaatattatggtaaaatatgtaataaaagggttggagtaaattatttataagtgggtaagaagggaataaaaatggtatctatatataataaggttagtgactatataatagtgttaaattgtatgggggaaatagttttttgtaatgaaagcgtcctactggccctactggtcctactggccctactggtcctactggtcctactggtcctactggtcctactggtcctactggtcctactggtcctactggtcctactggtcctactggtcctactggtcctactggccctactggtcctactggtcctattggccctactggccctgcctcagaatgttgctgtaaagatagcactctatatgcactacaaacactaagaaatctattagctaatcaacctcaggctacaaaagagataactgcaaattcatttaactcattcaaaactggtactatagatagctttataaatgacgaagtagtagttttaaaacgacaaagcccaactgatacatcttacgtatctatatgcaatattatattcataactttcaaagttacagtaccttctaactcaactacaatttgtgatacacctgaatgttgctgtaattctggtatggataaagccttaaaaactattttaggtaatccaactcctgataagttcccaataacaaatgtaaatttacaaatagatgttttgaataatacagcagcatcaattactctacaaaaagtacttggaatatgtaagggaatactatggggtcaaatgcaaggttcatcaaatgattttgtcgctatcccattatgctatatattctcagcaaataataaaaaccaatagaaattaaataaacaccaatttacaaaaacctagctcattaagtattctatatcttccgatttaggtagatatagaatacgagctaggttttctttaatttatttatattattttaaacttgatatgaatgttgatgaaaatgctcatgttcacctgtaaacccatcttcatggacatgatcatgtcctactccatttatatgataatgactatgcataaaagatacttgtagcttattatttataggatttatcccaacatatgcattaaccccaaatatctcctttaacatatccgatgttataactttctctacacttccacattttcttatttttccatctttcataactattaaataatcacaatacatagatgctatattcatatcatgaattgctgataaagttgttatattaagacttttaactaaatccataagttgaatttgataccctatatctaagtgatttgtcggctcatctaatattaaaaaatccgtatcttgaactaatgctcttgcaattaaagttctttgtttttctccccctgataactttgaaaaactcctattactatagtcatcaagtcctactctttttagcatattattaaccatgtctatatcttttttagaataatcttcaaaaactgatttatatggatagcgccccatcttaactatttgctctactgtaaagtcaaattgtgagttgctctcttgtgctaatactgcaatttctttagcacaatctttatctttcatagtagataaatctttattatcaagtattaactttccgctatctggcttatataatctatatatatttttaagtatagtagactttcctgacccattaggtcctataattccaacaaatgaaccttttggtatatcaaatgatatatcttttagtatatcttttttatctatactaaactttaaatttttaacttgtaatttaagcattaatctcttcctccaaatgagtaatttttcttagaaattaaatataagaagaatggcccacctactagtgctgttattattcctattggtatttctattggagggaaaagtccccttgctaaaacatctgataatattaaaaatatagctcctattaatgatgaaagaactataagttttttatgatcactcccagctatagttctacaaatatgaggaactactaatcctataaatcctatagctccagttattgcaaccaatgtagctgtcaaaagagttgaaagaattaaaataattgactttataagttttacatttattccaagaattatagcactatcatctccaagaagtagtatgtctaatgattttgacattacaaaagatacaattataactaaaattaaaactataaatggaattaataaaacatcccacttagctccacctaaactccctatagtccaaaataatgcattttttgcttgatttgaattttttgctgaatatataagcaaattagtaagtgctgaaaatattgttgatattgccataccagtaagtactaatcttgttgtagatgtggtttttcccatttgtgtacctattgcaaaaaccaatactccagataccatagaaccaacaaatgcaccagtagttatactgtttattccaagacttgctactccccctaaaacaatagtagcaacagcaccacatgatgcacctgatgaaattccaagtatatatggctctgctattggatttttagttacacattgcataagaacaccacatatagcaagccctgaaccacatatagctcctaataatactcttggaaatcttatttcccatattatattttgggtcataacttcacctacaccactaaacaatgctccatttgttaatttatttaaaagaactttataaacttctccaggctctatatatgtactacctatagctattgctccaactactgtacctgctaatagtatagttaaagctataacccaaaataagaaacctttctttttagaaaggcttcttgttttatttacagaaacttccactatttcttatctccataaaaatagttatgcatttcttctataaccatagggtttctaactcctggagataaatcagctagtttaaccacatatattttattattttttattgcaggtacatctttaagtgctggatgtgattttaagaaatcaattttttccttaactgggcttccagctaaataatcagttactaatataacttcaggattttttgctactatactttcaaatgaaacatttatgtatggcttgtcagcttcttttccaaatacattatttccaccagctatgtctattagattattagcaagtccagatcctactaccatagcatccttttcacctgagtcataaaccatcattttaactttatcttcttctttcatatttccaactttatcttctacaacttttatatcgcttttcattttatctactacttctttagctttatcttctactccaaatattttaccaagtaaattaaaatcttcataaacagtttctactgttgcatctggtgcataagatttagccataaatggtgctacaccattttttacaagttcctctggagaacctgtagtttgttcatttatagatgaatcccatccactaacaaaatcagctccagtagctacaaacgcttctttagatatagagtgaccttctcctactttaagttctggtatttttttgtaagcttcttcatattgaggaagtattgggttgtctaaaagagctgttccaaccattctatctcctaagtcaagtgccaataacatctcagtcataaattgagataatgtaactgctttttgctttggagcatcaacctttacatttacatccttagttccatctgagtaaacgtattccacagtttcaaaattacttgactcaacctttgcttttgcttctttaccttcttcttttttattatttgaacacccaacaacactaagtgttaaccctgctatagccattaatgctacaaacttttttaaacttttgctttttatcatttttattcccccatatttttcctatttttagtttactataatctaaaaaaaattaaagccatgaagttatttaaataaagatacaccaaagtataccttataatttaaaaccttcatggcttttattttcattaattatttattttaatttttattcatggctatgctcatgctctccattatgatcatgcccatgttcatgagtgtgatcatgttcatgtgaatgaatgccagtaaacccatcttcatgattgtggtcatgacctattccatttacatgttcatgttcatgtccatgagtgtgagtatgctcatgactatgattatgctcatgagaaccgcaacagttttctcctccgttaccacaacatccatttgtgtgtggattatgatgtagtctaaagtttctttgtaaaaacatatcgtttccccctgatagttctattaatttttctatatttcaataatttctcccctacacacttttactatattcgatttttctttagtagtaaatatatcgttaaattttctgaaaatttagttttatacataattttacatattatttaatattatttaatttttagataattttttatattttatacgttttttcatggttttattaacgccttaaaattattaaatttcagttataaagttttaaaatataaaaaatagcctctaaaaattttttagaaagctatttataatatataatatttataaactatctgttatcttataatctaacatatctatatcttctttgtcagtaaatatactatttactatataatctctttcttcaatattatttgatttatatatatacctttttaaaaatttatctgcttctggattattcagcttagtttttccccaagttgctcctagatcaactgatttacaagtatataaattattgtattctccccattgaatataaagttcatttctatgattaattaaatgaggaaataaacacattaactctgtttttataagtgttgattctaatacttcaaatttattatatactaactccccttttatatatttacaataatacttaccatcattttcttcagaaaaaactatattataatatcctcttatatcttttaccacagataaatatattttgctttttttagaatctgttattttaaaaggttcagaccatttatttttctttatattaaatactgatacaaataattcttcaacttcatctacatgtttaaaataaaataaaataggtatatctttatcccaaatcacttcaaaattgctcattatgttgtatggtatataatcaacttaattttcaaagttcttaatttgttttgtccgtttctcaaggacaagtaatactttatcatctaattaaactatcgtcaacagttttttttattttttttaattattttttaattttactttataaaaaaaagtaatcaacaatttatcaacatttttatccacattatctacagttttaaactgatttatacgcctcattttatcagcattatccacattatccaccaatattattgatatattaacatttgtcttataattttcgataattcctcttttttatatttattcaaacaaaaatggatatagaattttttacataattctatatccatttctattttatacacattatttagctatatctaaatcttctttcatatattcttcatgtaaatatatatttttagattctaatgtcttttttacatcaattattctttgatttgatgaacctctaaaattaagacttatatccctcttagcttctataaatttcccatctactaatacatctatatttctaagtaagtttaaattattaaaatatgaaggattctttttgtctataagttcttcaaatgtatatcctgtataagcccatacatccagattatttgctttacacactttagctacttcaattaaagcttcactttgcataaatggctctcctccagataaagtaactcctctgtgtaattttaacttttgtatatccttagctatatcatcaatgtcagcttcataacctccacataaatcatgtgtttgtggattttggcaccctttacaattatgattacatccttgtgtccatataacagctcttaatccaggtccatctactatactatcaaaagtaattggtgaagctaatcttatcttcatgtaaattacccccactaaatattaattatgtttaactctatctcttacttctgcctttttagcattattgaatctatctactgtacctactaagtatccagttattcttcttattctttcaaatcctatttctccatctgactcttttcttccgcatgctggacatacatcacctgcaataactcctgagtatccacaaactggatctctatctaatggatgatttatactaccatatcctattcctaattccttcatagctcttataatagtttcaaaagcttctagattattagaaggacttccatctagttctatataagttatatgtcctgcattagttaattcatggtatggagcctctattcgtattttatcaaaagaacttaatttatgataaacaggaacatggaatgaatttgtataatattccttatctgttattccttttatctcgccatactgttttttatctatagctgtaaatcttcctgatagaccttcagcgggtgtagctattaatgagaagtttaatccatatttatcactagcttcttccattctttctctcatatgtgttattatttctaatcctagcttttgagcttcttcactttctccatggtgtttacctataagagctattaaacattctgccaaacctataaaccctactgttaatgttccttgttttatgacttctcttaatgtatcatttggacctaattcatcagatcctttccatacattttgtcccattaagaacgggaagtttttaactttcttactagcctgtacttcaaatctctcaagtaattgttctataactaaatctatcttttcgtctaattcattataaaatccttgtacgtccatagcttgtccattcaatgaaccatgtttaatacctagtctaggtaaatttattgttgtaaatgataagtttcctcttccacttactatttcttctccacatacatttccaacaacccttgttctacatcccatatatgtggcctcagtttctggtcttccttctacatagtacttagcattaaaaggagcatctaaaaaactgaaattagggaatagtcttttagctgatactctacatgccaacttaaataaatcgtaattaggatcttctggatttaaatttattccctcttttactttaaatattaatatagggaagatcgctgtttctccatttcctaaacccttttctactgatagtaataagtttttaataattaatcttccttctggtgaagtgtccgtaccaaagtttacactagaaaaaggaacttgtgctcctgctcttgaatgcatagtattcaaattgtgaataaaagcttccatagcctgataagtatttctatctgtttctttacgagcttccttcaaagcaaacttttgtaccttatctgcaactttagaatctatattaaacttattcattagttcttctttttctagttctatatatggcttttctatatttatactaagcttagtgtttgtttgttcttctacataagacaccatttctttaacctgttctaagacttctatatcttcatatagttctaatgctttagccatattattagcatataattttttaaaagttttatatacaccctcagctaagccataatcaaagaatggtatactttgacctccatgctggtcattttgattactttgtattgctattgctgctagtgctgcataacttataatatcattaggttctcttaagaaaccatgtcctgtagaaaatccatttttaaataattttattaaatctatttgacaacaagtcaatgtccccatatttaaaaaatccatatcgtgtatatgtatatctccattatcatgagcaaaagcatgttctggttttaatatatgagttttacaaaattcctttgatactgtacttccatattgaagcatagtacccatagctgtattaccatctatatttgcattttctctttttatatcagcatcatcagcatcagcaaaagttatttgctctattgatttcataagtcttgatttagagtttcttattctatttctctctgttctatagactatatattcttcactcgtttttgcatgtcctttttctataagaacttttacaaccgcatcttgtatatcttcaactccaggagtattatttgcatgtcttagatttaaaagtttaattacatcttgagttaataattctgctaaatgataatctgctttactattttctctttcagccactttacttgcagctaaaaatatagctctagttattctgtcagaattaaaaggtatcactcttccatctctttttcttactgtttcaatcacaataaaaatcccccttcatcacaacatattgtatttataaattaacacacccactatatatagtatcttaggatgaaaaaaatcccctttaactaagttaaagggaagtctataaattattactctataaggttaccaaatttgtacataatcgtcaaatgtgctctaagcattggaattactatctaccttttttgaacgttagtatttgtaatacattcaaatttttaaaaattttttacatttcatatcaattttttgcagaattttttatttaaatattatataatttactctattattctaaattcatatataatataattatctatttcgaagaggaggtatcgtgcaatgctatctaatagattaaataacattacaccatcttatacaatcggtataagtacaaaagttcgtaacttaaaatcagaaggtaaaaatattatagatttaagtataggtgagccagatttacttgtaccttataaagctaaacaatacggtgtagattctcttaataatgatcttactaattatgacttagttcctggtttaaaagtgcttagagagcaactatgtaataaacttaaaactgaaaataattgtaattatgatatagatgaaatagtcgtatctagtggagctaaacatgcaataacaaatacattattagctcttgtaaatccaggagatgatatacttgtccctaaaccttattgggttagttatcctgaaatgataaagctagttaatgctaaccctatatttgtggatacaaataaagaaaatgactttaagcttacaaaagaaatactagagaaatatataactccaaatactaaaatgctatttttaactaatccttcaaatcctactggagccgtatatacaaaagaagaattattagaaatagctacagtatgtttaaatcataatatatatatattagctgatgaaatttatgaaaaaatctgttatacagaccaatttgtttcttttgcatctttaagtgaagatataaaaaacataacaataactataaatggtttttctaaatcatttgcaatgacagggttaagaattgggtattctgcaagtaataaaaaaattgctaaagcaatatctactatacaaggacacttagtgtctcatccttctttaacaagccaatatgtagcttatggagctttaaaagattgtactgaatatattgatgaaatagttagtatatataaatctcgtagagatttggttgttgatatattaaataaatctgataagttaggttatgtaactccagatggggcattctatgtttttatcgatttatcaaaagtaaaagaatctctagattataaagatagtttttctatagaattttgtaatagattattagacgaatatcaagttgcagccgttccaggaatagcatttggtatggataactatataagaatttcttatgcatgtagtgaagataattttactaaaggtttagaaagagtaatcaaattagcagaatctttataaaaaaataacccttaccaatttggtaagggtttatttttttaatttttcaacataaaaaagattacgtggctacgtcctactctcccaggcagcttcccaccaagtaccatcggcgctaaagagcttaacttctgtgttcggaatgggaacaggtgtatcctctttgctataataaccacataatctttaccattatttattattttaggtcttttataagcattttcatctctttttatatttctatcatttttatatttttcattatatttaggtttataatttttaccgtatatttcttgttttaaagattctacactaattttactttctgaacttaaaaaatttatataatagtctatatctacaggactttttaaagtttttattattttactagactctttagtgaactttaatctttcttcatcttttgatatatcataattttttttacatttaataattttatatcttatataatgaatagcctcttttatagatctttgatattcactcaatccatattttcttataaattcatctggatctttgacatcttttaagtctaatatttttacatttatacccgaactagttaatatatctatagctcttaatgtagctttaacacctgcatcatctgagtcataagaaattataactgtatctacatatctttttaataaattcccttgttctaaagtaagggcagttccaagtgtagcacaaacatttcttactccatattgatataaagatattaaatccatgtatccttctacaagtatcatggttctatctgatatattttttctagcaaagttaagtccatataaattatactttttattaaaggctagtgtatcaggtgaatttaaatatttaggaagagaatcatcaagaactcttcctccaaatcctataacatttcctctatagtcaaatatagggaaaattactctattaataaatctgtcataatatttatttccatcttttttatatgtaacaagcccacattcaacaagtgtctccttatcataacctttatcgattaaataatccataagattagtccatgccttaggtgcatatcctaatccaaatttttttattattttatcatcgagacctctttttcttaaatattcatacccataattcttttgtttaattaagtttgaaaaataatatctagcagcttctgtatttagatcttgaaacttctttattttttccatcctgattttagattgctcatccatatttgtgtttatttctactccacaatctttagctaataacttgactgcatccataaattcaagattttcaattttcataatgaagtttattacatctccaccttcaccacatccaaaacacttatatatttgttttgatgtgtttatataaaatgaaggtgttttttctccatgaaacgggcataatcctttgtaattcgctcccgattgctgtactttaatgtagtctgatatcaccttaactatatcagatctagactttatttcttctattttatcttttatatcattcatattatcaccttctggtgtaatttttttaacattactattttacaatatattagaaatttgtcaaatgttcattatacataattcgactttttttatctaattccttctttttttataaaattttttttaaattttaatgctttatcaaagtttttctatataaaagtgttactttaatattttgtataatatttataatttcaatactacattttaaaattatttattttcaaaaaataaaagaggcaataagcctcttaaaattttataatttttttatactattcatcaaatcttcaaactcttcaaaatgaagtgattgacctccatctgataaagcttcatttggatttggatgaacttcaaccattattccatcagcacctgctgcaaatgatgcaatagacattggtttaactagataccttaccccagttgcatgactcggatctactattataggtaaattcgtttctttttttattataggaactgcagctatatctaaagtatttcttgtgtaatcattataagttcttatacctctttcgcacattataatactactatttccgcctatagcaatatactcagcagctcctatccattctgatatagtagaacttatccctctttttaacattacaggtttatcttgctttccaacttcacttaaaagagtaaagttttgcatatttctagatcctatttgtattatatccgcaacttcgtatactttttctaaatctctagcatccataagttctgttataacaggtaaattagtttctttctttacagcttttaatatttcaagcccttcttcttttagcccttgaaatgaatttggtgaagttcttggtttatatgctccacctcttaatacatttgcacctttttgttttacaaattttgcagtttctaaaagttgatcataactttctatagcacaaggccctgccattatgattttatcttttggcatttctaaatttttagttatttttatatttaaattcttatcaaataagttttttttcattacctataaactcctttacttcttctctttcctcagtcgtcaaagattttaggtactcatttatacttacattatctatttttaatttatcatttaaatctataagtggtattaatacaaatgctctttccttaattcttggatgaggaatttctagattttcttcttgtaaaattatatcattaaaaaataatatatcaacatctatagtccttggcccccatcttatttttctttctctatttagttttttttctacatcttgacatacatgtaaaaggtcatttggatctaggtcagtttctatctctacgcacatatttaaaaaatctgcttgctcagtgtatccccaagccttagtttcatataatttagactttttggatatttttatgttgctatgagagtttaatatgtttaaagcttgatttaaataatttaatctatcacctatattagttcctagacctaaataagatttattcatttctctttctccttatttctacaccgaaataatcgtatatgccaggcactggagcttcaggtttttttactctaaccataacttcttgtattaaagtaaatttttcaaaaacttctatagctatattttcaactagtgcttctaatagattaaacctcttattttcaactatatccttaactacttcataaacttctccataacttactgatttgttcatatcatcagttattccagcttctctagtatctaagtataactccatatcaataaaaaacttttgacctaatataccttcttctttaaaaactccatgatatccataaaaccccatattatttaatagtatcttatccataataaccctactttctatatatagcatctgcaactttaatagctcttaaattttctaatacatcatgaactcttactatatctacaccatcttttattcctatgaccgtagtagctatagttccttcaactctgtctttaggttctaagttcagtatatttcctatcatagattttctagatgttcccaaaagtataggatatcctaattcttttaattcacccagtctagacataacctctatattttgttcaaatgtttttccaaaccctatacctggatctaatataattttttcatcatctataccagcatcttttgctatttttatactttctattaaaaattcttttatagattccattatatctttatcataatcagttccatcttggttatgcattatacaaacatatgcattatattttgctatagtacttgccattttaggatcttttctaagaccccatacatcatttattaaatcagctccaagttttaaactttcatttgcaacctcagctttataagtatcaatagatactttcacatttaaattttcctttaaagattttacaacaggtaaaactctttttagttcttcatctgcatctacttttttatgacctggtctagtagattctcctcctaaatcaattatatctgcaccttcatctatcatctttttagcatgatttaatgcagtttctaaatcagtataacttcctccatcagaaaaactatctggagttacatttaaaatacccattacataagtttttttaccataatcaaacatgtaatctctcctatctcatatttattaaactcatagcctccgctcttgctgctatatctttttcaaatatacctcgtactgctgaagttatagtttttgaaccaggttttttaacacctctcatagtcatacacatatgctcagcttctaaaactacaattactccatatggttttaattctttcattattatatctgcagtctctttagttattctttcttgaagttgtggtctctttgccaaatcttctatcactctagcaagtttagaaagacctgttaatctaccctcttttggtaagtaagcaatatgtgctttaccaaagaaaggaactatatgatgctcacaacatgaataaaatggtatatccttaactaataccaattcttcatgctcttcagattgaaaaagtgtttttaaatgttcactaggatctttatgtattcccgaaaatatttcttcatacatttttgcaactctacttggagtatctactaatccttctctattcggatcttcccctatagcttctaatatatcttttacagcattttctatcttttttttatctacattatacatataaccagcccccctaatttaatattttgtattttaaagtttatactgctaaaaaaatacatattcatatacttttttaagattattgtattcataacttttataaacatcttttgccaatctaaataagtctttttcattttcacttaaatatttaaataattttttgtctttaggtatccattttccatttttaataaagtatcctcttattatatcttttagatatatattagtcaaaaattcatattcataattttcaaaatcagttttattatgtaacctagatatattgtcatataactaatagcattacttacaatatatgtagattttttataaacataattaaaaatattattaagtataaaaataaattacctttaataaagagattaattttagtagaattagtgatagtaattattgtaggtttgatgtttatatttttatatactacttggtattggcaagacccattttttatgctaattgcaataattggttttttaactttaagcttaattataataacaggtattatattaaataaaatagattatttagataacataatagaaggaactaaaaaaataaaaaatggaaatataaatcataaaatagaagtaaaaggtaatgatagattggctacatttgcacaagatataaataatttgagtgaaggtcttgaaagtgcaatagatgaaaagtttaaaagtgagagaatgaaggctgaacttataacaaatgtaagccatgatttaaaaacaccattaacttctataataaactatgtagatttgataaaaaaagaagaaaatatacaaccagagtatttaaaagattatataaatgtattagataataaatcaaaaagattaaaagttcttatagaagatttatttgaagctagcaaagctagtagtggtaatatagaacttaatattgaaaagttagatttaaatcaattattaagacaaagtattggagaaaatgaagaaaaacttacaaattctaatttgaatttaaaagtaaacttactaaaagaacctgtatatataaattgcgatgggaaaagaatgtatagggtatttgaaaatttattaataaatatttctaagtattcacttgagaatactagagtttatatagatatgaaagtagatgaagataaagtatatttatcttttaaaaatatttcagcttatgaacttaattttgaagcagatgaaataattgaaaggtttagaaggggagatttatctagaaacacagaaggtagtggattagggcttgctattgctcgtgatttagtggaacttcaagatggagaatttcatatacagatagatggagatttgtttaaagtaaacttggaatttaaaaaagtatagggagtaaaaaaagaacctgttgccaggttcttttttattatttcatttctactaataattgtttatcctttacaagttcaccttgttttacaagtatatttttgattataccatcggtttttgcaactataacagtttccattttcatagcttcaataactataattggctcatttttcttaacagattgattttctttaactaaaactttaacgacttttcctggtatactagcacctatttgtaatgggttattcatatctgcttttactatatcttttatatttgagcagtagttattatcctttatttctatatctctcatcattccatttagctcaaatgataaggttcttgttccatcttcttttacatctccaatttctacaaactttatagttaaaactttaccttcttcaatttctacctcacattcttcaccaatagataaaccatagaagtaaacatgactttcaagtttagatatatcattatataattgtaaatgttttagatagtcttcataaactttaggatatagggtataacttaatatatttctgatatttgaatccattttaaatttatcatcaagatactttttaatattttcaaagttttcattttctattaatgttccaggtctagttgttataggtttatccccttttaatactattttttgaatatccttaggaatgccaccttcaggttgacctatcatacctttgcaataatcaactactgagtctgggaaagctaagtttttcccttctattaatatattatttttatcaagtttattttttaccataaatatagctaagtcaccaacaactttagatgatggagttacttttattatatctcctaatatatcatttgattctttatatttttcttttacttggtcaaatttatcagataaacctaagctatcaacttgaggttttaagttagtgtattgaccaccaggtatttcatatttatatatttcagcagatggattacttaaatcactttcaaatttagaatatacttttctcaaatctttgtaataatttcctaattcttcatatccatataaatctattttagtatctctttctgtattttttaaagcttccacaatagcatttaaagatggttggcttgtaagagacgacattgtttcaagtgcagtatctacaatatcaactccagcttcactagccattaaaatagttgcaacaccatttccactagtatcatgtgtatgaagatgaataggagcatctacatttgtttttaactcttttataagcttataggctgcatagggctttaaaagtccagccatatcttttatacatattatatctgaacctaattcttctagctgcttagccatatttatataatattctaagttatatttactctttgaagggtctagaatgtctcctgtataacaaattgtagattctactatttttccagtttcaagagcagtataaatagatggtttcatattttctacccagtttagagagtcaaatattctaaaaatatctatacctttattagaagactcttttaaaaattcctttataacattatccggataatttttatatccaacaccattagaagctctaaatagcatttgaaacattatattaggtatttcttctcttaatttttctaatcttaaccatggagattcttttaaaaatctataagctacatcataagtagcacctccccacatctcaagggaaaataaatctttcatatattcatttgttggttttgctacttttagcaaatcatagcttctaagtcttgtagcaagaagcgattgatgagcatctctcattgtagtatctgttattaataattttttctcattttttatagtatctatatattttttcttaccaagtttattaaataaatctctactgccttctttatttacaatagaatcttctaacttaggagtatatatagtttggaacttaggctttttgctacatttattttcattaactattgtatttcctataaattgaagtaattttgttcctctatctttactttcttttatatcaaataaatcagggtttttatcaatgaatttggtactacattttccatctgcaaatattttattatttaatacgttaactaaaaatccaacatttgttttaactcctctaattctaagttcttttatagaacggatagttttatttattgcccctttaaaagttctatcccaagaaatagttttgaccaataaactgtcataataaggacttatagtagaacctgtaaatccattgccaccatcgagtcttataccaaatcctgaaccagttctataaacttgaacttttccagtatcgggcataaaattactttttggatcttcagttgttattctacactgaatagagtagcctcttatttgtatgtcttcttgatttttaatatttatttcttcaccatctaatctatgaccttgggcaattaatatttgactttgaactatatcgattcctgttatcatttcagtaactgtatgttcaacttgaactctaggattcatttctataaaataaaaattttcattttcatcaactaaaaattcaagtgtaccagcatttacatagcctacatgtttggctatttttactgcacatttgcatattttttcacgcaattgagtagataatgaaaatgcaggagcatattcaatgattttttgatgtcttctttgaactgagcaatctctttcgtataaatgaacaatatttccatacatatcaccaagtatttgaacttctatatgcttaggatttactataaatttttctataaaaattatatcttcaccaaaggcttttttagattcactgcaagcagtttcatattctatgcctaaattattttcatcatatacaactctcatacctctaccgccaccaccattagaggctttaagcatgataggatatcctatttgactggcaatttctttagcttcttcaatactcttaataggtttgtcaataccagggatagtaggtacacttacgttttttgctatttgcttagagtttattttatctcccatcatattcattatatctgcagatggacctataaatattattccgttttcttcacatttacgtacaaattctggattttcagatagaaatccatatccaggatgtattgcatctacgtttttttctttagctaattttattattgcatctatatctaaataagcatctataggacctttatcttctccaattagatatgattcatcagccttagtcctaaataatgaatatttatcttccttactgtatatacacacgctttttattcctaattcagagcaagctctaaatattctaatggcaatttcacctctgttggcaacaagtattttatttatttttttaagcataaaagcaaaaactcctttcgtttcttttaatattaaagagtatatagtatttaactttaattttaaatagtaaaaatgaagttccttaataaataagatgaatatatatatttgaataatttttatggtttgaaaatatataattatcttattaaataggggtcaaaaagtttaaaatccttaaaatgtataattacttcataaaatttaagtatattgcttttaaaaccttaaaataggaatgcttaaatagtttaaggcatagaaaattaaagaaaattgttagtttataatctatgttataatacttaagtatttaaaaaaattttataaaggagtacttaaatgaaaaaaattagatattattttgttcaattgtatccaacctgtcttcatcgatcctgaattatctaagtaataccatgttcctcctacttgttcccatcctactgccattgctccatttggccttaagtagtaccatttgtctcccaattgtatccaacctgttttcattactcctgcattgttaaaataataccatgtttctcctatatatttccatccaggttcagagtatccattaacatttaaataataccattggttatctcttttcatccacataggttcatataatttttttatagagcttttcaatatatcattagatactatatcgttggttgtaaaataaatactaccatatatgttattatgacacctatttaaatttatctgtttatctatctcattagctactttatctttataaactccttgtccaatatacaaatccacattagaattttttacttcatcgctccaccaagacactaaagttctataatctgaaccactttgacctattgtccaatataattgtggaactacataatctatccattcattttctatccacgctctagtgtctgcatatacagaataataactctcattgccatttgtattagatccagttttatcacttgatttatttttccatatacctgatgggcttactccaaattcaacattcttatttatagattttatagtgcttctaacactttttatcatattatttacattttttcttctttgatttgctacatatccatcttttccttgtccttcaggaagtggatatccttgaggataaaaataatcatcgaaatgaattccgtctacagaataattttttactacttccgctaccgtattacatatatgtttttgtacttcttctaattctggattatagtacatagctccattgtaatatataacccaactcggattctttcttgctggatgattactactaagctttgttaaatctgttccttttgttgtaattcgatatggattaaaccaagcatgtaatttcatacctcttttatgagcttcacttatcataaactctaaaggatcatatccaggatttttaccttgtacgcctgtaagtacatctgaccatgggtttatatttgatttgtataaagcatcaccttttggcctaacttgaactactacagtgttaaatccattggcttttagtttatctaatatcgatataaactctttcttttgatgatttacatctccataatttttttcactcggccaatcagtattataaacagtagttatccaagctcctctcatttcataattacttgcaaatgatttaatattaaatatcaaaaatacaaatataaataatgttgtcaaaaactttataattttcataaatccccctacatatttttgtctatatattgcaaaaactacatacatacttgtgtatttttttatagttatcgataatattgcacaataaattatatattattaaactatataatgtcaatttaagtgttaatttgtatataattcaaaataaaataaattctctcaaataagcttaaggtaacgatagatcctattctactttataatatttactattcttaatgatatacaatatatatttattaaaataaaaaacactagaaataatctagtgtttaactttcaattaatttgagcaaatctataagcggagttctgtattagataatcatctttctaggcttattgtcaccaataagctcaagcggcctacctaccggagagtacgagcaatactctttatatcctatcttggccttgctccgggtggggtttacacagccaattagtcacctaattgctggtgagctcttacctcaccttttcatccttaccataaatggcggttattttctgttgcactttccttaagatcgctctcactaggcgttacctagcaccctgctctgtggagctccgactttcctcgtgtagtaaatactacccgcgattatctgacttactcaatattaaatttttaatagtgtaattatgttatcacaatgtatatataatgtcaatttatttttttattcttaaatatatctttacataattatttacattgaaatttttgtatttatttaattattatatccatttggatttaaactttgccatctccatgaatcttcacacatttcatctaatttatatttagcttcccaacctaattcctttttagctttagatgaatctgcataacacatagcaatatctccaggtcttctttctactattttgtatgcaatttcttttccactcgccttactaaaagcattaaccatttctaaaacactatatccattacctgtacctaagttataagttactaatcctgaatttgtttctaacttttctaatgcttttacatgccctatagataaatctacaacatgtatatagtctcttactcctgtcccatcaggagtattataatcatttccaaatacacttaactcttttaatttccctatcgcaactttagttatataaggcattaaattatttggaattccacttggttcttcacctattcttccactcttatgtgcacctactggattaaagtatcttaatatagcaacatttaaagacttatctgccttacatatatctcttaacatatcttctatcataagctttgttttcccataaggatttgtagctgataatgggaaaccttccaatataggacaagtatgtggatctccataaactgtggcagatgagctaaatacaaaatttttaacattatactttctcattgtttctagtaaaactatagtatttattaagttattagagtagtattctaatggtttttcaacagattctccaactgcttttaatgctgcaaagtgtatcactgaatctattttattttccttaaaaacaacttctagtttttctttatcttgtacatctaattcataaaatttaggtctaactccagttaattcttctattctatcaagaactactatattactatttgataaattatcaactataattacttctcgtcctgcttctataagttcaatagtggtatgactacctatatatcctactccaccagttactaaaactgacataaaatcgcctcttttcattttttattttttatgaactatttagctgttttattattctcaactatatttttcatataatccattaatccatcttttaaattatctctttttaatgcaaagtctatagttgcttctaagaatcctagtttatccccaacatcatatcttcttccttcaaaattatatgcatatatagcttcatgttgtgctaaagtttttaatgcatctgtaagctgtatctctccacctttacctggagcttgattttctaatatctcaaatatagcaggagttattatatatcttcctaatatagctatatttgatggagcttcttctacatttggcttttcaaccatatctttgactttatatactctgtcttctatatatttacaatctagtattccatatttatcagtattttccctatctacttcttgtacccctaatatactagttttatattcatcatatgcatctattaattgcttaagacatggagttttagaatcaactatatcatctcctaaaagtactgcaaatggttcatcacctataaaactctttgcacagtgtatagcatgtcctaatccctttggttccttctgtcttatataatgtatattaaccatatttgatatatcttgtaccatttttaacatttcagttttacctttttgttctaactcaagttctaattccacagatttatcaaaatgatcttctatagattttttatttctacctgttattataagtatttcttctattccagaatttatagcttcctctattatgtattgtagtgttggtttatcaactataggaagcatttccttcggctgagatttagtagctggtaaaaatctagtacctaacccagctgctggtataattgcttttttaacagtctttttcattttaatacctctttcttgttaattaatttatataaaaattcctaaatttacttattttatgtaactatagtattttacaacatttccatcaatttgtctgtcgatttttgtcgcatttataaatactatatatctatctattatctttcctaattttataagtttaaatagatataatatttatgttatcatacatataaaatataataaattttatataaaaaataatactatagaatacgaatatgagattttctttgcataggatatatgcactagaaatgattgtttgttgtataactcttataattaaaaatatcttaaaatggtatataaaaaatgtaaaaaaaccgtatctaaatataatttaaataaaattgactatcaataaatctttctacttgcatatatgattttaggaatgatagaacaatctttcaaataaatttaattacataaaaaaagattacgcggctacgtcctactctcccaggcagcttcccaccaagtaccatcggcgctaaagagcttaacttctgtgttcggaatgggaacaggtgtatcctctttgctataataaccacataatctttaatagattaatatctatttagttagagttagtaccctaaaaactgaataacatttactagattaaataatcttggtcaagtcctcgatctattagtatcaataagctacatacattactgtacttccacctttgacgctaaaaatatattgtagtacttataaaatttaattacacttaaattgtatataggtatataattatactctatgtatgtagatattaaagttattattgttattattaaaaatgattttaatttattatttataataataacttttaaatgattaaaattacttactgctatatatacaatagttactcttataaaagatgttattattgcatagtattcatgtaatttaggatataagtaatgtaatgcatttgaaatacatatatctaaaaagaacatagtgtacataagtgacattataaataattcttcttttttattgctcatataagataacaagcaacttaaaacaccaagcatagataaaattgcgataaatatcctaataaaatcggtatttgtcaattcaaatatcgccttaggacttgcaagttctacaagtcttaaaatatatcctccaaatacgaatatcgatattataagtataactattatattaattctttttttttcttttatagtttctaaagtatttgtgtgccccatgttgtttcccctttatttgataatttatatatttaaattataatgtatagtttattaattcccatcatttaatagtattaaaacacttaattttattcattaaacttctttatttattttttaaaatccattttattaacagctcgtgtgtaaactttggcatagatgatgctcttaatctaaaatctttacttgtttttttgtgttttaaaaaacctttgtaataaatttgtttacataatctactactactgaaatatccattaaatcattttttatgtatcccctttttagtttttgtttatatataagtatatattaacataaaaaagtactatctaaaattcagatagtactttaaactaaattaatattctattttaaatcttactttacagatatttttatattatcattttcctcatctactattatagtacatccattatatatatcaccagctattaactttttagctatcatagtctccaatacattgcttatatatctttttaatggtcttgctccataaatcgggtcgtaaccttctttaaccattatgtcttttgcactatctgtaacttcaatttttatatctttatcatgtaatctattttttaaagacttcataaatatatctattatttgcttgattccctctttatctaatggtttaaacattataatatcatcaactctatttaaaaactctggcttaaatcttattttcatttcattcataactaactctttagcttcatcatttatattctcaccagcttctaataagtatgaactacctatatttgaagtcattattattatagtatttttaaaatctactgttttacctttattatcagtaagtcttccatcatctaatatttgaaggaataagttaaatacatcttcatgtgctttttctatctcgtcaaataatattacagaatatggatttcttctaacagcttctgttagttgtccaccttcttcgtatcctacgtatcctggaggtggtcctataagtctagatactgcatgtttttccatatattcagacatgtctattcttattatattttcttcactatcaaataagttgttagctaaagtttttgcaagttctgttttaccaactcctgtaggtcctaagaatataaatgaacctattggcttattctcatctttaagtcctgcacgagcacgaattactgcattacttacagcagttactgcttcatcttgaccaattactcttttgtgaagttcatcttctaattttaataatttttctctttctccttctataagcttagtaactggtattcctgtccatttagcaactatttgagatatttcattttcagtaacttcttcttttaataaagcattttcataactttcactaattttttcttcatgttcttttatttgttcttctaattttggtattataccgtatttaacttctgctgctttattaaaatcatattctctttcatatttttctacattacctttagcttcatcaagattcgcttttaagtttctaatttctaatatttgacttttttctttttcatacttagcagtcatttcatcgttcttagattttaactcagctaattctttacctaagttttcaagtctttgtttacttttctcatcattttctttaagtagtgcttctctttctgtttctaatgttaataactttcttctaacaatatctaattctgtaggaagagaatctatttcacttcttatcatagctccagcttcgtctattaagtctattgctttatctggtaaaaatctatcttgtatatatctatctgaaagttttgctgctgcaactattgcactatcgtgtattcttataccatgatgtatttcaaatctttctttaagaccacgaagtattgatattgtatcacttacgctaggttcttctgccataactggttggaaacgtctttcaagcgctttgtctttttctatatattgtctatattcatcaaatgtagtcgcacctatacagtttagttctcctcttgctagcataggttttattaagttacctgcatccatcgctccatcagtttttccagcgccaactattgtgtgtatctcatctataaatagtattatcttaccttcagaaccttgaacttctttaagtactgcttttaatctttcttcaaattctcctctatatttagctcctgcaattaaagctcccatatctagtgagaatattaccttatcttttaatccttcgggaacatctcctctgactattctttcagctaatccttcaactattgctgttttaccaactccaggctcaccaattaaaacggggttatttttagttcttcttgataaaattcttataactcttcttatttcttcatctcttcctattacaggatctaatttattctttttagctaattctactaagttagtagcatatctttctaatgcttcatatgttccttctgggtcattagtttcaactctttgacttcctctaacctttgataagacatttaaaaagtcatttttatttaaattaaattgtttaaatatttttcctacattagttttagcttctatttccatcattgcaagcataacatgttctacacttatgtatgcatctttaaactccttagatatttcttcagcttttattaatatttcatttacttttcttgtagctgttacaccttgtgagcttattccttcaccatgtatttgtggtaatttatttaattctatatttatactattatttaatgatgctacagatatattcattttttctaatatatttggaataagtccatcttcttgatttacaagtgcacttaataagtggattacatctacttgctgattattgttttttactgctatatcataagcttgatttaagcctttttgtactcttactgtcattttctctatgttcatattaaaatacctccaatattcagttttatgttaactattttaaatagtaaaatttaaaatccatctttgttatcactctcttcgatagagtgctaataatttgttattaataatatatacatatatttacattttgtcaataacatttttttatttttattctttaatattctaatataagtaataatataaattataaaactgactaagtaaatcaagttaatactatataaaaatcattgaatacgatttcacagtatggtaaaatttaaataaaaggatgtgatcatatgcaaaaaattttaattcctattgatggaagtgatagaagtcaaaagtccttagattttgttttaagtaaattttctaaagatatggctaacataaccttaatgagtgttaatgatgttagtttaaccaatttaacaaacccaatgattatagatataaaaataagagaatcacaagaaaaaatagattatatgttaaaaagtttaaaaaataagttatcaggatatgaagtaactacatattctgtatttggtgatgcaggtcaagaaattataaaaaaatcaatagaagataattttgatttaatagttatgactaagtcaacaaagaaaaattttatagattcaataggatctgtaactttatatgtagttaaaaaatcaaaatgtaccgttgttatagtacctgaataaaatttaagttttatattgaattttgactatttttatactttaatccataataaaaccatttcagtccagatttcgtacaatttctaactattatgttataatttcaagtgtagattattgagtatactaagtttatatattatagataattttaaagagttttatcaacatataatattttgttgtaaaatcaattaaatctaattaaacaaagttgcttatttgtattgttctacaatatagttagaaaggtaggtagtattatgagtattttacatgatataggagatttttgtagtgttttaggagcaattgttgtgttatttgtatttattaaaaattttaaaaatttaacttcaatacaaaagttaggaattgcttcacttttattaggtattcttattcctgcttcaattgattttactaatggatttatttctggtttttcttccattgctaatatattgtaaaatcattctggtaataaatcatttatcgaagataataaataaaaagagtaaatataaatttatatttactctttttatttattaaagctccttctattttatcatttggctctgttagacaatttcgttataaataataagtgaaaaaggctagaaacattgaaaatatattaatattataaactaaaatattaagtttatttatttctttttgaatatttcatcactataataccatcttcaacagaataatactgaagagataaatctatcttaggattattttctaagaataactttcttcctttacctaaaatagtaggtattattcctataatatactcatctataatattagctttaacaaagttgtcaactaatctacctccaccgaataagaatatatttttaccttgattttttaaattatttataatctctactatgttaccacttataaaatggtagttttcgtaattatctatttttttagaagttgctatatatacttctttgtctttataatcgttatgaaaaccttggtcatagcaatttttccccataactacaatatcaatatcacctaaaaattctgaatagtcccatttattttttgtatttaatgtattatttccatctccaactatccaatcaaatcctccattttcatctgctatatatccatctaaacttattgctaaatttagtattatttttccgttcatatcataaattctccttttacttattacttgtactatttatatcaatatttaaattaaactcgttactataaagataaataattctactatataagttaatcatttcgtttatattgtataaccttttctaactttattaagtatacataatattcaattattttccaattataaaatagtttcattaaactaaagagtaatgacttatgttaagttaagttaattcaacacttaattgcaagaatttaaaccaagccaagtaatctgagatatacttactagacactccgttaaatatgcaataattgttaatttaattataacagaatttagagcttaacaatatgcacactaaaatagatattttcatggatacttttgaaaatactattgcctaaaagcttatttaaatatatctaataaaaatgcccttagaatccatttatttgaattttaagggcattaaatttattacaaatacatgagtgtttaagttttgaataaaaatttatattgattattttcattaccatttaaaataaaagctccttctattttatcatttaaatcttctaaactatgtatatcttcaatctttatatattcattaatagtagaattagaatctatttcacataaaagatttgcttttttctcaatttcactaaaatataacttatctaaagagatagtaaatttttcatctgacttgttaattatctttaataaaatctgacctttattatttacaaagtctttactaattgcatttatttgtaaattatcctcatcaactaatactacttcttgtggaaatttagatatgttttgagttttttcaatttcagttttatttatttcattattatttaattcatttttttctttagaacaaccacctgcaaaaaacattacaataaaaaaacacataattaatttaattttcatattcatattccttcacttttattaaactttgctataataatcttttaaatattgagttatattttctcttatttctttatgcttattttcatcataaagtttttcacagtcaaaccaattagactcatcatataaccatactggctttttctttcgttcttcactttcccactcataacgaggaaaaacatgtccatgcaaaaatttatctgtatttcctaaaatgtcataattaactctaattggattacaaactttaataattgcatcacctaagatactcatatcaagtaaaaaagcttctctttcttctaaagttaaatcatttaaagaaaatacattctttttaggtaataaaacgcaatatccaggtaaaaattgtgtatctccaaaaactgcatatcccccatttgtttcaatcattagcattggattagtaccatttttcgctgattcaattctattttttcgccaatcctccatatcccaatccccctttaaaatttaattacttttatgtaattatatattacttttaactatgctataaagtaaattttaataattagttatattttagtgcgtaaattacatgctttactccaaattcaaaaggtaaatttatatatttgttataatataaaagacattaaaggaggaactcatatgaaaaaaacaggtttatttccagaaagaaatgtaaagcaaattattaaagattttattgatgcaatacttcaattgctataaaaagcatgtataggaagtttaaaatattgattatgttctaggagggatgcaatgaattttggagaaaaattaaaatcattaagaataaagcatgaactttcacaagaaaatttagcagaaaaacttaatgtatcaaggcaagctattactaaatgggaaactcaaaatagtatgcctgatattgaaaatttaaaatcaattgctacaatatttgatgtaaccacagattcattgatttatgatgaagaagaaattgaaacaactgacgacagtttctgttggcaagtcgcatgtatatttggtggaattggtttagtatcagaatttttatttgaagatatagaaccaagtttaagtttatctggaattggattagcagttataggatatctagtagctaaatgttttttgctattcaaagctaaatgttaataaccatgaaattaattttaaaataaggctatgttaaataattatgtgataataaatcttaaaatttagtaatttcaatacatcaatattgagaacccacattaatatatgagacagttgctatttatgaatcaattatcacaaagttagctaacatagcctaaacttaaaaaggaatttaacttaaattttcaatttgtatttcgctaagtgcattaggtaatggtgtatctattttaggattttcaaatatgtttggtagaggcatattaaactgatggctttgtgactgattttgtgtattgttctgagttgtctttgttttagtatcttcaaggttttgtgttttagttaaatcgaaattctttattatacatgttgttaaaatcaaaaacataaatagtattttaataatacctatcctttctttcatatcaacttaacctcctttctaatattcattataactaagtttaattaatttaagtatatgttttaaggtgtataacaatctatattttaaattcacattcaattttttagttgtgggtggatatgacttgtgcgaatttgtaaaaaaagtaacatcttcaccaattttaccatcaagaaaatattatatcattactttaagagggtatagcatttcactatacccccttttcccttaacattaaatacttttttaattttaaccatatctattaaaattcaaataagtctatttatactttaaaatccttagcaatatattattaatataaataaaaaggtggtgatcttttgtatctgctttttaaatcccttcttttttaaattttaaaaaagaagggtggtcaaaatatgaaaataaataaattagcaattccattaatgttaaacaatattacttctatggttattacattatgcgaccaagctatgattgggagaacttatatggaaggttttgcatctgtcggtataataggtaacaatatatatgaaataacaggagtactaggagctatttccataggcttaaatatagtaggttctagggcaaaaggtaaaaatgatattgaaaatttaaacaatagcttatgctctaatttattaaatagcttaataattggagttatttttacgactttatcattaatatttggtaaatctgtattacaaaatatatttaatttaaaagacaatacattaatagactctgtaaaatatttaaatatttttagtttatccttaggaataaatttgattatatttaacttatcatcttattttaaaataataggagaaacaaaatttatactttatggaggcataatttcttgtacttcaaatgttttacttgattatatacttatatttggaaaattaggatttccagcattaggtataaaaggcaatgctataggatcagttctatcactaattttatgtgtattatattacttaatagtaattaaaaaattcaaattaattaaaaaaactaaaataaaattatttaaaaataccaaagaaatattttcaatatctattcctataatgttacaagaatttatagaatcagcactattagtatttgtaatgacctatattttagctcaaataggtttactagaagtagctgtttataacttactttttaatattataaatatagccttaatgcctatgtatgcttatgggcaagtatcattaactttggtaagcgaagaatttggtgcaaataatataagtaaaatacaaactattattaactcttgtattaaaagacctatgtatatttatataattttttgctcaatcataataatttttaaaaattctattcctaaaattttaaccaatgattatgatgttatatcaatgtcttcaaaatatatgtttattttagtaattgctaattttatgaatataccaaagacaattttaacttatagtcttcaagctcttaataaagagaaattagtatttgcatattcatctatctaagttcttttttatagatttcatttgtatttgctttaatatcttcatatattatcttatcacttagcttaaatatatttaaatctctatttgattttttaattaagatttctgcattattaaaaaacaccttacaacccccttctaagcttccttataattatatttatttttaataatttactttattcatattttagacaaaatctatttataacaagtaacatatctataaataaatcatatatttaattaaagagaaaaacaaaagcttctcttaataaatacaggaaaggatatataaaatggaagaaaataagactactagagtaaatagaactgttaattattattctgatagacctatgtatgatcattatccagaaagacctaaatatgatcattgcccagaaagaccagaatatgattactatccagaaagacctaaatatgatcatcgtcctgtaaaaccagaatatgatcattgcccagaaagacctatgtatgatcattatccagaaagacctaaacatgatcattacccagaaagacctaaacatgattatcatgatgaaagacctaaacatgatcattatccagaaagacctaaacatgataattactcagaaagacctgaccatgactgccatgatgaaagacctaaacatgactgccatgatgaaaaacatgaacatgactgccgtgatgaaaaatgcaaatcaaattgttcttgttgcccagagaaaacaacgctaacatcaaacggatgtacaaaatgttgtaaccctatggatattcattgtccagatatccactgtgcagtatgtacacctatattagcagataaaatacacgcatttgcatgtactaaacaatctatatctcaatcaaaccctgcattatttactataaataatccaccaacaggtggttttccagtaggttcaagagtatgtataaataaaattgctgtaagatttacttgtgctggaattactactgatcctttacctataaatatatgttcatttactggatcacttccaccaagaacttcaccatcatgttcagctaatttatttaatagctacgaaggaacaataacatcaaacttcctttgccatgataaaggaacatgtgctacttttgctcataatgacttagatgttactcttattggtgctcaatacgtagttgaaggttttataggtagtgtaccttttacagctagtactgtagtatttggtccacgtatttataatgatatcaatttatttggtaacatctgcttacctaaatctaaggacgaattaactttaagagcaaactttgaatttaaattcatagctaaacaaataacaccatcagcagcaggtatactagctggaggaacaactttcgatgctactatacttgacatattatcaattagtgaaaaactattctctataaaacaagaagaattagttgtatattcatcacctgatggatttaagcgtcgcgaagaataagtttaatttataaagtgataaaacatttaatcaaactaatgtaaatttataaaaatgagttcattttaaataaatgaactctttttatttttataattatctatattactgtttgtaataatctattcttaattcacataaatataaatataataattatttattctaggaggttttatatatggatgctatacagcctaaccctacatcaataatagatatctttagtgtagtagaggagatagtttatgattcttcaaataaaaacgatatttatgtacctatatctattacaactgaagatggatttgttaatacagttgtaatatcaaactcaaaagaagataattnnnnnnnnnntaaataaaaatataatactttataaaaataaagcaataaatttaaataaaatagtaaaaataaaaatacttacagacaatataaatttaaacaaatttaaagatttgttatcaaggagattaagaaatttagctaattataattataacgatcaaatttctttttctagaaaaagaagagtccaaaattttaatacttttactaatgactttagtagaaacgataatcttcaagattatataataaaaaatatggaaaatattaaaactataaattataacaaaccttcaggtagctacatatcaccaaacctatcaaaagaagatattttaaactcaagcacaaacttatatgtaaataaaaaggacgttttagaagatgttaacttagatacagataaactagatgttgtaagttttattgaaaaaaatactcaaaatgtattaactgaaattgaaactgaagaaaaattagtacttactaacaattctgaagaagtggaagtttcaaaacctatatataccgaagatataaatgtattaactaatttagaaataaaagattatcctatatcaacaagtcagatacctgcacaagcgataggtgatataagtcaaaacaaaatagaagccattacaaatataaatccccagtacctagaaaatactatatcaaatatagatattcaaagacaaattataccacctaaaactgtagaagtactagatttagctcctgtaaatagatttataaataaacatgaattagatggaagacttcttagacttgatcccactggagaaaactatataggtgtttttttagatgatggaacttttgaaccgctaagattaacatttaaaacatttagtgtaattcctgaagatacaattaatatagtcggaaatatatatagatcacatctaaaaaattcgttatcagatatggatatatctaaagatacattaataaaatctttagatatagattacaacaatgatttagtaaaatatcaatctgaaaatatgctccctttaagtgactttataattcaacataaatctataattaaaaatataactaatgaagctgaaactgcatctgtagtttcaaaaaattcatatgaaactattaacagtataaaaaatgtaaaacatagcactatagaaaatattagtgatataaaaatgagtcctgttgttaactctaccgaacttgtaaaaagtaatcaccaagttatagaaaatattaatttagataaaaacacttctagtgtagttaaagatatagacctaaataataaagatatcaattctttaaaatcagaagatattaatggagttatagaatttactggtaatggtttaatggttgtaagtgataatgattcagatatagtaatttactctataccaaaaataaactctgttaattaaagtttaaatcaattaaataaggaccatctaagatggtccttatttatcttttttgttaagatatttttcttttaaagttaatattctatatacactttcatcaattctatcttctgttatattattattttttacagccaattttattttttctataacagatttagtaatatctatatcacttccaattaatattatatcacttcctgcattgatagatttaacactagcttcttctatagataaattattacttatagccttcatatgcatatcatcagttataactactcctttaaagttcatcttctctctaagcaatttatatataatatttttagataaggtcgcaggatttttactatctattttttcaactaatatatgagataccataattgcatcacagcctttatctattgcttctttaaaaggaactaattcaaagttttcaagttgttttaaacttttatttacaactggaaggtcaaaatgtgaatctatatctgtatcaccatgtcctgggaaatgtttaactacaggtattactccttctctttttaatccattcatagtggctatgcccatagctgaaactatcttttcatcagttccaaaagctctatcccctataacagtgtttttaggattgctatatatatcaattacaggtgcaaaatccatatttatattatgttcttttaaagttcttcctaaattcataccgttttcatatgcatagttagtatcacctttatctcctatatcttttgcacttttaaacttagttgtatcatttggaaggcgacttactcttcctccttcttcatcggttgatataaataaaggtatatttttatttatattatttatatcttcggttaactttttcaattgatttgaattttctatattacgagaaaaaagtataataccccctacatctaaatcatttactaatgtattaatttcctcatttaacttttttccattaaatcctgctattatcatttgacctattttttcttcaaggctcattttacttatcttatcttttatatctgatactactcctattatcaaactattttctttcatttcaataatcacgcttctttcatcttttgttaaagtatataaaactttatttaaaaaatgcttaacatcaataactttccatccatcattttttaatttttctatatataaagaagtttttctataactcttatctataccttttattctatagccaatactaactttaacattatcattagttaacttataatttcgtttttttgcattagttggaatagctaattcttttattatactacaagatttatatcctctatctaaatcatataaatttgaaaaacctaaataatcttgtattatagttgtaaatattataactattgaaaaagctattataaatatatatatgatataatgatttgatagagaggagggaacttcttatggaaattgtcaaagattatttagaaaaattatgtataaataataatattttaaataaacaattagcagatgtaaacataagtaaagtaacatattttaaagaagaaaaattaatatatatatatttaagttctaaaaatataataagttacgattatatagagatattaagacaagagttaaaagaaaagctagattattttaatgatgtcaaaattaagataaggtatataaaattagaaaagcaaaaaacaaaagacattataaaaaaatactgggtaaatataatatatattttaacaacactatgtccttcgctaaatggatggataaaaaatgttgagtatatgtgtatagatgaaactttaaaaataaaattgccatcagatcttttttacaaaagattgataaaacaaaatgctgtacaggtattaaaaaatgtattgagtgaagaagctggattggatattgatattatatttgagaagtcagtaagcaaaggacctaatgtagaaaaacttattaagaaaaatgataatttaattgaagaaatggtaaaagaaagaatagctgaatctataaatgtagaagatgaagaaaaggaagttgaaggcaatcaagcaatagaaattgcaattaaagatgaatatatttatggagataatgtaaatgctccagttgaaaaaataaatagattaaatcaaaattctggaactgtgtgtatagtaggagaagtatttgatgttgagttaaaagaattaagaaatggaaaagttcttttaattgcagcagttacagattatacaagttcaattagttgtaaattatttttaaatgatatgaataaagataaggttatagattctgtaactaaaggagcttatttaaaaataaaaggagacgcactttacgataattaccaaagagaaattacaatgacaataagtggtataaaaaaagaagtaaaagaagaacgaatagatacttcagatgtaaagagagtggaactccatgctcatacacaaatgtcttcaatggatgctgtatgctcaacaaaaaaattagttgaaagagcagctaaatggggacaccctgcaatagcaataactgatcatggtgtagttcaagcatttccagaagctatggatgcagctaaaaaacatggtatcaaggttatatatggagtagaaggctatttggtggaagatgaattaccgataataaaagaccctaatgataaggatttatctcaaagttttatagtatttgatattgaaacaacaggattttcaaatacaaatgataagataacagaaataggtgcagtaaaaatagaaaacttcaaagtagttgataggtttagtgagttaataaatcctgaagctgatatatcatataaaattcaagagttaacaggtataactaatgatatggtagctgacaaacctactatagaggaaatattacctaagtttttagaatttgtaggtgatagtgttttagttgctcataatgcggattttgatatggggtttatatctcaaaaaagtagagaacaaggattagaatttaaaaataaaagtatagatacattaacactagctagagtacttttaccacatttaaaaagacataggttaaatgtgatagcaaaagatctaggaataccacttttaaatcaccatagggcagtcgatgatgctgaagctacagctcatatatttataaagtttttagaaatgcttcaaaaacaaggagtagaaaaattaagtgatgtaaatgaaaagctaggtggattagattataccaagatagcaacaaatcatataacattactcgcaaaagattatactggtcttaaaaatctttataaaattgtttcagatgctcatgtaaatcatttttatagagctccaaggatattaagaagcgtattagaaaagcatagagaagggctgataattgggtcagcttgtgaagcaggacaagttttcaatgcagtaaagaagaatttacctgatgaagaaatggaaaaggtaatagagttatatgattatatagaagttatgccgatagataacaatagatttatgattgaaaaaggcgaagttaaagatgaagaagaattaagggatttaaatagaagattaatagaagtagcaaagaagtttggtaaaataccagtagctacaggagatgttcactttttagataaacatgaagccgtacttagaaaggtacttaaaaattctcaaggatttaaggttgacgaagaagaaacttatcttcattttagaactacaaatgaaatgttagatgaatttagttacttagatcctgttgaggcttatgaagttgtaatagctaactcaaataagatagctgatatggttgaggttataaaacctatacctgatgacacatatccaccagtaattgaaggatcggatgttgaacttagagaaatgtgttatgcaaaggctaaaagaatatacggtgatccaatgccggaggttgttaaagcaagacttgatagagagcttaattctataataggtaatggatatgcagttatgtatataatatctcaaaaactagttacaaaatctttaagagatggatatctagttggatctagagggtccgtaggttcttcttttgcagctactatgagtgatataacagaagttaaccctctgcctgcacattatatatgtgaaaatgaagaatgtaaatattcttatttttatgaaataggtgaatggggatcaggtgctgacttaccagataaagattgtccaaaatgtggaagaccattaaaaaaagatggacatgatataccatttgaggttttcttaggatttgaaggagataaagagccagatatagaccttaacttctcgggagaatatcaaccggtgattcataaatatacagaagaactatttggagaaggatatgtttatagagcgggtacaataggtacagttgcagaaaaaacagcctttggatatgctaaaaagtatatagaagaaaataatataaacacaacatcatcagaagcattaagacttgctaatggatgtactggagtaaaaagaacatcaggacaacatccaggaggagttatggttgtaccacattataaagatatttatgattttacacctatacaatatcctgctaatgatacttcttgtggagttataacgactcactttgactatcactctataagtggtagaatactaaagcttgatatactagggcacgatgtgccgaccatcataagaatgcttgaagatataactggaatagatgcaacaactatacctttagatgataaagagacaatgtccttgtttacatcaacagatgcactaggggttacgccggaagaaataaactgtcctataggatcacttgcaatacctgagtttggtacaaagtttgttagacagatgttacttgatacaaaacctacaacatttgcagaacttgttcgtatatctggactttctcatggtactgatgtttggttaaacaatgcacaagaacttgtacaaaaagaaatagttggacttaaagatgttatatcaactcgtgatgatataatgaactaccttatatttaaaggtctaccgcctaaaatggcctttactataatggaaagtgttagaaaaggtaggggattaaaaccagaacatatagaagaaatggaaaaaaatgatgttcctaaatggtatatatggtcttgtcaacaaataaagtacatgttccctaaagcacatgcggttgcatatgttatgatgtcttttagacttgcatattgcaaagttcattatccagaggctttttacgcaacttactttacgactaaagctgaagattttgatgcagatttaattgtaaagggattacctgcaataaaagcaaaaattaaagaaattgaagaacttggaaatgatgcaacaacaaaagaaaaaaatatgctaactgttttggaagttgcacttgagatgtatgcaagggatataaaaataattcccgttgatatatataaatcagatgcaaagaaatttcaggttgtaggagaaaaaacattgcttcctcctatgatagcactacaaggagttggagagaatgcagctataaatatacaaaaagaaagagaaaatggggagtttatttctaaagaagatttgagaaaaagaactaaaatatctaaaactgtaatagagacacttactaatcacgggtcacttgaaaatatgagtgacgaaaatcaattatctttattttagttaataaaaatttaaatcactaagtttataacttttaattaaaagttataaacttagtacaaaaatatagggggaggtttatattagaaatttaaaattaaaatttaataaggaaatgttagtatcgattattattgttattactatgattatagattcaacagtatttacatctatgcaaagagaagtaccatttaaattaatatcgtcaatattagtattaattgatataatcctaatattattttgtaattttatttcaaagagaatacagctactaattgctctaataattgcatattttcatgcacgtaaaattcatttaaagaatccattccgctcatatttttctcctttattaattaaacataataaattcaatttttaaaaatggaagcataaaagcttccatttttatcataatttaataatataaaattattttattattagaattcattcatgttaaaataatttttttcgtcattattaaagtttatatgctttttagaactatttatatcttttagtttaaagttttcaataagtgatttaagcatctgagcttgtccacttaactcttcactagcagcagcactttcttctgatgttgcagagttagtttgtactacttctgagatttgttctattcctaatgtaatttggttaattgcactagcttgttcttcagatgcttttgctattgcttcaactactacagtagtttgtttagttgcatctattattttttctaatgacttagctgtattatctacaatttcagttcccttatcaactgcttctattgaatttacaataagtgtagatgtattcttagcagcttctgctgatttagcagcaagatttcttacttcatcagcaacaacagcaaatcccttaccagctgaacctgcacgtgcagcttctactgcagcatttaatgctaatatatttgtttggaatgctatatcatctattgtctttataattctacttatttcgttagaagtaaatgaaatttcttccattgccttaaccatttgtttcatttgctcgttaccatctttaacttgacgacctgattctagtgttaattcattagcttcttgagcattttctgcagtacctttaatcttgtcagatacttccattatagttgcagataattcttgaattgcacttgcttgttcagtagcaccttgtgataacatttgtgatccacttgcaacttgatcagatgctgctcctacttcttctgaagctacatttatttgtgacattgtttcacttaagtcatgagttattttatttattgatttctcaatatctttaaatactcctatatattccatttcagttgaaacatcaaagttgcctgaagcaacttcgtttaaaacgtaaactgcatcatttataagttctttagtcttgctactcatttgacgcatactatctgataaagaccctaattcatcttttgactcatattcaatattaatatcgaaatcaccttcagccattttattcgctgcttcttctatttcttcaattggttgttttaatttctttgtaacatataaacatataactacacctgctaaaatattaaatatactaattgccacagaagcaaaagttgcagttgaaattgtatcttctactcctttattaaattcagctcctctttcatctgctgatttattaagctttatagcatcatctatacattggtcatatgccttactgtatgcagtattttcacttgccatttctattgcacctttatagtttccttgttctattactgcataaacatttagagcttcttgttcaaaattacctatagacttttcaagattatcaactaatgacatatctcccttataagtacttctaacttttttaagattttcatatgcaccttcaaaatctcttgtaacaatacctttatattttgcaggattcgtgtataacattgcatttccaacatttctctcagctgaaactaaatctctacgaatttccatagttttatttgtttgtgaataaggtctacgatataattcatgacttaattctcctgcttcttttaattttgatactgtataaaaacttgtacacatcgaaattatcagtaaaattccaaaagctaaagttagctttctacctattttcaaattattcatattcattcctccttacaatctttcattatatttgcctgcatcgtacaataaaatttttaatatttaggtaaccgcactatatttggtttaatgtcttaatataaataaacattaattttagcagttttaataaaggcatattttttagtatttatagtttatatattaaaattacatataacgtatcatattcgacaaatttcgatataactttagacatttttttaatttaattcaattaatatttctaaaatttaaatttacatattgatataatatctataattaaaaatatttttttattttctataaatcgtatttaatttaactatgttattttcacgatttcaattttaccaatcattttatttacttcattttttatacggataaatgtatatatactttagattttgtatctatataattttattttaagttttttatttataaacattataaaaatgtaaactcttaaaatttactattcttgtatttaattaatattttttataatatattttaaaaataaaaaatgaaggtggttaaaacaccttcattttttatttttaaattctactgtatatttaattatttatattcaaagttaattaaagtttagataaggcagagataataatttcttctttaaatggcttaactataaatccttttgctccataaataatagcttctttcattctagcctcttgacctaatgctgataccattacaattgatgcagctgggtcaattttttttatctctcttaatgcctctagtccatccatttctggcatagtgatatccattgttacaacttctggttgtaattcttgatatttctcaatagccatcacaccattttctgcttctccaactacctcaaatccattttcttcaagcatcttacgaatagacatacgcataaatgctgcatcatcaactattaatactcttttcataacacttcctccattttcattacttcctatataataatagttttatatttttagcatctatttttaaattagattaactttcagacattttagttttaaatattgtgttgatttaaataatttatttcttttttaaattattaatccttgacgttttataatcaatactaatcatcttttagtcaagattttccttttaaatgtctatttcattattatacataaaactgtttaatcgtaaaagtatttattaattaatttcattattcatatcttctactatctccattaatgagtcgcaatctaacattagttgaacttcattatttatttcactaacacattttataaaattttgattacattcttctttatttgagttcatattcatgctttgttctggtgaaatattaataacttcatttacagcatcaactattaatcctatcttttcgttattattttcaattataataatacaagtcctttcattatattcaattggttcaatatcaaatctcatcctagcatccataacaggaataatagtacttcttaaatttataattcctttcatatacttaggaataaatggaacctttgtaataggtaacatttcaataatttctataatatattttgatgataatgcatacttttgattatttataataaataccatatacaaatcatctattttggcttttattatttcatcatttgcactcacaaatagtacaccatccttttaaatagcttttctcaatacctttattctaaaaattataaattactaaatttataacaaaatttaaatatacttataattttttatattaatcattaaatcctaatgaagataataacttcttacatgattcaaccttaggaataaagtaatattttccttcaatttctttatctaaagtgaaaaagtctgtttcaatacataaaattgaatcagatactggtccatataatgacataggtaaattcataattgccataaccatatctacactaaaatatggaattgatggatttatagttaaatttgtcatatcagatattgctgttaaatatgttccacaaagtatattacaaatttctcctattgaacttaattctttacaaactgaatcataatcatttatatcacatgtaatttcttttcctgtaatctttgataataaatttagtgctgaattaactttcataataaccataataaatccttccatatcttcagaaagttgtaaaaccgttccaacaactaactcttctggagatttataactattagttatatctgaaaatttaatcatatcacttttaggaattcctatatctactatttcatttaacattatagctaatgaagatgatgcatttcctgaacctatattactaatttcacgaaatacattcaatttatcacactcaaatttcatatatacctactttccatctactacttagattttactgttgattgtattttctttaatttatttgaccataaattaaaaataatttacttagttataattgcatttacatcaaatattaagcttatagaaccatcttctaaaatagaacatcccgatatgtaagaatgtaccttttcaaactgtgttaataatgcaggtactggtttaattacaacttgttgttgaccgataatactatctacaataatacatacacttcccatttcagattcaactaatatcactactttttaaatatagtttataaattaacaactaatggacaatttaatttatccatcaaattataattattatattcatattttttcattttctatattacaaacttctatcaaagttttattttcccataaattaaatttattatatcataaaaggaaattgtctaaaaacttccttttatgatattaacttttattattataaataaaatccatatgttttatcttaaaattaaattataatttagataatgcagatataataatctcctctttaaaaggcttaactataaatccttttgctccatatataatggcttctttcattctagcttcttgacctaatgctgataccattacaactgatgcagttggatctatctttttaatttctcttaatgcttctaatccgtccatctctggcatagtaatgtccattgttacaacttctggttgtaactcttgatacttttcaattgccattacaccattttcagcttctcccacaacctcaaatccattttcttcaagcatcttacgaatagacatacgcataaatgctgcatcatcaactattaatactcttttcataaaatttcctccatttatatcaattataatctttttctatatactgatggtcttacacgttcaaaatttgtttctagattagataaattttcagacattccaattattaaatatccacctggcttaagtgattcatatagtttacgtgataatttttgctttgtaggattgtcaaaatatatcataacatttctacaaaaaatgacatcgtacttatgtttatcccaacctatactattatttaggttaaaatatttaaattcaactaaattttttatactgtcactaataacataatttctttcatttattttcttaaagaaatttttaacccatacctcaggtaatttagatatcttatcttgtgaataaattcctgcctttgcttgtcttaatacattattagaaatgtctgatgctgttatagacacttttaattttgaatttctaccaaaaatagatgctactaacattgctatacaatatggttcttctcctgtcgatgaagctgcagaccaaatttttaagttacccatttttgaatttttaaaatgaggtattagtacttcatcttttaaaaattcaaaatgttgttcttcacgcataaaataagtaaaattagttgttaacttttctactaaagctgatgctttttctcctgtcttatctagcatcagactatctatataactcttaaaatcagcaaatcctagcctctttaccattaataataatcgtgtctcaattaaggttcttttattttcaagatttataccataattattatacataaagttttttaatcgcacaaagtctttatttgttaatttcattattcatatcctctacaatttccattaatgaatcgcagtctaatattagctgaacctcattatttatttcactaacacactttataaaattttgcttgcaatcttctttatttgaattcatattcatacttttatcaggtgaaatactaacaacttcgtttacagcatcaacaattaatccaatcttttctttatttttttcaattataataatgcaagttctttcattatattcaataggttccatatcaaatcttattctagcatccataacaggaataatattacttcttaagtttataattcccttcatatacttaggaagaaacggaacttttgttataggtaatatttcaataatctctataatatattttgatgataatgcatattttttatcatttataataaataccatatacaaatcatctatcttagcctctattacttcatcgtttgtattcacaaataacccaccatccttttaaataaatttttcactttttccaacgcttttgatgcgaagtttatttgtaacagtgtcaaatataatagttctaccacaagaacctaatacatcttcagaaacaatagaaatatgtaatttcgctagtgtttctttgcatgcttttacatttttttctccaatagtgcatatactacttcctgtatttttaaaattaaacatgtgtgcaccaccagctaactttgctcgtataagtctaggatttgcaccagcttttttcatttcttcatataacaaagtaataccagtgtctgcatattttgctttatttgatatactcttttcactttttgaatctgaaagtagaatatgaaccaatccagctattttatttatctcatcataaagtactactccacagcaagaccctaatccaattgtcataatttgattaggtgcctttacaatattaaactctgctatacctacagttatatttttcattagttcttctcctaatcatcaaatcctagtgaagataataattttttacatgactctaccttaggaataaagtaatattttccttcaatttctttatctaaagtgaaaaagtctgtttcaatacataaaattgaatcagataccggtccatataatgacataggtaaattcataattgccattaccatatccacactaaagtatggaattgatggatttatagttaaatttgtcatatctgatattgcagttaagtatgttccacaaagtatattacaaatttctcctattgaacttaattcttcacatactgaatcataatcatctctatcacatgtaatttcttttcctgtaatttttgataataggttaagtgctgaatcaactttcataataaccataataaatccttccatatcttctgaaagttgtaaaactgttcctacaactaactcttctggtgaattatagctattagttatatctgaaaacttaatcatatcacttttaggaattcctatatccactatctcatttaacattatagctaatgaagatgatgcatttcctgaacctatattactaatttcacgaaatacatttaatttatcacactcaaatttcatatatacctactttccatctactacttagattttactgttgattgtctcttttttaattggtttaatattacatttggaatcatatctaaagaagtttcttttaaaactgccccaagatttttagcagccattggcattccataaacaacacatgaatgtctattttgaccaatagtatatcctcctgctgtctttatatctaataatcctttagctccatcagaacccatcccagttaaaataacacctatagcattttcttttgctacatttgctacagatttaaatagataatctactgaaggacaatgaccactaactttctctccttctttaatttctagtacatatttattgtttttctttgcaatacccatttgtaaagcccctggtgctatatatgcatatccacttaatatttcatcaccatctttaccttcaaccacatttattaagcactctttgtttaaacgttctgcataccttttagtaaatactggtggcatatgttgagtaactacaattccaggtaatcctaaaggtaattgttttaatattttcccaacagcttcgacaccacccatagatgccccaattgcaattatttctttaccattttttatatttatattagaatttctagctatactcttattcgttgtagtgcaatcagcttgtaaagaattatttttagaaaacttcttatctaatttagcgatggaagcttcttttattttatatgctaaatcattagagaaatcattcattgtctttgtatctggtttcccaacaaatccaacagctccagcacttatagcttcaaaacacctaccattagcaccactaatgacaatagttggaataggacactgctccattagtatctttaaaaactcaattccattcatacctggcatttcaatatctaaagttaatacatctggtctagactgtattattttatctctagcctcatatggatctctcgctgttccaacaacttctaagtctggatcttcttgaagatactttgcgataatacggcgaaacataatagaatcatcaactactaatacttttatcttcttatttttttccatagacttcctctccttttgaatatctatactatattacttcagaaatcctaactatttttcagcaatttttatagctttgtctatagtaattatgcctatgatattatcttaaatttatttattaatttataattgcatttacatcaaatattagacttatagaaccatcttctaaaatagagcatcccgatatgtaagaatgcaccttttcaaactgtgttaataatgtaggtactggtttaattacaacttgttgttgaccaataatactatctacaataatacatacacttcccatttcagattcaactaatatcatattccgtatatacaattgctaactatatgattatgaatatcttcaattttcaattcatatttataactttcaaagatttcatataaaatatcatatacctctagtaaaaaattaccacatccacatgacagatctaaaattttaggatacggatttttcataaaatcatgattatataaagtttttttaactatataatctataatatattttggtgtgtnnnnnnnnttttggtgtgtaataaatgcctaaagattttttattttcttctgttaaactattttcatataaactagataaataataattattactcgaaatctccatactaatccccctaatgaataccttttcataagtttaattatatcaaatattacttaatataatctatattatctccacttttcaccaatccaacttaaaatactctctatatcacaactttcacctatgtctaataatttatctattgatttgtaatcatctaaacctatttttatatctattttaggattaagtcttatgtaattctcatctaataacttactagtacatgattggctaaatttagaattgccttctaatactagtgccactattgggtgtgatggatttttgtttaatatccagtcaatagctccccaatttggattaccaacatctaagtagttataagtatatcctgtacctatagataataactttatattttttaactctcttgctaatccatcatctaatgcatgtactaaacatgctaaacttggatcatttgcaataatacctccatctatatgatttttataaataggaaaatatataggtgctgcactactagatagcataacatcaattactttactatttgctgtgcttgatccaggtatattactataaaatataggttcccagttattttttttatcgcctaaataaaatgtgggtataacaacaaattttgataaatcttttaaagttaaatctttaggaaatatgttttccaatacttcttttagcttcttattattatatttactccttataatttccggataagattttgaaaatatatactctaacccctctcctgtgtatatattcattatttccataggagataatccgtgtgcaagacctatagcaataaaacttcctgtagatgtccctcccattaaactagttttttcaataagtgttgggtaatggtcttttaatctatttaataacgatatgcttaatgcacctcttactccacctccatcaaaagtcattatattaaaactattaattccttcaaacataaatttcctcctagcttcactttatactaaatctattaatataatttatatgtaaaactaaaaaaagaaagtatataagatttatatacttcctttttcctatttatgtttagagtctatataacttaaaattccttgtgctataccctctgccattttattttgataactttgactttttaaatttttttcatctttttcattagttaagaatccaacttcgactaatgctgttggcatatctgtactttttaatattccaacatttgaagggtatatacccctattttttgtatttaaatataaacatattgtatcttgtattgattttgctaatttatcagaatcattaattccattttgaggatagtaagtttcagttccattagctgaacttgcaccattttgcgcattttgatgtatagaaactactaagtctatattctgtgaatttgccatgtcagttctttcttctagtgatacatttgtatcttcacttctagttaaaataacttctaaatctttttgttgagatagtactccagctacttttttagctatttctaatgagatatctttttctaagcttccactaaaaccttttgagccagtatcactgcctccatgtcctggatctattagtattttaatttttttatttgatttttcattttctaaactcaaatgctcaatttcaatattttgctgagttttatcttttacattattcttatcatcaaccttattgtcttttgcattaccaaatacatttttaactaaaaatgatattgaaaatatacctattaatactaaaagtgctaaaataaataatctagatttttttattcttcttttttttataatttttcttttcttagacatatattcacccttctaaactataatccagcttaattctagcatttttttactatattttcaatatttctagtattatccacctaaagttatatcttgtttattgtaccaatctatagcctcgtgaatatggttatttttaaaatctggccaatactcatctaaaacataaaaatctgcatatatagattgtacaggtaaaaatccacttaatctccttcttccaccccatcttattattaaatccagccttgaaacatcaaaagattgtatgtactcatgtatattatttttattattgcccttagcagttgataatgtatttaaatcccaatgccatccataatttactaataaatttgcttttatttgaccttttttaggctctattctttgcgtatatggtcttaactcatctggaaacataggcgaatttgtatttcctattactaataatgatgccccttcatctactaacattttagcagcatttacacatgcatcagtaaatgctttagtctgatatgatggtcttttagtattatctgtagtgaatccataaaatgtaacttcttctacacctatatctctacaaactctataagcttcaagacctgggtctaatccactatcataacctctttctttcgtaaggcctttagattgtgcccatctcctattcccatctggaattattcctacatgttttggtattctcattataatcacctctttccatatgattattcccatcagataagtttttacacaatattcagtatattattattaatttctttatatttttttgaaaaacttttaaatttcgatataagattataattactaaatatgctattgaatataaatcaattttcagatcaatattataaaagaaaatagagatacatttgattattgtaagcatgttatcaaagaattagataaactagtaaaagattctgttaaaataagtagtaggtatttcaaaaattttaaaggaaaatcatattttaaagattacgccaatgaattaacttcttctgctaaattccctattctattagttggtggaaatagaacagtagattcgataactgaaactctaaatactactaatattgaacatttctcaatatgtagaccattaatatgtgaacctgattttattaataaatttgaagttgaatcaaattttgggcatacatgaaacattatttttttaagttcatttaaaaagatgagtccaaagtagactcatctttttttattgatagtatccaaatatttttatatattttctctctcctattttttcactcaagggataatctaataaatcttctgtatgttgacatataaggtaatctaataagtaatttctatcatctaatataacctgtgtaactatcatagtatgataagctcttccctgatatactaactgtattaaatctccaatttctaattgattataatctacaacttctgcatatattccataattttgtgttaattcactgttattttttataatatatcttccaaatgcatctgctgctgtccatgatggtgttctacttgaatcactataccaataccattttcccataacatcgtttccttgattatcaaagggaatattacctgcatgtatacactgagatatatagtttgtacagtctcctccccatggatcataatctttatatttaggatttctgtataatgcccatgttcttgcatattctgctgctgcttttctattatattctttaagttctttcattaagtcaccccactaaatattttcttgtatactcacttagaaattcttttatttctccaaagtataattttacatttgttatttcattagaatttaatatttcataagatgaaaagtttatggatatatattttgaagttatataaaaagataggtcacaagttatatattggggcaattcttttatttgattttttatactgctttttataagtttttcatagttacattttttattgaaaatatcttctattaatatttttttttcatttttaagatcataattatatgtgtttatataattaattatatgattatttttgtatatttccgaaaatactatggatatgcttattatatatttaaattatttataattaaactcattatataattacctattttgctatctttttacttaacattttaataaacaatatattttgtaataaaaaaattaagagtcaatatactaactcttaattcttttattatataaaaacatataatatgatgctgtaaatattataatataacctataaaactatatgaatctggcattgtattaaatattattatacttataatcgctgagaatattatatttgagtaatcaaatattgatatttctttagctggagcatacttatatgctaatgttaccccaaattgacctatactagcaaatattcctgctaatattaaatacgtaaattgtataagggtcatatgtttataaaccattatagtgaacggaagtattgaaaccgtagaaaataaagaaaagaaaaaaactacagtataaaacttttcttttcctcctaaaactcttaaacaagtatatgctgatgcagcaaatatcgctcctaaaataccagaaatatatggtatcatttcaaagtcaaaagtcggttttattataaataaagctcctataaatgctatacacacagctatagcttgattagatttaatcttttcttttaaaaatatagctgaaaatattattacaaaaaatggactcaatttatttaacatgtttgcatcagaaagtactaatctatctatagcataataatttagaattattcctaatgttccaaatatagatctaagtattaatatttttctattttctttgtttccaaaaaaactttctttatacttaactatcattgcaaatgatattatgcaagatactaaattcctaaaaaatgttttttgaaagcttggtaaatctccagataactttataaaagctgacatcatagcaaatccaaaggctgataatattataaagataatacctttatttctgtcacttatattatttaattttcccaagtctatcacctcctatataatttattatatacagtatactacataactaatatatttttataatagtttcttagcttctactattctttgtataatagttataaatataataaaagaaaatatattagtaaaaaataatatatactttggaagcaatataattaaactaaacattataaagccttcacttctctcggctaccccagcttgataataaaaagactttataccttttttctccaccaatgctcctacagttaaaaatatagtcatagaaattattatacaaatcaaaagtattataaaactcattcttgcatctacatattttaaggccagtactaatatcatacaagtctcaacaattctatcaaaagttatatccataagagtcccaaataacgatgtagtattagtttttctagctatagcaccatctacagcatctaagtatcctgatatccaaagtgttaaaactgctattatattcatatcaaaatatataaatacacttgttagtatacctatcaaaagagctataatagttacattattagctgttagttttaattttaataaaaaacttgctccactatttataattggatctacatattttctaccatgtgtatctaacatataacctcctactttttataaaaacttacaaatttattttttagaaatatcgacgctataactaataatattagtgccattatcgacatataaaagccattgctacctatattaactgattgtgcacctatattagtaaatacaagtattcccggtatagtacctataatagttgcaagtaaaaaatctttatattttatagatgtaaggccagctccgtaacttattatatcaaatggaaataatggaattaatcttaacattaaaacaacaaagaaccctttagagtttatcatagattcaataccatctaatttttccttagttaatttttttacaaaatttctaccaagctttctagatatataaaaagataaacttgctcctattaatgctcctataagtgtgtatatataccctttaaataatccaaatataagacctccccctatcgctaatactgagtctgggaaaagtgttaaaggaactaaagcaaacataattatatatactaaaggtgctaatttcccaaaagagctgacataagcttgtatatctttagaatttatattcatatttaataatttatatattgtgcttcctattattataattaatattacagatattaaaatctttaaaattttatttatttgacaattcatagaaatctcctattagttaattattttgataattttacagttttatatctcattttccatttatctacagttctacttttactttgagtaagttttttatgatctataaaattttcattaaataataaatcaagaatatgaagtatatttttatcacaattaagtaaagattcacagcaagattcacaataacaaacaatgtttttgcaatttgtttcataacctctatttttcatttgttttaaagctaaatttttattagttacaccaaccatgcctccagctccacaacaaacagtattttctctgttattttcaaattcaattatatttgctcctaattgtcttaatatattccttacactttcatgtatattactttgatttctcacagagcaagaatcatgtactgcaaaatctaaatttttataattgttttttaattcacttggtatcccaaacttttctataacttcatatatcgaaattacttttatatccttactatttttacttatagtattgtagcaattaggacaggcaactataatttcttcaataccttcatcatgtatttctttctctaaactagaatagtatttattaaatttttctatatctcccatagctattgtaggctttgaacaacacttaaaagtaattccaatgttttcatagtgtgtatttaaatatttataagtttttaaaactatatcttggctatagctacttaaactacatcccggtaaaaatacaactttgctattttttaagttcttactttttgaaaataatggagaaaaactatttatttgatgaaatctaacaacattatagcctttatctttaactgattttttctcatttgaaattacatcttttcttatatcataaaaagtagactttaaatctatatcttttgggcatttttgtgtacacaaatcacataacatgcatgaatatgaaatttcacttaaatcaattttatcttctagtatttttgacattaattcttttggagaattactaaattctttcatcataggacaattgttaaagcataatttacaatctatacacttctccttatcttccataactttattaatgatttttttgcttaatttcatgctatcaccaccttagtctcaaacatataaaacggaatatctcaaaatactaatattatagtatcttaaaatattccttattaaaatcaatattgctttaacttcttttcattgtatattttctttaaaacatatataaaaatacttattgcacttaatataagtaatcccatcatcataagctttgcaccacctgtaagcataccacctacataagagtatattatagtcgcaggcaattgacctatacctgttgctataaaaaatgatacaaaactcatagatgttaaccctgctgcatagcttactatatcaaatgatataaaaggaagtaatcttgctattaaaatcgtatgttttccatatttttcgaaaaactcatctatgctatcaagcgcaaatttactagtaagtttttctaccgtatctcttcctaaaaatctagctatataaaaacacagtgcagctcctgccatagcacttgtccatgaaagtatagccccttttacccatccaaataacgctgcatttgcaaatgtaattaaaaacgcaggaagtggagctacaatagattgaagtatcatgagtatgaaagatactataggcgcccaaacaccaaatgataatatatatttttttaaactttctaaatctagcatacttaaataatataccatctgatttataaaattattaattggattaacaaatagatatacccctattactagtgctacttggaaatactgtagttataaagcctgcaacaagcatacctattactacataatactatctacaataatacatacacttcccatttcagattcaactaatatcatgacaccttcatcagaacttgatttatccattcctaatatatttgataatctacgaatcttatagcaatttcctctaataatgctatattcctctccatttggattttgaactatttcataagctccatgtctaaatacttcttttatatttagtgatggaataatatatatttcatctcctatttttaccttcataccatctactattgccagtgttaatggaatacgaagtactatcatagttccttttcctttttcactgtctatactaatagaacctcttagcttacgaatgtttgtatacacaacatccattcctactcctctaccagagtattcacttacagcttcttttgtagaaaatcctggtgctagtataaagttataggcttctttatcactgatatcttcaatattcttgtttgtaatgcctttttcaattgcttttttaacaatagattctttatctaatcctctaccatcgtccttaataatgataacaacatctccaccagtattttttgcttctaatgttacagttgctttttctggctttgaagtcaatttacgttcttctggtgtctcgataccgtgatccatactatttcttaccatatgcattaaaggatctgatatattttctaaaatatttttatctacctcagtttgctcacctattaactgtaattctactgatttacctgtttttctactcatatcccttacaactctttgcatttttgtaaaggtagaagaaattggaaccatacgaattgacataactacatcttgtagttcgtttgttaattggtgtaatcttctcgcttgtttttcaaaaagatctctatcaaaattttctagttgtgactgtttttctaccatagattcagtagtaacaatttctccaactaaattcattaaagtatctactttactaatatttacagttaaataactatttttgttatgtgcatgtgattgattattttctttttttccattattttctttcttaacttctttttctatttttttatcattatctgatttaacaacttcttcttttttaggttcttcctttatttcttttacttcttcttttactttttcttctgattcatttaattcttcttttgatgagttatcaataacttctacaacatcatttacagtatcattatcattatcattatcattattattacttaaattaacttctccaaagatattttctaactccgctttatctgtgacttctttaatttcaaaactttctaaaaacatagtttctttaataggtttttcaagtacagatttttcttctgaagttttcacatataaaataaatccatctttgattatagtatcatcacattcacccattaaatcttcaggtatagtttttataaaagaacacatattttcaattgaattgactaccccaaatgctctaataccttccataccacatccattttcaaataaaacttttatgtaaaaatatttatctttagttgtttgttcattattattatcattatcttgtggtaattttatatctgataaatttgcatcattatttttttcatcatcactttctttagctctttttaataaatttacaactttttcatgtaattcatctatactagcttctggaagtaatccatcttgaatatttaacatttcttcttttagaaaatcgatactagataatacaatatcaattaattcttcccacttatcactagaaagttcaagtccgctacgtatttcatcaaagacatcttctatactatgagtaagttttgttatactatcataacccatcatagctgaagaacctttaatagtatgcattgtacggaaaatctcttcaatttcttctttccccaaacttcccgtatctgattgtcctccaagtaggatttcttctaactgctctaataattgcatattttcatgcacgtaaaattcatttaaagaatctattccactcatatttttctcctttattaattaaaaaacataataaatcttgtctttaaaaatggaagcataaaagcttccatttttatcaaatttataacatattattattttattggacttcattcattccaaaataattcatttcatcactattaaaacttaaatgcttattagatccattagtatcttttaaattaaagttttcaataagttctttaagcatttgagcttgtccacttaattcttcactagcagcagcactttcttctgatgttgcagagtttgtttgtactacttctgagatttgttctattcccagtgtaatttggttaattgcattagcttgttcttcagatgcctttgctatttcatcaacaactacagtagttctatttgttgtacttattattttttctaatgccttagccgtattgtctacaatttcagttcctttatccactgcttctattgaattttcaataagtgtagctgtattcttagcagcttctgctgatttagcagcaagatttcttacttcatcagcaacaacagcaaatcccttaccagctgaacctgcacgtgcagcttctactgcagcatttaatgctaatatatttgtttggaaagctatatcatctattgtttttatgattctacttatttcgttagaggtaaacgaaatttcttccatagccttaaccatttgtttcatttgctcgttaccatctttaacttgacgacctgaatctaatgttaattcattagcttcttgagcattttctgcagtacctttaatcttatctgatatttcaattatagttgcagataactcttgaattgcgcttgcttgctcagtagccccttgtgataacatttgtgatccacttgcaacttgatcagatgctgctcctacttcttctgaagctacatttatttgtgacattgtttcacttaagtcattagttattttatttattgatttctcaatatctttaaatactcctatatattccatttcagttgaaacatcaaagttacctgatgcaacttcatttaatacatgtactgaatcatttataatttctttagtcttgctactcatttgacgcatactatctgataaagatcctaattcatcttttgattcgtaattaatagttatatcatagtctccatcagccattttatttgctgcttcttctatttcttcaattggttgctttaatctatttgttatgtataaacatgtagctaatcctgctactatagtaaatatactaattgttatagaagcaaaagttgctcttgaagcagtgtcttctactcctttattaaatttaacaccataatcttctgcatctttattaagacttactgcatcatctacacacttattatatgcattaaaatatggagtgttttgtctaagcatttctattgcttgcttgtaatcacctttatctataaatacaaaaacattgttacattcttgttttaaattgtttactgagttttgaagctcatcaattgcacttttgttttcactaaaagaattattaagtgtctttatactcttatcgatactgtcaaaagtactcatcattttagctttatattgtactggatcttgttccataactgcattaccaatatatcttgcaacagcaactaaatctctacgaacttgcatagtttcagtcgttgatacataaggtcctgtaaataactgattacttaatttttctgctccctttaatttagatattgtataaaaacttgtaaatgctgaaagcattaataaaataccaaaagctaaagttagctttttacctatttttagatttttcatacatattcctccctgcaattttttattatatttctctgcatcgacaataaaatttccctattttatagagtgttaaataatttactatatatatttagtaatatttaaaatatatataattttttactttaaatatttaaatatacatatattacctttatacttatggaattttttcctaattcaaatataaggtactactttctattaaattttattaaaaatcaatctttaatcctcggtctactagagtgcaaatagtttttgtctaatacccaaaggttagagtccgagctatcttgcaaactatatttaataatagtcatagaggataaggatgtaatcaatattactccttaaaaaagcactgaatttggagttttaggctatcaaatcagtgctttttttatttgtatttatagtgtaagaaaaattatattaatatttgattaaataataagaattttataaaaattattttagtttttgtcagttttttatgataaaattcgtattaaatgttgtaaaaggtttttagggggagggtgcaagtttgaaagataaattgataattaaatatatcaaaaaatgtaatcaacggggaatggaaatgttaatagacacttacggtggtctattggcatcagtgattcgtacacatcttaatccattaatagattatgaggaagaatgtataagtgatgtgctttttttaatatgggaaaatattgatggatttaatagtaaagaaagtacttttaaaaattggatctgtgcaatagcaaaatacaaagcaatagattacaaaagaaaatatatatctaaaataaatttagaaatagattctaacacttcatacatagatataaacttagctagattagaattagaagaagaaataaatgaaattttaaactatctaaatgataaagataaagaactttttattagatactatttaaacggatataagttagaagaaatagccaaagacacaaatacaaatgtaactaatttacatagtagattgtctagaggacgaaaaaaaatccgcaaaagtattttaaaataggagggtgaaattatgatagataagtttaaagttttcaataaaataaaaatagatatagataagtataaagaagtggaagttaataataatgaagaattaacaataaaaatgcaagatagattaaattcatcagaaagaataaagaaaaaaatgaaaaaaattaatatattaatatcaactattgcattaatatcaataatagtagtaggaattggagttatcaatccttctttagcagataatattatacaaaatatatctgattttcaaactatgttagataaaatcaagaaatctgttaatgatgaagatggtattgagtctaatacagagatttatcctgaaagagaaaaagagaagaaaaaaaacgaaaaaaataaattaatagcaactactgttaatgtatcaagtaaaagcaacggtttaaaaatcactatagataaagcaatgtatgataaaaagaaaatatacttagatatgacattaaaaacagataaacctattaaaaaaagtgagtacataaaagcaatatctgattcgccttatggagatggtgaaaaaaatatgtatttagatgatctgaaaatgactataaacgaaattgaaccaaactcttattcctatggacctggagttattgaatttattgatgaatacagtgctaaattcacatgtttaatagaattagatcctaataatagtatagaagatgctaattttaaaataacttttggtattcctaaatataaacatcctaattttacaggtaagattaaaggaagatggttttttgattttaatataaaatctgtagatgacggcaaaaaatatatagaagttaataaaaaagatggggactatatattaaaaggtgtagatgtatctaagacttatgttgagattaaaatacaacttccttttcaaccatctctaggtaatcctcacaataactttgtaatagttaaggatgataaaaaaagagaactacaaatgtctgtgggaagtgaaggagaaaacaaaatttatactcaaataaatgaattggttaatttaggtgaaattccaaaatacattgatattttagtattaaaaaatcttactgatgaagaccaaaactctaaagctttatctagctttagagttgatttggaataagttaacttttataagtataattaaatttaaatcatatgtatattctttataagaatggttaatatataattaaacagttaataaaacttaactgtcaaaccaacacttactaggcaaaagctagattatatctaaccttttgatagtatctttggaagtgattgggactagatatttgaaaaaatatcatattaaatataatgaatctactagatatcctcggtctactagagtgcaaatagcttttgtctaatacccaaaggttagagtttcaagctagcttgcaaactatatttaataatagtcatagaggataaggatgtaattaatattactccttaaaaaagcactgaatttgaaagcatagtctatcaaatcagtgcttttttattataggaaatatatataatcttaaaaataattctaaaaaagcgtagttaactctacgcttttatataacaaatattaaatataaataaaatcatattggtaattatataaggttttaattttaaaaattattgtaaattataaaatgtatttatatatgccagcatttgatcaccaagatttaagtaatagtatatataagttagatactcagagtaaaatagcttagatgcatcaaattcattatttacaagtgcatttaataaagataattgctgatttaagctcattttgtaggaatttagtaaggcttcaatttgttctgaaaataataagtcaggttgagaattagtatattttttatcaaaatcagatagtgatttttctaaactagaaatttcagttaaataaaaatttatttgtttttggatttccggtgcattatcttttgcattaactgtatttatattaatagtacttatatttgatctaattctttttgcttcattaaggaaacctactaattcatcttttccttgtagatttttaagcattggaggaactgttgacctagattgctctgccaaaactatagaactatttgttattacaaatgaaagtaataatacagctatgagtacatatttttttttcatttttatctcctttcacaccttagttatgtagatatattttatcctctgcattacaatttattcaatcattatatatagcttacatttgtaaaaatataaaataaataatatagtttttacaagtaatatgctataatttatatccaaataactataaaaataggagattaaaatatgtacaatatagatgaaatcatatacgactgtccagtagaagccttatcaactatattaggcaaaaaatgggttgctataataatatgggaactacaaagtaacaaaatgagatttggagaattacaaagagctgtagagggatgtacgaaaaaaatgttaattcaacagttagatttattaattaaacataatattgtaataaatgataaaaaaacatataaaaacacagtagagtctacttattatttaagtgaatcagggttaaaattacttcctataatgaaaaatatgatatattggagtaacgaaaatctttcttgtgataattagatataataaattcaaaagaagtataaattatagtgtatatgagttttttatttgattatgtatcttttattataaaatgctaaatttatgtaaataattttaaaatgagaaataaaataaggagcataaattatggcaagaaaaaaaggagtatcaacattcattaatcaagtggcaaaagaatcaataaaagaacaaaaaagaaaatctaaaannnnnnnnnnnnnnnnnnnnnnnnnnnnnnnnnnnnnnnnnnnnnnnnnnnnnnnnnnnnnnnnnnnnnnnnnnnntatcaataaacaacgaattagatgagctaaataacttaatcataaatggaattaatgaatataagcctatacctataaacgagtttataaaaaaagatatacaagaatttaaaataccaaaagaactaaatatagagtatgaaaagccaattaaacctacaataagaaaagctaatatatttgaaaagttatttagagttcataaattaaaatatttttgaacataaaaaattattagaagttaacatatttaaaaatataaatgatgatgtagatttacaaataataagcccatctaatgttaaaattcaaaatatatctccaaaattaaaagaaaaagaatactttatagaaaatactaaaattgaaatttattttaataaagaaaataatataaatataaaatttacttcaaacgattgcatagatttaggtaaatggaaattattatttaagccaattaacgtagaaaaaggaaatatagatatatatttaaagctagatgataataaaatagaaaattcattaatagaagattcaaacttatctgtagtaatgtttagaaaaaaattaaatgattttaaaagaacaaagaaaagagaatttggagatgaagaagttaatttagataactttatgccgttgtttgttatagattattttgatggctttgaacaagaattagctagattaggtagtgcatttaggttttataaaatagcagagaattttggaatattatacataaataaaaatagaatcgaagaattaggagagatatatggtcttgaaaatatatttaggatacaaagatatgtaaaaatggcgcagttaacaacaataagtagagatacaacaaatggttatgtagcactagaagagataggagcaaatttttttaagaataatcctaatataaatatagatgggagaggcgttataattggaattgcaaattctgggatagattatttacatccagattttatatatccagatggaacatcaaaaatattatatttatgggatcaaacgatagatggaaattctccagaaggatttaatataggaacagaatacactagagaagatattaataaggctatagcagaaaataatccaaatttatcaattgatgaagaaggaataggaactgcattaagtggaatatgtacagggctaggaaatttaaacgaccaatataaaggagtagcagagggtagtgatttagtaattgtaaaacttaaaaaaattgatggtttttacaatagtgctacattacaagctgcaaaaagatatatatatgcaaaagggtataaagaaggaaaacctgtagtacaaaatgttaatttaggtagtaacaactcagtagttagaggaattgatttacttatagatagcttattttttgaatatggagtatgtgaagttatagcagctggaaatgaaggtattggcaacgaacatgcaacaggaaatattgaatttgtcggtgatactaaagacatatttttagaaataacacaagaagaaaaagagttagaaatagatatatggataaataagccggataaagcaaatataatagttatatcgccatctggagaagaaagcaagacatcacttgtatctaattttagctttgtgaaaggtttatttaatagtgaagatacttactacaatatatggactacatacccattttcatactcaggacagcaacaaactgtaattagattagaaaacgcaaagccaggggtttggacaattaggcttataggagattatataacaaatggaatttatcatgcatatttaccaataagaaatttattaaatgaaggaactaaatttagagatagtaatccagaatatacaataacctacccatccatatataaagatactataagtgtaggaacttacaatagcatgggttctagtttatggccagattcatctagagggcctctagtaggtgctacaggtaggcttgaaaaaccagatataatagctccaggggttaatatactagctccttatacagggagtagatatgctacagttacaggaagtggagcagcttcttcttttgttgcaggagctgtagctttaatgatgcaatatacattagttgatagaaattataaagataaagctgttgtgcaaaaaataagaacatatataagagcaggagcaaatagaagtgctcagataggatatccaaatgtaagttatggatatggagtattagatataagaggtatgtttgaccagttgaaataatttataggaggggttttatgcaaaggtcatatatattaatttacaacggtaatgtacctgagttagaagctgatttaacttcaagaaatcttacaaattatattattttaaatagcaatttggctttactttatgttgatgaagattttgatgaacttacttttgataatattgattctgtattcgactggataagatctatacctatgagttcacttatagaaattggagtaggaactagtggtggagaaagaccaagaaatgtttctggagtaaattatattgagcaaaatccatacattaatccatctggtaaagatacaattattgtgattcttgattctggaataaattatttacatccagactttataaaggctgacaacactacgaaaatactatctatatgggatcaaacaacagataaaggaaatccaccaacagacttaaagtttggaagtgaatttacaagtgaagaaatcaatagatatataagcgaaaatgatgcaagcttgactcaagatacaattggaacgggaactatagcagcaggtatagtatcaggaactggaagattaaataatgcatatagaggcatagcattagatagtgaactggtaatagtaaaattaagagaacatgaaggagtatataaagaaggtagaattagctatgaattaaccgattttttagcaggcattaaatacgcaatagaggttgcagaaagaactcaaaaaagaatggtaataaatttaactattggaggaaaaagtgaagctgtagttttaactagtatgcttgaatcatttgatagattattaagaccaggtactattatagtaagtggtctaggcaatgaaggaaatacagatactcattatagagggaaaatagatgatatgaatactgtttcagatatattaattcaagttggggaacaaaaaaatttagagattacagtaagttgtgttggaccagataaaataaatggatctattatatctccatctggagaattaagttacactgtgtcttatactccagatcaagagatatatacaggaagatttaacatagaaagaactaattatgaagtaagatatttatatccttggctgaaatcaggaactcaagaattagtcataaacttaacagatataaagcctgggatatggacattaaggttaactcctgaatttataattactggagattatgatgtatttttacctaacaagaacttaatagatgaagaaactagatttataaattctaattctttttctacaactacttggtttgcagcaactgataatgtaataggagtaggtggatataataataaaattgatagtatgtggattcgatcttcaagaggaactataaatcaaaaccctataaaaccagatatagtagcgccaggagtagatataataggtccttataaaaatgatgagcatataaaggcaagtggtacaggaataagtagttcaattgttagtggagtagccgctattttaatggagtatttaaggtcgcaaagttattatagtagaaatttattatttacagaagttataaaaacttacttaatgattggagcagataaaaaagatatatatacatatcctaatgtaaatatggggtatggacttttaaattttagaagtactatgcaacagattgcaaaaaatttaagatgataaaataaaaagtaaggattggttatgtgagttatataaagggggaaaaagcctatattataaataccatatttggaatttgtatgtttttacttataggtatagttagaccagtattagtttatttttttaatatagatataataaatttactaatgataattatgattatactagctattttaataattgtaggagcaaaagaaaataaaagaaaaagtataaatatattatagacaaaatagataaattggtactagaagcaggtatagcatttatagaaaatgggtttaatatatccaagacatctaataatatatatcttcatagaaatacacttatatatagattagaaaaaataaaagatatattaggaatggatataagaaatttcaatgaagcatgtatttattatttaatagttaaaaattatttaataaacaaaaatatataaatctacggtgaaaatatgaaaataataattatgaaaattacattaagagcaagttgggttcattcacttaaagaaaaaagaatggtagtaaaaagtttagtgaaaaaacttcaaaatacatttaacgtatcagttagtgaagttgaaaatcaagatattcataaaaatatagtaataggaataagtggcgtttgcataaataataaacaagcagattctacaatggaaaatattataaactttgtatatgaaaatacagatgcagaagttataaatatagattctactattgatgtttattaaatacttcgcataaatttaggtaaaatgtgaaaaaatagtatcaaataaaacatcaagaggtgaaagtaatgagacgatttaccagtatagttttagctatgataatggttattatgtctttaagcactactgcatttgcagacgataaaaaagttcaagaacccattaatatatcatctaaaacagctatattaatggatgtaggtagtggacagatactatttgagaaaaatccacatgaaaaacttcctccagctagtgttactaaagtaatgactatgttacttatagttgaagcattagatagcggaaagataaagttagatgatgaagttcaaataagtgaaagagcatcggaaatgggaggaagccaaatattcttagaaccaggagaaacacaaaaagttgatgaccttttaaagggaatagctgttgcatcagcaaatgatgcttgtgtagctatggcagaatatgtaggcggtagtgaagaagaattcgtagctatgatgaataataaagctaagcaattagggatgaatgatactaatttttctaatactaatggcctgccaatagaaaatcattatacatctgcacatgacatagctataatgtctagagaattattgaaacatgacaaaataactaagtatttaacaacttggatggatcaaatagtagttggtaaaaagaaaacaactataggacttgcaaatactaataaaatgataaagcattatcaaggagctactggtgttaaaacaggatttacacaagaagcaaaatattgtttatcagcttctgctaaaagaggagaaactcacttagttgcagtaacattaggtgcacctacaacacaagaaagatttaaagattcatcttcactattaagttatggatttgcaaattatgaaagtgttaaattatgttctaagtcagataaaatagctacattaacactagataaagcagatgataataaagtaaatttagtagcaaaagacgatttaactgcacttataaaaaaaggtgaaagtaaagatttcactaaaaagatagaagtatctaaaaatatagatttacctgtaaaaaaaggaactaaattaggaactataagcatttataaaggtgataaacaagtaggtaaaattgaccttataaatgaaaaagatataaataaagcaagttactttaaaatgtttgaaagagttatagacaatatattttagaggataagacctagtataactaggtcttttaaatttaagcaaatcacttggttttaaaggtatatattaagttaaaaaagtaaatttttagtttaaatcttagtttgattataagtatatatattgttataatagtattaaaacttaaaaaataggagaaaaataaatgaatatgttaagccagtttttagtaacggcagtaggtattgcagtggctatatctgtacatgaatttgggcatgcatatgtagcacatcttttaggagacgatactgcaaaaatgagtggaagaatgactttagaccctataaaacatgttgacccctttgggcttgtgatgcttatagttgcacattttggttgggctaaaccagttccagtgaatccaaataactttaaaaactacaaggttgggaatttaatagtttcattagcgggacctttatttaatgttataacagctataatagctgtaaatcttattagctttgttaatatgaaagctctataccttatatttgatagtatatttacatatagtataggatttgcggcatttaaccttttaccattacctccacttgatgggtggggaatagtatctagttttataccagctaaatattatgatgttgtttataagtatgaaagtatgagtacaattatatttatatttttaatcataacaaagtttcacgtgataatattaaatcctataattaaagtattattaagtatagttaatttatttataatatagtgataattctatagaatttagaggtaatttatgaagtatagtgtacaacttaaggtatatgaaggtcctctagatcttttatatgaccttataacaaaacataaaatagatataaaggatatatctataatagagataacaaagcaatatctagcttacttagatatgcttgaagaatttgatcttgaaatagcaagtgaatttattacaatggcatctaagcttttacaaataaaatctaagtatttactatacaagcaaagaaatgatgaagaagaagaggatccaagacttgaacttatggaaaagcttgttgagtataagaaatttaaaaacgctacagaggatttaaaaaataatgtaacttatatagaagatgtattttatagaaaaaaggaagaagtagttatagaagaaaaattagatttagaatctatatctttagatgctatagttaaaatacttcctcatatattaaatgtaaaaaaagatgaattagaagaagtaaaagatgataagttaaacaaaattgttagaactcgtattatatctgttgaagaaaaaatgcactatgtaagaaatattattaaagaaaaagaagatattagatttaaaagtttaataactgattatgaaaaagacgaaataatagcaacgtttttatctgtactagaacttataaaaagtaatgaagtaattgttgttcaggatttattctttgatgatatcttaataaagagaaatatggagagttaatatgagacgtgatgagataaaaagtattatagaagctataatgtttgcatatagcgaccctataagcataaaagaattaaacaatgctataaatgaagaactttcttcaaaagaaatagaaataatgttaaatagtttaattgaagagtacaaagaaaataatcgtggaatacaaattataaaattacaagataaataccaaatgtgtacaaataaggagtattcatcttttgtaaaaaatatattagaacctaagaaaaagaaaactctaagtcaagctacattagaagcattaactataatagcttataaacagcctataactaaagttgaattagaagaaataagaggagtaaaaagtgataaggtaattcaaactcttcttgaaaatgatcttatatatgaagctggtagattagataaaataggaaaacctataatttataaaactactaatgagtttttaagactattaaatatagaaaaattagaggatttaccacctattgaaaattatgaaaaagaatagatcaaaaatagtagatgatgattaaatatttttatttatccatcatctactatttttttgcatagttttaaaaaaatggaaaataatatagatatgaattataaagatttattaattttttttataaaaattttattacctatttctttcatagtatttgttctcttaaaaagtactattggttagtgagtgattatattaaaaatttataaaaagtgattttttaggtttatattataaactaaaggttataataatcttacaacttaatagaaaatataatgtcacatcaataggtaggctaattctatgctaacttcattttgtttaatttgactgttaatattcatagtcttttccatattacctcgtaaattgaaatttgtataagtttatctataatatcaaaaacaatttgtttaatttttcttgttttgatattagtatctagctacagtttattaatttaaaattttgttagatacaaaaagtggcttcatttttagtgaagccacttttaatataaaagtttatttataccatgttgtttttaataatattgtcaattactttatctaaagtcaaatcttcagtatctatattttctaattccaatatatagtcttcaaattcaacttctacaaatctatcacctttattatctgagtttatataatcaataactttataatctttaatttcttcttgtaaatactctttaagctcattatattcttcttcacttattttatttttattgcatctacaattaggacatcccataatacttcctccttttatttttgtatttcatctaaattcatggtaagttgttcaaataaaatattatcttttgactttttattagtacttttttctttttctattaaattcatctttataagtaatttttttaaagaatttacactgtctatagatatactttcattattaacaatcatagcatatcctactccagtttttttaatacttaaattaggattatatatctttatagatattactttagaatttatatattctacagaaaatgtatttttcttttttgaaaatagttctactaaattatcttttatattttttacttctttattttttacttttttagcttttataacacccatttttataagcaaaggctctaaagacttaatatcatttaaaaatataggtcctccctttaaatttaagcagtagcctttactagaggcttctatttttatatccttttcatttatatatatagatgttatcttaccattagtgtacttaacttcataagatttctctattttggctaatacatttgtgattttatttggtaaatacatacaaaatcctcttttattttagtttttaaataaaatatatcatttattttatttaattacaataaaaagatgattgtgtatacaatcatctttttattaatatgtattagttattttttaattctaaatagaaattagttgctgttatttgataatatggaacaagccataaaaatcctataccaaatgttaaaatagataatataaaccatcctacaaaacttaagtacaatacaaaatattcaaatttatatcctttcatcatcctgatactttcttttaaacattctatagatgatttttctggattttcagctaatatgtaatttgcttgtgaaaacataaaaattaatataatacctggtattataaataatatcatacctatactaatacatatcattattattaaattcataagtaatgattttaaaaacacatcaaatccagaaaataaatctttaaattttgcacttgaatcgcctttacttaaatttaaagaaaatctgcatataccaatctgtacaggcccataaagtaatattcctaatatatttaaagcaataccaaaatttgatacttctacagatttagtaaattcaacgtttactaattgtaatataagagaataacaaacaaatgttattatagctaatatccaattattttttaactggcttttagctcttgtttttagttctagtcttgaaaccataacatgcctccgtttttactgtatactatttttataaatctataataacataattttatacctaatgatatttatgtaaattaattttattattactatacatatttttttataaagatatagcttatatttattattgcttatgaaatacatagtatacttaattttctatagttatatatttaaattgtttattttattttctatttaccccttaattaatttaaataaacaaaaataggcctacaatagacctatttttgtttatttaatatatttttatttaaatttaatgatgtccgcaaccgtcgtgtgagcaagtgtgattacttggaaattcatttaatttattttcattaaataaatctatattttcttcaatagtatcagcttgagctttatatacttttattcccatagagtttaacttagatatagcaccttgtcctatacctcctactataacagcatcaacaacattacctgataatgcccttataggttgacacttaccatgttcatgtcctaaatcaccattgcttatttgagataactctttactttctaaatcataaactaaaaacataggagctgatccaaaatgtccaaatggtttactttttaatccttcatttacttctactggtatacaaactttcattcttaaatctcccttcttttacaacattttttaattgatttacaattttttgtacaatctgtgcttattaaatttatatttgaaatttctaaaatattactattaatattttctattgaattaaagaaagctatacaatcatcaaatacatttttgtttacatgataaaatacataatatccttctttatatccagttattatctcagcttcttttaaaatttttatatgttgtgaaactgatgaatcagttattcccaaatacttagatattcctttttggcatatatctcgctttgaaactaataaaagaactttaagtcttgtttcatcacttagtgctttaaatactttagctaatttattcatatttacctcttttgattaagcaattacttaattagattataatactcttaagtaattttttcaaggtatcttttaaatttattaacttttttagactttatatcaaaactaatatgattaaatttaacattttgtggtatattttaacatatatgacataataaaaaggagtgttagttttgttaaattttagagactttggtggatgtaaatcatctgatggaagatttgtaaaaaaaggattattttttagatctggtaatttatctaatttaagtaaagaagatatacaaatgctaaaagatttaaaaataaaggtagtatttgattatagagatgatgcagaaagcttagctagcccatctcaagtagtagaaaatataaaatatataagagttccagctattcttactccaaatccaaatgaagttaaatttggatcagttgaggatatgatatcaaaaatgtttgataataatgaagcttttaatatgttaaaagaaacatactataacttgccagttaataataaatcttataaaaaattagtagaacttatacaagacgaatctaacttgccaattcttactcactgtacagcaggtaaagatagaacaggtgtaggatgtgcaataattttaatgatactaggagtttcaaaagaagaaataattaaagattatctaaaaagtaatcaatcatcaagtgaaggtataagtgaaataatgactgcaagaccagaattacaaagtattccaaaagaaaaattaaaatatatatttggagtaaatgaagaatatataaatgaagttttcagaagaattactgatgattatgaaactatagaaaattacttatataaagaatttaatttaacacaaaatgatttaaaaaatttaagagataagtatttatgttaaaaaaattttaataaaataaataaagaacctgtatttagcttaaaatactttatgctaaacacaagttctttatatttataaatttatctaattataagtaattttaatttttttattcttaatatcaacatgactttgaaggtcattttagtaaagcttatttagatgagataaattcttttgtagaaacattaaatcaaaaattagcataacttgtatatattaataaatgcctataatgtcttatataaaaatatatattctaataaatcactagccaaaatttaggctagtgatttttaattttaaaaatgggtattatataagtagttaaattgtagatataatactttcaatatattattatataaatagagtaaaaataaatttttagttaacactaacgggatacgctaaggagatataaatatgggaagattattagaattaaatatggaatcagatgcacttgaacttgcaagaaatttttgtagagataatgaccttatgcttttaagtaatagtatagaagatgaaagtttacttgtaatggatagaaattgtgttacaaagagaatatatataaaagatggtgagtggtcattataataaaaaagcatgagtaaagtataactcatgcttttttattataattttttaatttaattcgtatattttaattattctgtgtcttctacgtattctaaaatatcacctggctgacattctaaaattttacataaactatttaacgtagtaaatctaacagcttttgctttatttttctttaaaattgaaagattggccatggtaattccaagtttctcagaaagctcagttgagctcatctttctctttgccatcattacatctaggttaactataatagccatattgacctccttatatagtcttgtcattttcatcttttatttcaatagccataacgaacaatttacctaatactaaacttaaaaagcctattgctaaggatataaatgaaactacaactgatggaatgatagttaatgcataaagatatattccaaagaaatagtataaacctatttgaacaatattaaatataaagatttcactaaatgcacatatagatattgtttttaagtatttaggtatatttttagaaaatggttcttttttgtctattaatttgcaaagtttttttaagttaaatagtgctataacataaggtatagcgcatatgtatatgcctattgagataaccataggcatattacttcctactatgcctaaagaacttttaaatatagcagttaatcctaatggaataaatagcagtacgataaatgttaatattataccaactaagacaatgctatttaaaatttttgaattaagagatttattcatgtattactacctccgttttttattttacaatattttttaatgttgtactatatgtagctagaaattacttttatttaaaaattaagtatttaaatacttgaaaataaataattaaaaattagtttttaaatttgatttaataattttttatcatagatattattaacttttcatttttactcctttctaagcattataattttaaaattatcctaaaaatctcatttgtctattctagaatacaatttatgttgttaaaagtcaataattatttattgtttttcgataaaaaattattgactaacttatttacatattgtatcttaagtaggaggttgatcgattttacctaggacaaaataagtaaattcaaaaggagaaacaaatgaaaaaattaaaaaaagtattaataatattagcgatagtagttttaggattagttgcagtcattcgcttttttggaccgagtgatgtagttgtacttacagaagaagaagaaaaacaacaacaacaagaacaaataaagaaatttcaaaatgtaaatattaaaggatttaaagcaaaggatttaaataacaaagaaatcgattctgatatatttagtaaaaataaattaactatggtaaatatttgggctacatggtgtgggccatgtatagatgaaatgccagaaatttcaaagctaaatagagatttgccaaaaggtactagcataatttcaatttgtattgatgcaggagatggcaaagagtatttagatattgcaaaagatgtaatgaaaaaatcaaatgctaattttacaacattaattccagatgagtttttaaagaaaaatttaactgatggtatacaaattttgcctacaacaatatttgtagatagtgaaggaaaagttgtggggactcctcactttggaggaaatacagctaatgattatagaaaatctattaatgatcgtttgaaattgatggaggaaaaataatgattaaaaatataaattattgtagtaaatatattttactactaatttcaatcatttttatttatattggtatattaagaaacgaacaccttgtagttttaaaaaaggctgttaaaatttgtcttgaatgtattggagtgggataatgaaaagaagttatattcaaattgtggcaaccgcactttcaaatgggtatgttgctggatttttcaaaggaaagatttacacaggaaaaacaaagtatttttgcacaccaggattaaattgctattcgtgcccaggggcagtagggtcttgtccaataggttctttacaagcagtgttaggaggaagcagttttagtttttcttattatatagttggcataatgatactatttggagtaattttaggtagatttatatgtggatttttatgtccttttggatttttacaagatttaatttataaaattaagactccaaagataaaagttaaaaaaagtattgataaatctttaagatatgttaaatatattgtacttattgttcctgttgtggttttttctatatttgtaactaatgaatttggaacagcacaaccacatttttgtcaatggatttgtccagctggaactttagagggtggaataccacttttaataaaaaatgaaggtttgagaaatatggtaggatttttgtttaactggaagatgagtttacttatattaactatagttttttctatatttatatatagaccattttgtaaatatatttgcccattaggtgctttttactcactttttaataagttaagtttttataaaatcaacattgatagtattaagtgtgatggatgtaaggcttgtgaaagagtttgtaaaatgaatgtagagttaacaaaagattgtaatttgggggaatgtattcgctgtggtgattgcaaaagggtatgttctaaaggcgctatttcattgggattgagtatgaaaaaataatataagtataaagagtttatttgatagaaataagtaatttcaattaatacactcttttagaccaattaggaaactgatctttaattaaattttttatttaagaaattaatattatgaggtcattaattaagttacatcacttgtaatttatagagtattaacctgaaaatgatatataatgtttttagtaaaaaagtacctaacatgaattaggtactttctttttacatttgtatattattcttctaatactattttgaaataaataatactcttttgatagttgttctatggatacgttttcattagcttattatagcatgatatttattttaattgaaataaactatttgcaaaggaaaatttaagctaacctatgtgttttttaactttacatataccaaatttttgtaaaaggtcatcccatatatccccaaagctacaacctataattaattcaaatactgtaatatatataaaataaattggaattataattagatattttttgaagtttttattaagattaatcatcttatcaccaccaaactatagatttaaattatacaaatattatacaactttttttattaattgaggagttttataataatttgatgaaatttaattagatattttataaggtacttttagtaaaatatagttaatcaaatttaaatatttaatgattatttaagattaagaatcccattgctcgtatcataatttttacaaaaccagatataactattaataatataatagaacccatagctgttaataatttatttctgatatttattttttctaaatatctctttatattcaattttatattcacatctttttctacactatttaagttattatatgtatattccttaacttttgttatattagttaaatcatttccacaacttttacaatatatactatttttattttctgattcaccacatttagaacatgttttttcatttccaaattctatattaatattttctaaattagttaaatctcgtccatctaatttacaataatttttacagccaaaattatttaaaccgcaattttcacaactcatatctttcctccatagtttaaaaatagccttaagataatcttaaggctattatttataactatattatatcaaaaggatttaaatttacatcactttttacaatatctatatcaaaattttcgtttatatagtcaaacattatatctgcaaagactttttcggtatcaaaatgtccgcaatctataaccttcatccccatatctaatgtatcttgcgcatcatgatatttcatatctccagttataagtacatcacatccagctttataagctttttttaccatatcagctccagagcctgtaactatagcaattttagatacctcatcatttaaatttccaaccactcttagatatttcatatctaatttatctttaagtatcatgcctaaacttttgaaagtaatattttcttttaattttccatatcttccaagccctaaagattcccctttattttctaacttatataaatcatatgctacttcttcataaggatgagcttttatcatagaactaattactttatctaaaattttttgaggaactatagtttctatttttacctcatgaacactttctaaagctccttcttgtcctatataaggattagcaccctcacaaggtttaaatctaccttctccttctgtggtaaacgaacaatctttataatttcctaaatgtccagctcctgaatttcctaaagctattcttacattatctatatgagttttaggaacatatacagctaatttatataaagtttcacttttagttttatctagtattttgacatttttaagttctaacatatctacaaaataatcatttaacccatcaaatgcaatatcaaaattagtatgcatagaatatatagatatatcattttttattaatttatgtattaattttccctttaaatcagaagtattaactttattaattttagaaaaaataaatggatgatgagttattattaaatctatatttttatttatagcttcatctactacactttcatttgcttctaatacaaccattactttttttatatctctatcataatctccaactataagacctacattatcccaatcatatgctaaattaagaggatatttttcttctatcttttttataaaagtcttaagtttcattatatcaaccccttaagtttttttatagtatttatagtactatttcttttagcttctattgaaggtccatttttaccttctaatttgcttattataccttcataagaattaatctttttatttataaactcatttaaaagtttatcattattttctattaacttactaccaatttcataatatatatcatcactaacttcagtatttttccctgtgtatttagccacaattatttcatatattctaaaatcttcttttactaaaacttcgtttaatatttcatatccattattataaagatactttctaagttcattttgtgcttgcatcggttgaagtataagtttttctacagtttgagaaacactttttttagcttctaaaagttcacttattaaaattccacccataccagctattataacttcatctacctcattttgatttaaaacttcaagccctgaacctaatcttaagtctactttatcatttaatttattatgtctaacttctttttttgcattctctaaaggtcctttattaacatcagctaatattgcatagtctattttattattatttaaaagataaacaggtatatatccatgatcagttcctatatctgctatttttttcccttcatccacaaggcttgctatttttaataatctatctgttaatttcaatttttattgtcctttcatatatatttttgtatatataaaaattcgcctattatagacgaatttttatattaatctaagtaatctctaagttttttagatctacttggatgtcttaattttcttaaagccttagcttctatttgtcttattctttctcttgttacatcaaactctttacctacttcttcaagagttctggcacgtccatcttcaagtccaaatcttaattttaaaactttttgttctctttcatttaatgaacctaaaacttcttcaatttgctcttttaataaagaataagctgctgcttctgcaggtgctggagcatcatcatctggtataaaatctcctaaatgactgtcttcttcttctcctataggagtttctaatgaaacaggatcttgagcaattttcataatttctctaactttatcttcagtcatatccatttcttttgcgatttcttcaggttttggatctctacctaattcttgtagtaattgtcttgatactcttattaatttatttatagtttcaaccatatgaacaggtattcttattgttcttgcttggtctgctattgcacgagttatggcttgtcttatccaccaagtcgcataagtactaaacttaaatccttttgtatagtcaaatttttctacagcttttataagacctaagttaccttcttgtattaagtcaagaaataacatgcctcttccaacatatctcttagctatacttacaactaatcttaagtttgcctcaactaatctttgcttagctatttcatcaccttcatgcattcttcttgcaagttccgcttcttcatggggtttaagtaaaggtattttacctatttcttttagatacattctcactggatcatcgatacttatacctttaggtaaagttaaatctatttgctctatttccatagtgttttcttctttagacatatcatcatcgatactatcatctatatctatatccatatcatctgaactaaactctatatctacatcagccttttcttcttttttctgtattacttctatacctaagtttcctaatgtttcatataaattttcaacttgatctttatcaagttcagtttctgagaaagcttccattatctccataagggtaagacttccttgttttttacctttttctataagtgattttgctgttactcttttagactctttttttggcgctttattttccatgctcaatcctcccttcatctatattttttgtaatatttttcttaattcaactatttttatagcaatttccataacctgtacatctacctctttcgcatttgaattatcattaattttatttgattccaattctttttgcttctttaataaattatctatatcattttgaagcttatttcttttcactttttttattatctcttctatacttttatcatcatttaaatttatattttctaactttaaggaatataaattgttaagatattcttcggataagtttaaacttttcaatttgtcaatagttattttatccaattcttcatttttaattataaattttaaaatttctttattttcttttaaaataaaattatcttcatccaacttaagacctaataattttcttacttctctaattttgaatcttttttcatagtatttcatctcctcgcaaatgaatatacccactagttatatattaataaacatattagtcttaagttttaatattctaaaagttaaaaaaattgcttatagaatttataaatgaataaaaatgaatattaaaattcatttttataatttataatattaaaatttataaaaaattattgattttatattatagatatttaacagtaacttataaattttttgatttatgaatgattcaagtgttaaagtttaataatcaaaaaaattaaattttaacactttatttataaaaatgactatttcaaataaataaatgaaaagtttattttgaaatagtcatttttaattatttattatgtttttcgggatgacaatttttagaatatatctcaggtgatttttttaaagtagatgtccattggttgtcgttttcatccttttgttttactcctgttttgcttgttaacgagttaattccactagcccattggttgttagtttctgttttagatcttttattcattttaaaatctcctttataggtgttttaattattttgaacatgtagttatgattatatacttactagtatttatatttaatattataataaaacttaatgtaaatttattctcaaagctattgacacttgctatgatttaatgtttataataaaacgatatgaatttacaattaaataggaggctaagatgaaaatagattggaacagtaaatacacaacaatatctatatactcatttatagttgtttgctgtagtattattttttatcgcatagtttgggatacaagtatgttcgccggtaaagtaagtgagattatatcaactttgcaaccgtttataataggcggagttatagcttatttattaaactttatattagtgtttgttgaagataaactactaagtaaagaaaaatttaacaatctcaaacctaaaagtaaaagagccctaggtcttttagttacttatatagtagcttttatattaatttacttatttgtacaatttgtattacctcaattggtatcaagtataatgggattagttaatgacataccaatgtatatagctaatttatcagaccttataactagttatacacatgatttaaatgttaataaggaacaactaaacttagcagttgacaaacttacggaccttattaattattttatatcagttgcagctggtttaattcctgtattaggtgaagccttaagaatagtagcctctagtgtttggaatataatacttgggtttatagtttcaatttacttacttattgataaagaaaagttttttggattaggcagaaaagttatatttgctgtatttagtgaaaagcatgcaaaaagaacactagaattaattgatagaagtaatgatactttcggtagattcttaagtggtaaaataatagactctgctataattggtgttttaacatttattgttcttacaatatttaaaatgccatatgtattattaatatcagttataataggtataactaatataataccattttttggtccattctttggagctattcctgcaacgataataatattatttgtatctcctgtaaaagccttatggtttatacttataataattattattcaacaaatagatggaaatattataggacctaaaatattaggggattctataggtatatctgcattttggatattattttcattattagtggcaggtaaggttttaggtttagtcggaatgattataggtgtccctttatttgctatagtatattctattataaaagaagtagtagaagaaaagctagataaaaaggggcttcctatagatactaaggattatatgaataaataattttaaaatatctatctaaatttaattttagatagatatttttttatttaaataaaaaagtttggattcatatgtattttatataaaatattttttataaaatatgtaatcatactatttaaccctatatttttatttttaaaagtatgtgtggtaccgaattttattggatttgaataatataataaatctgataaaattataatattaacatcaaatattaatcaatcattcgtaaaaggagaaaattatgagaaaattaattttatcaaaaactataatgtttatattcattttagcatttataaatttatttatagctggatttggatcagaaaatactttaataggtgtaacagtaataactgcaatgttaatgttacttgaaagagatttaactatatcacctattaaaaatacgttaaaacttataagtattaatgtattcttaggggtattgtcttttatagctatacaaaatatatttttaggagttgtatgtaattttgtagctttatttataattggttatatatttagctatgatcttagaagtcctttatatatagcatttgggttacaatatttatttactgtagccactcctataagtatagaacagttaccaatacgacttttagctttaataagtggagcattaataattatggtatctcaattgatcgttaataaaaataaactagttaaaactagtaataaactacttgttaatatttgtaatgatatattacaaaaaatcaatttattacaaaattataaatatgacactaaagatttagattttaaaataaattcatctttaaaaactttaaaaaagcttctttatgataacagaaaagaaaatttctttatgactcacaagggagtaagccttttaaatattttatttaactttgaaagaatatctatactattagataagtataagtgtgaagatggtaatgaagttatggatagagaaaaatctctctctattataaaaaaagagttaaacaatttaaaagagtatataagtgaaaatgttaatgaaataaagttcattgataaagaaacaaattgtatagatttatatgaattttatgattcactagaggatatatattaccagtttgatgaatataaaaaaaatgaagtagaaaaagatatagaaaataaattagatgtgcctcatgaatttaaaatgtcatatgtctataaaaaaaatcttaatacaaactctataaaattttcatatgctataaaagtagctgtcggggtatctattgcaggttttataatggactattttaaattaagcgagggtagatggataatgtttactgtattttcgcttatacaaccatattatgaaaattgtataaccaaatctaagaaaagaatagtatcgacaattattggaggtatgatagtttttatattgttttcgatatttaaagatcaaagttcaagaggtatgattatacttttagcaggatatataagtacttatactaaagattatagagatttaatgatatgtaatactatatctgcaataggagctgcatgtcttattacttctccaggggtatttgttttaaatagaattgcttttgtaatattaggtacagtaatagctttattaataaacaaaatactgcttccatataatgcacaaaatgcatataaatatttaataactatgtataaaaatgtcatagcagaaatgtctaaagaaattaccttatgtctaaagaaaaaaagtaatttacataaggtaaaaaatcttttattgatatctacattaatagaagataaaatattatctatgaatagcttagttaaagatgataatcaagacaaaatactatctaaaaaaagaatgcttatgaataatatgtatagtttatatttaaaattaaatagtagcaaaaataaagaaatagaatgggcatacattttttctatttttttttttcaagcagaagacggcatacgagatcggtctcggcattcctgctgaaccgctcttccgatctctgtcataggtatagcgattgcatttttaataaatatacctatgaaattttttgaaattaagttaataagtccaattttaaaaaagtcaaagcttaaagatactaaaacaatatctagaattttatctttaatacttacattaataatactttttatatttattagtgcttttgttaattttgttgttcctcaattaattaagagtacttcaagtttggtaagtaaagttcctcaatatatagattctttacaaacttatattccaaactatttatctcatataaatatatcaagtagtatgcattctagtcttttatctggagttgaaaaagtttcaaattttgttattaaatttgcaaattattttatatcaaatatattatcaattacatttggtgttacatctgctataacaaactttgttataggatttataattgcaatttatattcttttaagtaaagaaaagcttctaattcaatgtaaaaaagctgcatatgcatttttaagtgaatcttatgctaagaaacttatagaagtatctcatcttgtatcttttaaattctcaagattcatagctggccaatgtatggatggagtgattcttggaacactatgttttataggtatgactatttttgatatgccttatgctatacttgtaagttgcataatagcgatagcggatttaatacctatattcggtacgtttataggaagtgctatagctgctttcattatatttatggtaaaacctataactgccctatactttataataatgattgttataattcaacaaattgaaggtaacttagtttatccttttgttgttggtaattctataggattatcttcattttggatattagttcctatatttatcggttcttctacattcggagttctaggaattttaataggtgttcctctttttagtgtaatttatacactagcttcaagacatataaataaaaagcttaaagaaaaaaatatacatttataaaacaagaaaagtcagatctatttatattagatctgatttttcttgttttatatttaatattatcttctctttgtatttttcagcaatttctagtatcatatttaactcgtctacttttaacatatacattactcctaaataaactattcctcctactgaaattgatatacctaaattaattatttttatatttattaaattagctaaattattataaataaacagtacaataaaactcattatcacaacagagattaatgactttatcagagtggaaaaaatcttatcctgaccaaaataaccagctttcctgtataaacttataaacagtgtaattatgcatattatagatgatatacttgttgctaaagttaatccgacatatccaaaactctttgaaaaatatatatccataactatatttaaagcaacagctataataccatttatcataggagttttagtatcttttagtgaataaaatatcttacttaagatgtccctaagtgaatatgctatcatacctattgaatatcctgataaagctaatgctgtcatttgagttgcattattatcaaacatccctctttcaaataacatacttactataggttttgataatattatagacccggcagatattggtaatataaatattattactaagtttatacttttagttattatacttacaaatccttctttatttttatcaactaataacttggataaacttggatatattacagatgttaatgatactgtaaaaattcccattatgaaactatttagtttatttgcatagtttagtgctgctacactctctactccaaaaccagttgccatactattatctactgcagtattaatttgatttacagcaactccaattaaaattggagctaataaaatcatcatttttattaaatatttatcctttagatctattttaaatttatatctatatccttttttatatgcatatattaattggataagaaactttgatataagtccaatcgtagttcctataaccattacatatgggctagtttttatacttaaaaacatagaaattattactataatattaaatggcaagctcactatagatggtactacaaactcttcatttatatttaaaaatgcagttataactccagatattcctgtaaaaaatcctccaatcattaatatctgagtaaaattaactgctattttaaattgatttcctttaagtcccatagcaaatattttcactaaaacatctgggaaaatcataccaaataaagttataaacaagctaacgactattgttatattaaatatattatttaaaaaacttttagctctttcttctccatctttatcttttatctcatagtgcataggtataaatgtagtcattatacatgttccgactaaagcaaatattatatctggaatatttgatatagccaggtatatcccaccataaccctttactccatataatgaacttaaagttatatctctaccaaaaccaattactttgcaaattaaccctaaaatcattattaatgcagtatttttagctatcttactcatctgatttctccttataaaaattttataagtttaaaatatcaattggtatttttatattcaatataaattgcgtgtttggtagcttttactgcatagttggtaatggtattagtatttttacgataaatttttcatcatcatattttatatcaacttctccatcataactataaatagttctttttacattctctaatccaattccatgagttaatttatcttctttatctgttattaaattaccacctttaatttcaatttcattgcacttactattttctattttcattacaaaaaaattttcatttatatacgaaccttttaaacttatatatttgtctccctgtaatttatcacaggcttctatagcattatctattaagttcgaaaatatagtacatacgtcattaactttaataaagtcgcactttttaaattctatgtatgcattaaatttaatttctttttctaaacaaatttcttttttttcattaagaatgatatctaagattaagtttcctgtattaaaacaactttcgcaattttctattttcgtatttatttctgttatatactcattaagattctcacttgtattagataagtttttcatacatgacatatgatttttcatatcatgatacatttgtcttactctatcttgattttcttttaccttcatgtagtacttatactccatctccattttttctttcataagcttattttctatataaatacgattatctcttgttattttcctaaaaaggaatatcattaatatattagaaagtatcattaatattcccatgaaaaagactgaaaaatcatttataaaatcggctcctgatattttattagttttattaactaaaactattgctaagctaagtatattaacacatataggaaaaaatattgctataaagtgctttttatttatgtatttatatgatttaaagtatttataaagtaatgaagtagctataaatataagaactgaaaaagtcattatttctaagcttgaaaaataattatatgaattagttttaattccacttaagttacgagttcttaaaattatggctaatcccattgtaacatgacagacatgagtgtagagaacatgatagacatgaaaaatgtcattgtgactggaaagaacatgacagacatgaatgtagagaacacgatagacatgaaaaatgtcattgtgaatgtaaaaaacatcatcatgatgattgctgtaaaaaaatgaagggcaaagttaatcattatgaagattgtaaatatatagatggtaaagactactgtgttgaaaataaaaattactatgacaattactacaaaaaatgtaaccattattatataactgattatgattatgttacagatcacttctatgaatatgatgtttatcactatgatcataaaactaaatatgattgcaaatattataatgataaatgctatgaaaatgactattatagagaaaaagataattggaaaaaaaatgactactatgaaagagataattatgaacattgtaaaaaaaatagaagaggttatgactactagtatatcctatatataaatttaaacttgcatattactaaagactaaaagttggaaattatatttattcatagcttatgtttaaatataatttcctttgaattttaatttttatcagggctatgattataaatcatagccttttattatataagttaattttccttatttccatttataagcataaaaaatgtagttgcatttttactagtcataaattcttcagtatttttatacttatcaataaattcattggttatacctacaaaatctatatctccattttcatataagtttacatcagcagatccttcttttactatttttgtattgactgattctaattttacagtatctttatcccaataacctttattcttactcataacataaacgtcatctaatttccatttagtcaatgtaaacggtccattatataatgttgatttactagttgttccatatttgtctccttgcccttttacaaatttttcattctgtggaaaaaatactggaaatgacataagtttatcaaaataatttacaggtcttactaaattaacttctaaggtatagtcatctatagccttaactcctacagtttcagcatctttagtttttcctatattataatcttttgctccaacgatatcatacattataaatccgtactgagaagctgtatctgggtttaacgttcttttaaatgcatactcaaaatcataagcacttacattatcaccattactccatttagcattttttcttaaattaaaagtccaagttttcttatcttctgatgacttccaagatttagctatcccttctactacattaccattattatctactctcacaagcccttccattacattatttgcagcactaaatgataatgaatctgtagctctactcatatctagtgatggtatatctgaattgctagttaagtttaactcatttctcccatttacactagcccatttatatgcatattttgctccatatggaattatagttattccatcaacatattctttttgtatataggcactactgctttgaaataatggcattataaaagcatcactaagtaatatctcttctgcttttgaatacttatcccaactaccatcaattgtagcttcatttttaccttcttctatcaatttattatactctttgctatcataaccactatttttaccaaatttaccgttagtagtaaatgtttctaaaaatgttaaaggatctggataatcagctacccatgaactatatactaaatcataatctctttcagattctaactgttgtttttgtttaaaaggaacttgctttagctctactttcaatccttctaaattattttgcagttgattttgaaagaactcacctactcttttgctactttcggcatctgatgtaagtacttctatagttactttatcaaaatctagttcatctttggctttatcccaatgtgttctagctagctttaaattatatcctcttcccatattttttattttatctatatagtcttttccttcattattaatagctaatccttctggagtataatagtttataggatttgatccattatttaatataatatcagttattttttctttgtctactgccattgttattgcaagtcttgcatctttattttttaataattctgctgaattaattgttttaccgctattttcattactagtgcatccacctaacatagataaagataaaattgtaattagcgccataattgatatttttcttttaaatgtcatgtataatcatcctcccactttaatatattttattatcaaatgtattgtaaattacttactttttatcttctttttctgtcactaaaaatcataatattttgtatttacacaataataaaaagtgcattaaaataaatactttattttaatgcactttttattgttatattatctaattcttatattatatataaagtttcagtaaaaacttccataggattttctgtaaatatagatatatctacgtctttaccaacttcagtactccctaatctatcatctacctcataaatttttactgcatttagacgtgttatagatgaagttgatagtataaaaaaagtttatatagaaagtatgactgtagatattttttaagttatatatgatagtccaaataggcttaaagttttatctaaagaagaaactttaattaaatgtaacgctactattgaagagtgtaagaaaactgaatacaaagtagtttaaatatgaattagataaaaataagtagctaatatatgttagctacttatttttatctatccatttatatctttatttttatatgctttgtaacaatgtaaaaattcccttgtgctaaatatatatttaccacttatttgtgtataataaactcctgtagaatcatatatatcttttactttttgagttaaatttttgtgataatatctaagctccttaaattctttttttaatctatctgctgttaaccatactttattagatgttatgtctgctagttttatattttcaaaagatatattattttgttgtccataaacatatagctcagccattatttcttgtaagttttcattagttaaatcatgcttaagttttatatatgttatagcacccatgccatctctacctttttcatttaatttttcttgatgtataagcgcctttaatggttgcctctttatgtatatataatttatatcatcaagtacatactctcctcttacatacttagcaggtttatatattactaagataggactatattctcctcccatttcttctgtattataatcagttatatcacttaaatctaataagttgtattctttagatatagaaccatatcttgatttttttattaaagtatacattcttgaattttgaattttgtatattaattcatctaaataagatttatccaaaatattaccttcattataagaattgtttatataattaagttttatttcttcttttaaagtattaatttcttctattcttacattaaagtaagctaataaatatttaaacttctcttctaatttatttatatttatataaaattaaacaagaggatataataaaaaatgaatttttctcaaatataagtcatgaattaaaaacgcctttaaatataatatattcagctaatcaattattaggtgttagtgtacaaaaaagtaattttaaagagatatatataaaatataaagattgtttagatataaattgcaagagaatgcttagattaatagacaatatagttgatattacaaaacttgatgtaggatttaaatatccagaatttgataattatgatgtagtaaaaattgttgaagatatgaccttatctgttgcaagctatgcaaatataaaaggtattgaggttttatttgatacagatgtagaagaacttgatatcaagtgtgatccagatatgttagagcgaatagtcttaaatttactttctaatgctataaaatttagcgaagaaggaggaagtattttagttgaaatatttagcgatgaaacttgggttggtataaaagtaaaagatgatggaataggaattccacttaatattcaagataaaatatttgatagatttgtgcaaggggacaagtctatgagaagaaaaaaagaaggtagtggaataggccttagtttagttaagtcacttgtagaattgatggatggaaaaatatatttacaaagtgatggtaaaaatggtacagagtttactgttttacttcctaacaaattggttgaagaagaagataaaaaagtgcataaagattatcatgttgatttacaaagaatacaattagaactttcagacatatatgagttgtataaagatgaatatgataaataaattatttataaaatctatagttgagacttcagctatagattttatctattttacactataataaatttaacatataatgaattcaagaaaatttggaaaaatttgcttgactatttgatataaagggagatagagatggaactaaaattagacatatacgatagttcatttaaacacataaaaaatattgaaaacaatttatacgaaacgacaacacaactatgtgtagcgagagaagaagcttttgcatttcaagttatgttaaaaagtgatgaaaaattcttttgtcaattaggaaatataaacgatattcattatctaggtcttaataataaaataagaatagatatagaactagaagaaagtttaaaaaacaactttaaaatgtcttttttgggatatatacaaaatgatattaaagaatatataggcgatcaaatattaaatcaaaactatatgtatatagaagaagatcaaatgatatggatagatggtaaaatacctaaagattttaacaaagactatatacaagtaaaggtaaaagcttactatacaagtggatatgaaacagaaactttattaaaagaagaaattgtaaaaatagaagtattaaaccacatagtaaaaccagtaaaagaaagtgagtttttcttagatttatggcaacatccatgtaactgggctcgttactatgaagtaccgtactatagtgaacaacattttactatattagataacttcttagaaaaaatgtcagacttaggacaaaaagtagtagacttaatagtaactgattacccatgggcagggcaaagatgttatgaagtacatgagaatgcgaacaatttatttgaaatgaacatagttaaagtattaaaaaaagatggagaagtactatgtgatttttcaaatttagataaatatatagatttatgctttaagcataaaataaataaagaaataaatttatttggacttgtaggaaactgggatgcttttaaatttggaagtccgctagaggattacaaagatgctataagaatcaactattatgatgaagatagaaaagtttttgattatataaaagataaaactgattttgctaaatatttaaatttgctatttagtcacttagaatctagaggtttactagatataaccaaaatcatagtagatgagccagacaacatagaagtatttaatgaaaatgtagattttataaagaaaagttcaggaaataaagatataaaatataaatgtgcaatacatcaccaagagttttttgaaaagtgtgagataaacatagaaaacttatctttaaatacttgtgagcttataaataacataaataagttagatgaaattaaaaagaaattagaagatagaggcggatattttacttggtattcttgttgttttcctgataagttaaatgtatttttagattcaccattgatagaatcaagacttaaaggatggtttacatattattttaatttagatggttttttaagatgggcttatggtgtttggccagaagatctatttaaaaatgccagttataaaaaagaaaaatggaaagctggagatatgtttttagtttatccaggcaaagatatgaagcctatggattctgtaagatgcagaaacttattatttggaatacaagactttgaaatacttaaaagtatggaagctaaattaggtaaagaagttataaataaagaaatagaaagattattaggaaaaaaatctaaaatgaagtttttaggtgaaagagatataaaaatgaactactctataagccatggagagtatatgactttaagaaaaaatctaattaatagagttaatccaagaagtgcaaagccagaagagtttgaaagtgttataaatcttataaataaagtctttagagacttaagaggacataaaccaactatgcaacaagagtttcctttactactaaataaaaataatgtagacaacatgatagtaatttcaaaagacgataagattgtttcagatgtaaattatcttatacaagatgtaactattcaaggaaatgacataaaagttgcagcaataggagctgtatgtacagatccagattatgaaggaaatagatattcatctactattttagattatgttgaagaaaaaatgttcaatggcggtgtagatatggttagtatttcagggacaagaactttatacacaagaagaaattgtagtttagttaaaaattgctacaagtatacaacttatcctaaagatatagttattgatttagaagtaaaagaatatgacgaaacctacttaaacgaaatgattgaaatatacaatcaaaatagcactagatttttaagaactaaaaatcaatttgaagttttattagaaagtgcaacaataccttggggtaactttacttataaaaagttagtagttttaaaagaaaataaattaattggatatatagttttaagaataataaatgaagaaattttgattggagagattagagaaatatatataaattctaaatataactatgaagtagtccaatatattgcaaataagtataatttagagtatatagttcaaagtgtacatataaaagattttataaatcaacctgacaactttgataaaaaagaattatcttatttagatggaagtgataataaagcaccacttatggtgcctaagaagttagctttaaaatataaagcaatacctatagatagtaataatgataatttaactgtagctatatctgaagaaaatatatatgcaatagaagattttaaactagcaactggtaaaaatataattttaaagatagaagatgaaaaatatataaatgaaagtattgataaatattattctaaaaaccttttagacaaggaggaatattcaaagtctatattagataagattttgaataaatcattagaatttaattctagtgacatacatatagaaccttttgaaaatacattaaaaataaggatgagaatagatggatatttaaaagaaatttatagttatcctatcaatattcatatgcaattagttacagttataaaactattagcgggaattgatatagcagaaaaaagattacctcaggatggaaggatagataaaaatataaatggagagattatagaccttagaatatcaactattccaactatacatggagaaaaagctgtaattaggttattaaaccgaaataagtttttaagaaataaagaagaacttggattttcagaaaaagctataaataaaattaataaaatgatacataatatgagcgggattttactcataacaggcccaacaggaagtggaaaaactactacgttatattctatattaaatgattttaaaagtatggataaaaatattgtaactatagaagatccagtggaatacaaaatagaaggaataaaccaaatacctttaaatactaaaataggactagattttgctagtggattaagagctattttacgtcaggatccagatataattatggttggagaaataagagacatcgaaactgctaaaattgcaatgagagcagcatccacgggtcatctagttataagcactatgcacactaacaatgcagtagaagcaataaatagactattagatatggatatacctagatacttaatagcatcttgcttaaaaggcatagtttctcagaggttggtaagaagagtgtgtaaaaattgcagtatagaaactattatagataaagagtttgctagcaacttaaaaatggaattaaatactaaagtaaaattagaaaaagggtgtaacgagtgtagtaatactgggtataaagggagaatagcattaaatgaagttgtagaaataaataaatatttaagacaggctataatagagtgtaagaacatagaggaaatttataatattgctaaagaaagtaatatgattaaatttgaagatagttgtacatacttactaaaggaaaaaataactacagtaaatgaatgtttatcagtagatttttttaatgattagaggtgagtatgtggctatatatgaatgcgtaatatacgataaagaaggcaatcgaaaaagtataaaattagagtttgattcagaaaaagacttaaattcatatgctttagaaaatgaatttaaaatagcagatacaaaattaataaaagaaaaaagtataaataaagtaaaaaacaaggaattatcaattatgtgtaatcaattaggaatgttaatatcttcagggtgtgaaattacaaattcactaaatacaattcaatctaattgtagtcataaattaaaatctattctaaaaaaagttaattacaacctacaaaaagggaactctatttcaacatcatttcaagatacgagcatgttttcaaccttttttataaatatgataaaagcaggagaagtaagtggaaaattagatgaaatacttgtgagtttagcaacttattataaaaaagagtatgagtttaaaaataaattattaacagctatgatatatccattgttattggtggttgtatgtgtacttgtaatcttatttatgcttatatatgcagttccaagcttgcaagcgtcatttattagtaatgaaagaaatttgcctataagtacaaaaatcttaatagaaatatctagtttttttaggagctactatgaattaataattattttaggaatgattttgttattgattgggtataaacttatatctaaatctgataaattaaaatattacttcgatgaaaaagtattcaaatttagatgtacgaaaataataatacaaacaatagagattagtaagtttataaggtgcttttatattttaataagtagtggaattcaagttgttaatgctctagagatatcgtccagtgtcataaagaatagatacatacaacaaagattatatttatctaaagattttatacaaaggggaaatactataactaactcattaaaagtgtcacaggtatttccaaaaatagttatatctatgatagaagtaggagaagaaacaggtaggttagaaaaatgtttgcatagtataactactaattatgataatgacttagacaattttataaataagatagttaaatcaattgaaccaattattataagtattatgggaattttcataggagcaatagttatatctatgatgatacctatatttgatgcagtgacatcatttcaataaaaataattaaaaaggagcttatttatgaataataaaatgaaaaaaagaagaggatttactcttatagaattagtgatggtagttgctatattagggacattatctagtatagctttagtgaaatttacggatgtaggtaaagatagtaaagtaaattccgactatgttactgctagtaatatagcaactgcagcaaagttagcattaaatagtaatgtagacgagggtaaaattaatttaaattatttagttgatgaaaaatatttagaaagcatacccaaaccacaaagtgttgatggtaaagagtttgaggtacatgtaagcaatggtgatgtaacagtcaaaatagatcaagaaactttttatcctagagaaataaaaaatgtatctggacaaaaatagcatgaagaaaaataattaatgtatatagaggtggtattataagattgataacattggacatagatgcaggattaataaagttagtagttatagataattattttggaaaattaaatattagactatcaaaaatattagagtgtgaagaaatatctagcataaatacaattacaaatattgagaaagtaagtaaacttataaaaaatgagataagtaatataaagttaccttttagtagagtcgcatatttagttcaaaatgaaagcataataaatcgtaatataaaaataattaatacagatcacaaagaagatatacaaggattaataaaatatgagttaaatcagtacatgccaatatatttcataagatacactatttttacttttatatttctataaaaatatttcccactaaagcactggataatagaatagtattttttcatcttatatattaagtaaactattgttgatgaaaaataatgttttgaaaaaaataaacgatttagtccaaaataaatacattttagtccacttttaagatttttttaaatctataagttaaaataaatcatagatttttcaactcatataagtttaaaaaatttataaagcatttaaaaaggagttttattatgacattttttagtttattgattaactggggacagactttattaattgggattccttcactaattatcatctatttattatctggaaagaaaactataccaaaatcaaaagtaaaagaacgaaaaattttaattcgcagtaattcagtatcacaaagttggattgctcttatgattacaatgatatttggaacattttatgatttttacaatggtacaaatgttgaaattttaaaatattcttcactaatgtatttattaacaggaataattgtatatgctatttcttatattttaaatcgaagaaggtttatttaagtgatatatatagcatttaaaaagaaattaaaataaaaagctatctattattaataatatgtgctataataatatttgtagcgatacacaaataaattaagagagacctagaaataggttcataggagtatatttaatgataaatggaacagtaaaatggtttaacaacgaaaaaggatttggttttatatcagtagaaggtggagatgatgtattcgtacatttttcagctatacaaactgatgggtttaaatcattagaagaaggtcaacaagtaaactttaatatagttaaaggtgctagaggtcctcaagcagagaatgtaactatattataatatatatatattttcgggaaaaagacacatcgagtgtcttttttttttatgctaattaataatttgaatattatatttagaaattataatgtattaaatttcaatatcatgccaaaacatagccttaatttaaattaattattgaataattttgtatcgcctgttatattatttatataacaaatgatataaaattataataatagggggataatcatatgctaaaaattattaatttatctaaatcatataaaaataagaaagcaatagataatatttccattgaagtaaataaaggagaattatttggttttattggacacaatggagcgggaaaaacaactacaataaaatcaatagtgggtatacacaattttgaagaaggagatatattaataaactcaaagtcaattaagaaaaatccgattgaatgtaaaaaagatatggcgtatattccagataatccagatatttatgaatctctaactggaatacaatatctaaactttatggcagatatttttgaagtaagtaaaaatgaaagagaagaaaaaataaaatactattcagaaaagtttgaaataaataaatctttaggagatttaatatcatcttattcacatggtatgaagcaaaaactagttataatttcagctttaattcatagtcctaaaatattaatattagatgaaccttttgttggcttagacccaaaggcatcatttatcctaaaggaaatcatgagagatttttgcaataatggaggctgtatatttttctcaactcatgtattagaagtagctgaaaaaatatgtgataaaataggaataattaaaggtggtaaattaatcgcttatggcaatacaaatgaagtaaaaggggataaatcacttgaaaatatatttatggagatgattgagaatgaataatttagcacttttaatgaaaataaatatattaaatctaataggatataacaaattaaaaaatggtggtaaaaaagaaaagaataaggcagtaggtatggccttattaatagctttaaccacagtaatattagtaacatctggattttcattatgtttttatctatcagattttttaatacaaattaatcaaatagagctattacttataataggtataattggatgtagtttttctacattatttacatctttatataaagcatcctcatatctttttcaaagtaaagactatgaaatgttagcaagtctaccaataaaacaatctacaatattaagtagtaaaatattaatacttattttaaataattatttatttgcaagtgcttttattttgataccaggtattgtattttttataaaagtagatacaagtttagtatatataccatttttaattatattaactttagcaacaccaataataccgattttaatttcatctttaatcgcatttttaataacaaatgtatcttcaagaagtaaaaagaataatttcgtttnnnnnnnnnnaaaatataataatgaatttagtacaaaatagttcatcaattattgaggtgacgaaaaagatataccctccagcttattactttgtagatgcacttaaaaatattaacattatatcgctattaatatttttattaatatctatattaccaacggcactatttatatttgtatttgcagataactttaataaaattaatagcaaattaagtgaaacgtataaagcaaataattataagtttaaagaattaaaaacttcaaaatctgtaacagcattattaagaaaagaagtaaatagatatttatcttcaactatttatgttataaatagctctataggtatgatattactacctatatttgcagtagcaatagtatatgtaggatatgataaaatagcacaattacttgagatgagtatagtagtggatatgatgaaaattcaaattataggagtaatagcgttttgtataattatgactaatacatcttgcgtatcaatatctcttgaagggaaaaacctatggatattaaaatcatctcctatagatgaaatggaaatatttaaaagtaaaatattattaaatatactgttaactattccaatatcagtaataagctttttagtaattgcaataaaattaaattttaaacttaagacaattgttgtagtaatactttcaatagtactattatcaatatttattgcaatattaggactatttataaatttactttatccaaaacttgagtttactagtgatgttcaagttgttaaacaaagtgctagtgtaataatatcaatgattattaatatactatatgtagctatgcttttttgcataggttatatattaaaaataaataattttgagttgttcttaataatatcaaaaagatatggtattaagcttattaagagcaggaagtactttatttatagttgattttaaatacttagaactaattaataaatatatgtcttgaagtatgtatatagacacatatattaatataaatatagaagatataactccgaataggatttcttgatttttaaacatactaccttcccccttattaatatagaaaaataaaaagtgtcctccaatatactactaagtttagttgtatattgtgattgtacatattatgatttttgaataatttatagtaaatttgtccatattaaaaaacagtnnnnnnnnnnnnnnnnnnnnnnnnnnnnnnnnnnnnnnnnnnaggaaaagcttatgattaaaacttttaaaatattaataatattaagcttaataactactataaacacactcaatgtatatggattagaaagtcaagctactacaaatgaagaaactgtaaaaaatatatacaatttaaaaatagaacaaaagagcataaatgaacaaatttctaaaatagagaaagtaatagaatctaaaagatcatatacaaatgatataaatgatactgaagttgtacagttaagtttcattgatgatagtagtttaaaagataataatgaaattcaaaaaacttttgaagaagagatacaagaattagaaaatttaaaaaatcaattaaatattaatataaatgatttaaacgaacaagaatctaaacttaaagctgatataaaagatactattaactatggatgttggccagttccaggatttaaagatataagttcaccttttggatatagaattcatcctatatctaaagaaaaaaagttacataaaggtatagatattcccgctagctatggaactgatatagtggctacagattatggagttgtaactttttcaggagttcaaaatgggtatgggaatgttgtttatttacaacattttgatggcaaagtttccatatatggtcataatagtgaaaatatagttaaagaaggagatatagtatcaaaaggagaatctatagctaaaattgggtctacgggtaaatcaactggaaatcatgttcattttgaaataagtgtaaatggagaattaaaaaatccattagatataacaatcaaataaattaagtgaaaaaattataaaaaattataaaaaattataataaaagcatagataatatcaaaaagtttttactttattatctatgcttttttatttttactttaaaatataaggaatataacaaaaaaagtttattttaaaatatatatttataaaaaatattcaattgattaaatattttaaagtttaaaggttagaaaactaattttctgatttttccaaaaaaaaagaaatatttataaacaattgactttacaaatttatagtattatacttattcaatgttaagtaaaatagttagatatctaattaaaaaagaggtgaattaaatggagaatacaatggaagctatagctactaataatttattatttatattttcggtagtagttgtaacaggtataatattggggaaagttagtgagctattaaaactacctgatgtaatattatatttgattgcggggataataataggtcctgcagttttaaatataataagtgtagaatcttttccaatagaaaataatcttatattaacctttggatcggcatttatactatatgaaggtggtagggaagtaaatttaagagtattaaataaagttaaagtcagtgttgggttactggcaactttaggtgtagtaatatctactgtagtagtaggatttgcaactagtaagatatttccagtttctataatgacagctttattaataggtgcagttatagcatcaactgacccagcggcacttataccagtgtttaagcaagttaatataaagaacaaaataaagcaaactgtagttagtgagtcggcatttaatgatgcagttggagctatattagtaagtactttattagcagttataacatctggttcattttcagctggagaaagtttaaaagaattgatagtttcagttgtagtagggttaattgttggtatggcaataggactaatattttcattactagtatctgataaaaagtggggagtatttcattcatatgctccaataatatcagttttaaaagttgcattagcttacgaaatagctactaaattacatggtagtggatatatggctgtatttatagcaggacttatagcaggaaatagaaaattatttggattatgggtacctgaagaagattttcatgcagaacatttctttagagaaagtgtaggagcattatgtcgtatggctatatttatagttttaggaacacatgtagacttagctgcacttggtcaatattggttaccatcattattagtagtattagtcctaatgtttgtggcaagacctttagtagtattgatatgtactttatttgatagagaggctaaatgggaatttaaagataaattatttatgatgtgggtaagagaaacaggagttatacctgctgcattatcagggataatagtttctatgcaaatacaagggtatgaaataatatcatcagtagtgtttatgacaatattaataacattaatagtacaagctagtacaactaaactattagctaaaaagttagatttattagaagaagaaaaagatgaaaatataaaagctaaagatgtagcataataataaaaaactatctaaaaaagtttatattaaacttttttagatagtttttttattttttatatatgaaaataaaaacttaactaatccagattaaattttatatagatatagaaggaaaaaatagatattaatagaatttattttatatataaaaatttgaaaaattcaataaattgggggttggttaatgaaaaaaaggttattaggagatgtactaatttatttcatagctccaattattttatttgccttttttaaagaaaaggctaaattttattcaacaatcataattgttgatagttttaattaaatttaaaattttttaaggctattaatttacttaacatagattttacaaataaaaaatatatatattatagaattattattaattttatattaatcttaaattaaaggacaaaaatttaagtttaagcataataatatataaatactgctgtaatttttaatatgtgaattattctaaaatcctgcctgtaatgattctaaaattcaaattaaaattaaaaatttaacaaactaaatttaaaaagggggtaaatgtttgataagtttaatgataatgtgtgcgttagttttactaatatgcataacttcaagcaaaattttatataaatttggggttcctattcttttgatttttataatcttaggaatgctatttggctctgacggtattgttggaatatattttgacaactacgaattaacaaaaaagttatgctccattggattagtatttataatgttttatggaggatttggtactagctgggaaatggcaaaaccagttgccataccttctatacttttatcaactcttggagttgttataactgctggtttgacaggtatattttgctttaaagtatttgatacaactttgttagaagggttactgataggatcaatagttgcatctacagatgctgcatcagtatttgcaatattacgttctcaaaagctaaatttaaaaggatccattgcttcaatattagaagttgaaagcggaagtaatgaccctttagcatacatgctaactgtaatcatactagggctaattggaaataaaggatatggcactataatacctatgttattaaatcaagttatagtagcagttatagtatcagttttattatctaaacttacaatttatttattaagacatattcattttgaaatagatggattttacccaatatttattatgggaattgcagttttatcatatgctttaagtgaacatgttgggggaaatggatatttagcagtatatattgctggtcttatggtaggtaatagcaaaataccacataaaaaaagtatatttcaattcttcgatggaatatcatggattatgcaaataatgctatttttcatactaggattgttagcattcccatctaaattaccttcagttattataaaaggtgtttctatatctgtgtttatgatatttgtagcaagaccaattgcaacttttagtatattaagttggtttaaaattcctttaaaacaacaaatatttgtatcttgggtaggacttaggggagctgcttcaatagtttttgcaatctatgcagtaacttatggagttgtaatagaaagtgatattttccatgtagtattctttgttgcacttttttctgttgcattacaaggtacactgttaccttttgtcgccaagaaacttgatttaattgatgatgaatctccagtattaaaaacatttaatgattatagagaagaaataggtacaaagttaatggaaataactattgatcatagtagtgctattgcaaacaaagctataatggattctaatatacctgaggatattcttattgtaatgataaaacgaaaaggagaggtactaattccaaatgggtcgactagtatccttcctcaagatacattagttatagcaggaaataattttgatggattgagtaatttattaagtaatagtagttcaagttttagtatataaataaatttatttttaaaaattatagtattaattataatttcaaaaaaattttaatttataggtattaaataataaaatctgtatataatatcatatgtaaatccaattactttttcatatttttctacttaattttttctatttacttctactaaaatattacttatatattaaaaaaggcaggcatcggaacctgtcttttttagtttaaatactcatcaaataatacatttatgctctcttttttcctttttctctagatttactttcccatttaatccattcaaaagaatctaattctacaaataataatacaaacgcaggaccataatatgtatttatacctgtttttgcatatactcttaaaaaacttatttaaaagcattatctttatttaatctagtctatcaattaaaaattttaggtattggtacatatccaatccaaacggaaagttaacttgacgtaacttaggaaaaatactacaatttatgtaaagttaactttccatttttaaatagaaaggatttgttagtgaatgaaaaatagacttgaggaaattagaaagcaaaaaaaagtaactcaagaagaattggcaaacgctttagaggtaactagacaaacaataggttcattagagaatggaagatataatccatctattattttagcttttaaaattgcacgctactttaatatgtcaattgaagaaatatttatttatgaggaggattaatatgaaaaaaagtactctgtatataggactatgctatttagctgtagggatatgtgctatattatttggattattcggaccaagtatagaaaatgatgaaatcatttggggagtagcaggaggaggtatagttccaggactttttatgatttataagtatttctattggagtaaaccagaaaacaaaccaaagtatgaggaaaaacttaagaaagaacaaataaatttgaaagatgaaagaaaaataatgttaagagaaaaatctgctagaataacatatataatattattttttttattagcaattttaattccgatatttactattatgaatgtaaataaaattgtaataattacattaagtattatatgggcatttatatatatatgtggaattgtagtatttagaatattagataagagattataaatactccctaaaaacttatttagctattaataataaaaatgcccttagaatccatttatttggatttttaaaatattttaaatattatatttgattattaatttttaataataattaaatttattcatctttatatatttttattaatgaaatagatttttattatctaaggtaaagtagttataacattttttgtaaatattataactactttacctttagattaaataagcatatcttaacctatatcacttaaattactatctttatctagtcctaacatatcatgtttagattcaaaactagtatgtaaaagctcatgtgataaatgagataacggttctttaaagaattctttatatacatttattacatctgggttttcataactacattttatttttatagttttatctttatcgtataatccttctatacgttttaatctcatttcatttgtaattctagctttcattttaggttgtccagctccacctatacatccacctttacaagtcatcacttcaacaaagtcatattcaacttctcctgcttttagcttttctattaaagttctagcatttgcagtttcttgtacagctgctaatctaagagttttatctcctatagtaacagtagcttctttaactccttcaagtcctctaactggagtaaagtgtaaaaactctttatgtggattttcatgagttagtatattgtatacagttctgaccgcagcttccataactccaccactattaccaaagattaaaccagctccacttccaagacctaatatattatcaaattttgaaccttctaaagcatcaaaatctatgttttcttctcttaaccatttagcaagttctttagttgttaatattatgtcattatctctcatatcttcaacattattaaatttagctgaactgttcatttcaggtctaagtatttcatattttttagaagtacatggtgttatagtaacatttactatttttgatggatctatattagctttttttgcaaaatatgtctttataacagtaccttgtatacctattggacttttagttgtagataagtttggtattaattctggatagaatgtttctgcaaacttaacccaagaaggacaacagcttgtaaactgtggtaatttgctattaccatttataatacgacttactaattcactagcttcttccattattgtcatatcagcaccaaaagttacatcaaagacataatctccaccaagttctcttaaagattgaaccattttgtcttcaacatatgaaccttcttccatgttaaattcttcaccaagtgctacacgaacagctggtgcagtactaaatactacaattttgtcaggatcatttatagcttctttaactctgtctatatcttcaacttgtgttatagcttttttaggacatgcttgcacacattgcccacaatttatacatattgctatatctccagttttttctaaatcaaagtagcctgcaactcctatttcatttgcacaaaccctcttacataatccacattttatacatttgtcataatctatttgtatagatggattatctaactctactgggactaccttttctgtaaataagtgtttcatgttaattgctcctttattgtgatttaattcataaagtattaaataaacatttaattgtacttttcgacaatcaaactcttaatatgcttatacccatttttttaactttgtatcatattttaaacattattttttataaaaaaataccgctcactcctaaacttattggaataagcggtatccttaaataaatttttttattatttattttcttctattaatttttctatagtttctctacatcttgcaccttgacatggtcctgttgttgctcctgttgcatctttaactttttctacagtatttgctccattttttatagcatctactatagtttcttttgttattcctttacataaacatactttctctgacataataaacctcctactaaatatgtatcatattttcctttttatattatacccaattattttaactttaaatatttttatattataaaaatatttaaattatgaacatatttactataagtttcataatttactataagttaaagtttgtaaataagggggaaatatatatggattgctttaaaactaaggaaggtaattctatagttagagtttttcatgcatcacctaatgcaccaacagttgatatttatataaatggggaaattttcacaccagaactaggttttacaggtatgtctgattattcatatcttgaggaaggaatgcatacaatagaaattcgttctatgggagattctactacaactatactaactaaaatgatagacgttcctgatgatagaatatttactatagctattgttggtaatttagataatttagaatttatactaatagaagatgatatagatgaaattccttctcctaaagaatctactgttagagtaattcatttatctcctgattcacctaatgttaatgtatttgctaatggaaattctttatttgagaatttagagtttaaaggaaattcagattatactaaagttccttctggtgcttattctatggatgttacttcaagtaatacaggagatatagttttatcaggaaacttaaaccttaaagctaatagaatatatacaatatatgttataggtaatccacctagcttaggtttaattcaatcagtagatgtaaattcttatctttgtagatgataaaaagggtatcaatcccctttttatcttaaacttttaattactaagttaattaattctataatatttttagatatatataaatcttgttttgaagcccaaattaagtatatttttaattcttcccattttaaatttttatctatatttactttatatatattatagatttcatttattttatctaaaacttcatgttttttatcttcactcatatttttacctcgatctattagtatcaataagctacatacattactgtacttccacctttgacctatcaaccaggtagtcttcctgggatcttacccttacggtgggaaatcttatcttgaagttggcttcgcgcttagatgctttcagcgcttatccattccgtacatagctacccagccatgcccttggcagaacaactggtacaccagaggtacgtccatcccggtcctctcgtactaaggacaggtctcctcaaatttcctacgcctgcgacggatagggaccgaactgtctcacgacgttctgaacccagctcgcgtaccactttaatgggcgaacagcccaacccttgggacctactacagccccaggatgtgatgagccgacatcgaggtgccaaacctccccgtcgatgtggactcttgggggagataagcctgttatccccagggtagcttttatccgttgagcgatggcccttccatgcggaaccaccggatcactaagtccgactttcgtccttgctcgacctgtatgtcttgcaatcaagcttccttttgcctttacactcttcgcacgatttccgaccgtgctgaggaaacctttgagcgcctccgttactctttgggaggcgaccgccccagtcaaactgcccacctgacagtgtcccaatacctgattcaaggtatctggttagaatctcagtactacaagggtggtatcccaaggatggctccgccgagactggcgtcccgacttcatagcctcccacctatcctgtacatgtagcaccaaaattcaatgtcaagctacagtaaagctccatggggtctttccgtcctgtcgcaggtacccggcatcttcaccgggattacaatttcaccgagtctgttgttgagacagtgcccaaatcgttacgcctttcgtgcgggtcggaacttacccgacaaggaatttcgctaccttaggaccgttatagttacggccgccgtttactggggcttaagttcactgcttcggacaagtcctaacagatccccttaaccttccagcaccgggcaggcgtcagctcctatacatcgtcttgcgacttagcagaaacctgtgtttttggtaaacagtcgcttgggcctattctctgcggccacctcgggcgtgaaccctaacgtggcaccccttctcccgaagttacggggtcattttgccgagttccttaacaacagttctctcgctggccttaggatactctcctcacccacctgtgtcggtttgcggtacgggcacctttaatctcgatagaaacttttctcgacagtgtgaaatcagctacttcgctacttaatttcgctccccatcgtaccctagcattatcaaggcggatttgcctaccttgactgcctcagtacttagccacacataaccaacagtgtggttagcttatcctactgtgtcattccatctctcaaacgattattggtggtacaggaatctcaacctgttgtccatcacctacgcctttcggcctcggcttaggtcccgactaacccagggcggacgaaccttcccctggaaaccttgggtttacggcccgtgggattctcacccacgtctcgctactcatgccaacattctcactcctatactgtccacacgtccttacggtcatgcttcagcctgcataggaagctcccctacctatcataaatgatatcgtagcttcggtagtaagttttagccccggtaatcttcggcgcaggatcactcgaccagtgagctattacgcactctttaaatgagtggctgcttctaagccaacatcctggttgtctatgcaatcccacatcctttaccacttaacttacatttagggaccttagctgacgatctgggctgttgccctctcgactatgaatcttattacccacagtctgactcccaagtataaaataacggcattcggagtttgataatcttcggtaagcgcaatgccccctaggatattcagtgctctacctccgtatttctcaaccttgaggctagccctaaagctatttcggggagaaccagctatctccgagctcgattggaatttcaccgctacccacaagtcatccccgagcttttcaacgctcgtgggttcggacctccacgaaattttactttcgcttcatcctgctcatgggtaggtcgctcggtttcgggtctacgacagcaaacttaacgcccatttaagactcgctttcactacggctccataccttaagtacttaacctagcttactatcgtaactcgttggcccgttctacaaaaagtacgcggtcacacataaaaagtgcttccacagcttgtaagcgcagggtttcaggttctatttcactcccctcccggggttcttttcacctttccctcacggtactatgcgctatcggtcactaagtagtatttagccttggaggatggtccctcctgcttcccacagggtttcacgtgtcccgtggtactctggatcacatctaaagtcttctcgtttcaactacgtggctattacactttatagcggagctttccaactctcttcgtttacgatacctcttcgttgatgatgtgtccgcaaccccagcgaagaaaacttcactggtttgggctgttccgcgttcgctcgccgctacttacggaatcgaatttctttcttttcctccgggtacttagatgtttcagttccccgggttcccctcgctaagctatgtattcacttaacgatacttagacattactctaagtgagtttcctcattcggaaatcttcggatcaaagtttacgtgcaactccccgaagcttatcgcagcttatcacgtccttcatcggctcttagtgccaaggcatccgccctgcgcccttaataacttgaccagttattaaaagtgttattttttaaagagttttcttctcttattatgctttgtaatatatttagtataaattccatagttgtacctccttgttgctttttattcaaacaactttgtttaattattcagtatactatattataatagtttactttttcatcataaagtatttatttcaaaatatatataatttttaaaacaaaaaatctatagaaatttctatagattttttattttaaaaattatcatacttatctagatattatttttattttatcgttttctttctttaatttttagaataagaaatattacaatacctataaatataactgcataaatgtaaattactaacattcctatattatataaaaaattactcattgtcttctataattactgcagttccatacgctagcatttcagctgctccttgcataactgcagctgaagttaatctaaaccctattatagcattggctcctttatttttagcttcttctaccattctttctatagctatttttctagcttcttctagcatttcatcatatcctgttagttctcctccaactaattgtttaaaactagcccctatatctttccctatatgttttgctcttacagtacttccttttactaaaccaataacctccgttatcttctttcctggaatattttcagtagtcaatactaacatttaattcctcctaattaatagttatatttatattaattctatcacaattaaacatatttaaaggttacataagtttacaattaaatcataataataaactatttagcttatcataaaagctaaatccactattaatctccatagtcccaagtcctaaaaatgtggctatgcgtgaaattatagcaaatatagttaaatataaaatcctcaaaataagatatttattaaatttagaaaaatctaatatcaaatttttttaaaatctcaataaaagttaaacttcataaaatttataacaattaaaaaagagttatctaaaaaataactctttttatattaacctaaaatcctatcggtattccagtaaccatccaaactataaatagtatagtccaagctattaagaatgtcatagagtatggtaacataagtgatattacagttcctattccagtatctttcttgtaagcttgcataaatactataaccattgcaaagtaactcataagaggtgaaattatatttgttgaactatctgctattctatatgccgcttgaacaacatctgaacttattcctaattttaaaaacataggtataaatactggtgccattatagcccatttagctgatgcagatcccataaataaatttataaatcctgttataaatacaaatcctactaacaatggtattgcacctatatttattgattgtaagaattcagcccctcttaccgctattattgtacctaaatttgtatactcaaaatattttataaattgtgatgcaacaaatgctaaacataaatatccacccatagaactcattgctttactcatatgagctgctatttctttttcactttttacagttttagctatttttccataaactacagatggtacaaaaaatagtatagctattatcggtataagaccattcatcaaagtagagtggtctactatagaatttaagaagtttggtttttctaaatttcttaaaaatgaatttggcatagctacaagtattattaatcctactaccataaataataaagttaagtttgcagctttcatagccttagcttcttcaggttttatagtttgtaaatcattagctcttgacattccatctgaaaatttagcatctttactattatattttccaagtttaggctctataattttagtagttatcaaagttcctaatatagtaattaaaaatgttgatacaaacataaaaaaataatttgcagtagcacttatatttactgttgggtctattatatgagctgcttcatttgttattcctgcaagcataggatcaacagttcctataagtaagtttgcactaaatcctccagaaacccctgcaaaagctgcagctataccagctaaaggatgtcttccataagccataaaaactaaagcaccaagaggaattaatataacatagcctgcatcagacgccacatttgacattattccaaggaatacaaccgttggaactatcagctttgctggtgttatacttacaatttttttaagaagtgtccctatgtatcctgaactttctgcaatcccaattcctaacatacctactaacactacgcctaaaggagcaaatgatgtaaagttagttactgcattttctaacatatatttaaacccagctccatttaataaactaatcgcttttatagtttgttcttcaactttcattgtttctctatttataagttctgctgttacacttaaatccatcttttctgctattgcagatataattgctattgccacacaaagcattgcaaataatgtaactgggtgtggcaacttatttcctatatattctactgagtctagacatttcatcaaaagactcctttttttaacttctgcttttcccataaaacatcccccttttttctatttgctataatggtagcacattaattctatcaactacaacaaatatttttaaattttcaatttatttttaaaattccgttttttaatttataaaatacttcaatttcatttttcttttcttatgcattatttaaataaaataaaaaaactaccttaaatttaaggtagtttttttattttatttaggaatcaatcttaaataaggaagctatttatgctgaatactctatgatgaatgcattataaaatacaagctatattaaaacataatataatggtaattaaaaaatactattatactggcttatgttttaatatagcttattttgtatgtaatgaaaattaaattgtaaaattgtataataaataaggtaaatggaaataaaacttattaggaggaaaatatggatataaatgcaaaaactaaattaatatgtttaatagggcatccaattgaacatagcttatcaccggatatacacaattatcttttaaataaatacaatttaaatatgaattatgtatgttttgatgtagaaaaagaaaatttaaaagaagctgtaaaagggttaaaagcactaggaataaaagggtgtaatgttacaattcctcataaagtagatattattaaatttttagacgaagtagataataatgctaaattaataggagctgtaaacacaataaaaaatgaaaatgggaaacttataggatataatacagatggagtaggatttgttaaatcaataatagataaaggatataagctgaaaaataaaaaaattttaattataggagcaggtggtgcttgtagaagtattgctatagaattggcatctaatggtgttaaagaaatagaaataagaaatagaagtatagaaaatgcagaagttatatgtaatgtaataaacaagcattttaaaactaaaagcaaatgctcatcaaaacctataatgaaaagtgatttagaggacatagatataattataaacacgacgcctattggaatggataaagataaagataattgtcctatagatgaaaatttagttatagataaaaaaattcttttatgtgacatagtttataatcctcatgaaactaaatttatagcttggggtaagaaaaataaatttgatgttgtatatggaatagacatgcttataaatcaggctatacatgggttttatatatggactaacataaaggctgatgaaacaaaaaatttaaaatataaattgaaaggtatttaaattgaaaattaaacgaaatgggtttcttattttagaaaatgttatatctttaagcttaataggattaatatcatcgctagttgtatctgttttatcaactagcattttttgtataaataggtcttacaaaagtactgagatgctaaatatagcaaaaaatgagatgtgtgatatagaatattctatagataatacagatgtagaagaagaacatagaaagaaaatgataaaagattatgaaatagattataaaatagaaaaaagtgataaatattataattgttataaagttgatattgctgtaaggcataaagataaagaagtaaaattaaatagttatgtggtgaaaagttgagaaaaaatttaggatctataatggttacaacacttttttgcttttctatattgagcattttatgtttaagttgcttagatataatacgttcaaataatgatataataagtgtttatgaagaatcattaaacttgcaatacgaagtaaaaggtggactgaatttagcacacagtaaaattttagaggaagttgataaagctatagaaatagctataaaagatgaatatcctgaagataaatataaggattatttcttaggaagtaataaaataaattttataaaatctatagagagtttagactgtgaaaacataattttagatgtaattaataataaaatttacacagaagataactatataaaattagatataacgtgttctaaaagtaataaagaaattaaaaaaagtgtgaggtgttcatttaaaataagtatgaatatagaagatattaataagaacaaggtatataaatacaactataaggagatataatttatgaaaagagaaggaatgtgactttaatagaattagttataggggtaggaatagtattaatagctatagctataagttttccaaaagacaaagcagataaatatcaaatagattcttttgcaaggcaacttgtttcagatataagatatgtaagaagtatgaatataaatgggaatatgaatttatatttagaaaatataaaggtttttgataatccaagatatataataaagaacaattctagtataataaaaactgtaaaccttccaaaggattcaaccttatcggctccaacatctataattaaattcaaatcagatggtactttaaattcaaagggagaaactataattattaattcaaataatagaaaaatagaaataacaatagtaccttttagtggaagagtattattaaaagaggataagtatgaaaactaaaaatggatatctaattatagaagcttcactatctatatgtatatcgctagttataataattggactatatggcttattattttcaagtttaaaaatttataaaaaaattcatagtagtatagagatacaacaacaaggaattgaaatacaaaaacatatagaaaaagaattaagtgaaggtatagaagtagtaaatgttaaaactcaaaataatcaaatattaacatcaaaaaattttgatttaaaaaacgtaatatcaattaaatataaacctatagatagattatctagtatgggattagatgaattgtttaggaagtttaatgatagtaccatttatattagcagcaggggctggattattagaaagccaattagaaagcataaatgaacaataattatatagatataaataataaaaaagtagtaggattgttaacctactacttttaactatattattaatgacatctatcacatggatcgcttttacctgattcagcttgagttccagacagtatagttttacttctacttaaagtcgagcaagatctagttgtatgataagattttcctttaggagtccaataaactacctctgaactagtttcaacctctggctctattacaggttgcggcttaggcttaggagttataataggagcaactgttgtttttccagtattggtattttgttgttctgttcctggttcataacttcctttcttacaatctacagtaaatccattaccagtagacttaaacactatatcaccacattcatcacttctatgaacctcaatattcatatcttttaaagtatccatagtttctttatgaggatggccatattgattacctttaccacaagttataactgcatactcaggagttactctgtttaagaactctggagttgaactactatgagagccatgatgaccaactttaattaagtcaacatctcctggatttaaattactttctatttctttttcagcatcacccataaataatgccttgtcatttccatttgtaaattctagaactatagaattattatttggatcattagcattagctacagataaaacagttaaagttgcagtccctaatttaaattcgctatttaataaaggtacacttggacttactcctttatttgacattgcatttataaagtcagaataagtttttgtatctgcatctccattactaacaaacatattttttacaggtatagaattaactacagcatcaagaccacctatatgatctgcatgaggatgagtagcaaatacatattctagttcattaaccccttgatttttaagataattaacaactctactttcatcatcattatctccggcatcaataagagcagcttttgccccttggattattaatatagaatctgagttacctgtatttataaagtgtatttcagtttcttctccagatgaattttcttccttattattagtgctaattgtagttgagttagagttagtatttttagtagtactttcattttgagaaatagctgcaatatcatttgtattagtatcaactgttgattgagttaaatcagcaaatgatcctattattaagaacaaaagaattgtaaatgtaatagtaaatgacttaggcgaaaatatattcttattcaattctttctttgaaattttaaaatatgctttctttagcaattcattagttttaaaagttatagtatcaaactttcctgctttatatagttttactataagatatataaatccacctataattgcaaatggtaaaaataatatgattgctattattttgagcattgttgttaaactccctttgtttttcataataaacctcccctttttataaatatagcaaaaatattttaacatattatgggaaatttaaaaataatatgaagctctatgagtaattaaaaattaagaaaagaattatagttcttttgttgcgaaacttcctgcatgattattaaaaaattaaattcaaagaaatagtctataagaagtttttttgacataaatattaatataaaaaaataggagggagtttcatggcaaaaaatataatcgatgatatatttgatgttctcgtattagtagggaaatcatctaaaattttagtatgtaaagttttaaacataaaagagatgtatgacttagaattattttttaaaaatgcaggattaaaaaacgggtcaggagaaagacctaagcagaaaaaaataacaacaggtgaaaaaggagatgtatatcacttaagtatcccagatggattgacgtctaaggatttcgaaaaatataaactagcgttagaagaaaaatataatgaagaaatagaaataagtagcagtaaaggtgttattttaatagaaatgtataaaaaacaatgaagcatagctttttacgtaaatagagtataagtataaaagtatatacttaggccaggtccactatgaacaattaactggtcgttcattatatcttaaaccaagtttaagagagctacgcttataattcacttgttaatagagtgtatactaaacacatataaaaagttgcatgttcttacataaaaaataacttatataaaaagaaggtggcaaattttaaagtcgccacctttttgccaccatagcagaaaacatactaaaacataattaaatttaattaaacttattttaaaaaatatatacgttcggagaaagatttttattttatttaaaacataatataacacaacttaacttactttaaagattaaattcgcataaataccacaaatagaagcttacatagatttaaatagtataaaataatcacttttaacacatataagttttcaattataaataaattaccatcgtaaatttttttacgatggtaatttttatatttaaatatggtaaaaaataaggttctagatatatatctagaaccttattttttacttattatttgcacttaatattattttttgtgcaatttgtgtaggtacttcttcatacttatctaattccatttcaaaataacctcttccttgtgtcattgctcttaaatctatagcatatttaaaagtttctgcttgaggtgcatttgcatatataatttgttttccattttcaattggctccatacccaatattcttccacgctttttatttatatcacccattacatcacccatatattcatctggaacaactattgttaatttcattataggttctaataatataggcttagcttgttccattccttttttaaaggctatgctagctgctaatttaaatgccatttcagatgaatctacatcatgataagaaccatcataaagagtaacttttatatttgtaactggatatcctgcaagtatacctttattcatagattctcttatacctttttctactgcaggtatatactgtttaggtacagaacctccaaatatatcttcttcaaattcaaaatcctttggagatctttcaaactttatcttaacatcgccatattgtccatgtccgccagattgttttttatgttttccttgaacatcagaacttccttttatcgtttctctatatgctacttttaaatcatataattcaacgtccagaccaaatttttctttcattttggatttagctatatttatatgaagttcaccttgccctccaattaaaacttgcttagtttctacatttctactccaagttatggttggatcttcttcagatattttatttaatacaatactaatcttatcttcatcacctttgtttttatgctgtactgcaaaatatatttgtggttttggaagatttataaaattatctgcattttcattttgattcgttgatatactatctcctgtctgaagagaattaactttagttataattacaacatcaccagcttttgctgtctttaattctatcaactcaccatttttcatagtatatatattataaattttttcttttatagacttattgagattgtaaatatccatatctttatttaattcaccttgtaaaattttaacatatgacattttgcctataaaaggatctaccatagttttaaatatagaaccttttagattcttgctatcatcaatatatttaggttttaaatatgttgataaaatatttaaaatttccacagtacctatattatttatagttgatccacacacaacaggtattatatctccattttgtattcctaatgttatacctttttgtatatcttcattcgttaattcttctccactaaaatacttttccaacaactcatcatctgattcagctattagttccatcaaactttcttttatgttttctgcttcgattttaaaatcattacataaacctgacatatcctcaaatatgttatgtaattttataaacttgttgtcttcatatactggcatatacataggtactatcttgttactatatttttctcttagctcttctattaaatttttatatatagatttttcactatctattttattaataaatataagtttaggtatagatttttcggtaagttctaaagatttctctgttcctacttgaatgctagtagtagcatcaattacaattatagctgcatcacttgcacttattgctgatataacatctcctgtaaaatcagagtaccctggagtatctaataagttatatttgtaatttttgaattctataggaactaaattcatgctatatgtcatattaatcttatcagttaatttaggcattttatttgtagttttagaagtataagccattgcgtcaattaagtttgtctttccacaaccactatgccctaatatagctacacttcttagcatattactattatataccttcatatttaagcacctacctcatatcatttttataatttatatgcaactaatataaggctttatgtgcgattattttaaaaatattaatacttaatttataaacccctcgttgtttaacgtgaaacattaattagaaattatatcaaattaataatttacattaaaataaaaatagttctaactattattttatttaaaaataatagttagaactatcttaaaaataaaaaaagattacgtggctacgtcctactctcccaggcagcttcccaccaagtaccatcggcgctaaagagcttaacttctgtgttcggaatgggaacaggtgtatcctctttgctataataaccacataatccttcatagattaatatctatttagttagagttagtactctaaaaactgcatatcatttgtaagattaaataatcttggtcaagtcctcgatctattagtatcaataagctacatacattactgtacttccacctttgacggattataaccttttatataaatataaaaacataaattatatttatttttgccaactaaaatccactcacccaaaatttcatttcttaagtcgaaatcaacttttttataattataaaaattacctatatctaattgtaaaagattagtatctgtattataagtaagtgtatattttctattatttaaaatactttttttagaattaggataaataaagtttacttttagattattaggcgaaaatataataaaaatcaccacctatatttagtaaataataaaatatattcctaattagataaaagtataataaaaagttcatatttatataaaaataatataagaatttaaaatggtttaagaaaggataagctatgagacaatttaaaaaactaatatcattaacagctatagctatacttttatcaacaaatttaggttttgcgcaaagtaaagcagaaaaattaatgccatctgcagatgtagtttttgtaaaccttaatttaaaatatcctatagttcagatggttttgaacaaagatactgattttaaagaagaagatataattttatctgcaatttcaattaacaaaaaacttagatataatttaaatgatttaacagatttatacaaatcagaaaatgaaaaagtgttagtaagatttataagagataaaaaagaatattcacaaatttttacaagtaaagattttagaggaatatatttaagttttactcaacaattttatgggactataacagcagttaaagaagatggttcttttgtaggacttagtcataatataaaaggatcagaagttgctgatagcactcaagtatttgaaacaacatatgtacattctataaaagctacactttttaattctggaggattaaagccacatataaaagaaaatgaagatgggaagttaaattatataggagatataggtaaatatagtgattatggagtagaaggtaagttaaaagaaaataaatttgaagataagaaatctatggatatagctaagcctaaaaaaggaattgcatatatatattgtaaatctccaattactaatgaaaaaaaattacatcaaatagaaatattaaaaacatatgaagatggggcaaaaataaaagtaaaagataaagagcttaaagaatatagaggtggagtaattggaggaatgagtggttcacctgttatacaagatggaaaattaattggaggagttagatcaagtttaatttataatcataagataggttatatatcaaatatagactatatgctaaacaatgaaaaagataagagtgaaagtaatatagataagtagttatgaaaatttataaattatttttaatattaccattacttttttttacattagggtttaacaaattagatactttaaatttattagatgaaaataatccaaaatggcatatagatagtgatgaagatggtcttccagatgcttttgaagaaatattaaaaactgataaatataataaagatagtgataatgataaattaagcgatgaagaagagttaaaaagaggttcaaatcctttatataaagactataatagaagtttaaagtatgaattgagtaatgagtatataattgatgactttaaatcaaataaaaatatatatgtaagtgagtatatgttatttgaaagtgctgatcttgcaagtaaaataattgaaaaaaatcctataggaaaaactataggagagatttttaaagataagtataaatctataaaagattttaaagtaattagatatgaaaatggagaaagaggttttggaggaatagcacttagatgtggaaattctttaatagtttcatataagccaactagaagctatatggattggattggaaactttacaactcaatttatgccgcatccgcaaagagattatgctatagaatttataaaaccattagtaaataatgatacaaaagtatatataagtgggcattctttaggtggattattagctcaatatgcaacatatgatttagttaataaaggttataaaaatgtaaaaactgttacttttaattcggctaatacacttaatccaaagcatataaaaggtaaatatgcaccacctattataaagaatagtttaataaaagattatatagtagcatatatgaatttaatacctaaaaaaaatgaagattatattatagatgcatcatatataactagctttttaaataagagtatagagtataaaggatttgtggatataaataattatagatttaaaaaaagtgattttaaaaattataataatatagttaaaaattatatagtttctaatgaccctttatatttaattataaatggagggtatctaggcaaaaataaaattaaagaattagatattgaagatatagatgtagtgaaagaatcaataaagttatagatttatctaaagcaaataatggacctgatgttattattaatgtaacgaatgcaatatttgatgctattattcctatacctataaaaatcataaataatacaaataaaactcctataaatactaaccctgtacttaatactgttaaaagtatttttataagtttagttgataatccttcttcatcattttttaagtctggagttaatttattatttataatttcttttgatttttgatacttatctctaaattttaatttaattttatttaaattatcataaattttatcaaatcttttgttacttgaatttatcttgcttgaattcatttcatctaccaaatcccttactatagatttaggagaccccaatgactcaattatttgtatatcactttttccctctatttcgccatctataaagtattcttcataatctcttaatatatcattaacttcatcatctgaaaaatgattagataagtaatcttttaatatctctaaaaactctcttttattcaacacaactacctccttaatctaaatttataagataatctaccgcactagtgaagtttttccattcacgtttaagatttattaaattatctctaccaagctcagttattttataatattttcttgctggcccttcacttgattctagtatatatgtttcaaagtaaccttcttttgtaagtcgtcttaataaaggatatatagttccttcattaacttcaattactttagatatattttgtactatctcatatccatacatatcttttttatgtataagagctagcacacatatttctaaaacaccttttttaaattgtgtattcatatactctatcctttctacaataaacaaactactatgctttatacagtaccttgtttaattatcatatttttatattaacacaatactatgcattacacaatactatgttaaatattttttcatacctcatttcaaatgctagcaaaaaagctgttaagacactatataatatgtctaacagcttttttattatttaatatattccattattagttttatagtttctattatagcttttatatttgttctttcatatccatgtgatgcaaatataccagcacctattaaagcagttttggcatcatatccagctcttatcatagcccctgcatctgaaccatagtttggataagtatcaactttatatcctatattattatccttagctaaatttataagtctagtagttaactcataatcatacggcccacctgaatcttttgcacatatacatacatcatactcagttgaattttggccttctccagggcatcccatatcaatcgctataaattcttttgttttttctggtatagctgctgatgaaccatgaccaacttcttcataattactaaagaagaaatttatagtatttttaggttttataccaacaagttttatatattctattatatataaaactgctgctactgaagctttgtcatctaaatgtctagatttaataaatccagaatcagtcattttaactcttggatcaaaagatataaaatcccctacttctattcctaacttttgagtatcttcttttgtaaatacttcttcatctataactacttcataattagctggaattctttgtaattctctagcatctgaatgtatgtgtacagatggtttagtagtttgtatagtaccttcataaaccttaccatctcttgtatgtattttacaacactccccctcaatagagtgcatcatatatccgccaacttgagttagtgctaatcttgaattagatttaatttcttttaccatagctcctaacgtatctacatgacaagataaagttttttgatattctgtatcttccccttctatagtcgcaactatagctcctttatttgtaactttatagtctacattatgtgtttctaaaattttttttatatactccattatgttttgagtatatcctgatggactaggtatgtttaatacatcatttaaatacttttttactaaatcagatttataatccataatctaaacctcctattatctataaataaattaaatttaaataataaactaaagatattaatattagagttattaataatttctccataccaattattatgaattctactttttttaatggtatgtttattccacttgaatataatatattaccagttattgatatcgtttgcataatagatataacaaatattataaaaatcgatatattagatatatcattatttataaactttataactctattagcattaaataaacttaaacatatacactcgcttaattgtattttaatgctgttatttgtaatagcctcatcattaatttatgtcccttctctaatcaacgacaaagacaatttaagtttaaattttaaaagaaaaaataagttgtaagagtattaaattatactcttacaacttatttttttatctatactatttttatttatttttactacaaatgaaattataaaaaatatagatatagatacaattcctataagtatcaaactaatatttccatttaattttatattttcttttataaaaaacattggcactattaatatcaaagctatagtattatacaatatcttatattttaatgattcttcatttaatccatacttactagctctatacaattttaaatatgtcaatattaatgaaaccacaagtgctcctaataatatgtaaacaaagtatttagttaccaaaggcttgtataaaattaaatcacaaactaaagctagtatagcaactacaattgaaaactttttaaccgtttctaaatatacaatatataaagatgtattttttatataattttcacataacttatcacaaaactcttttggattaactatatgtttttctaaattaatatttttagagcttaagtttacatacatattataaagcttttgacttatttctcttttgtgaatatccaacatctttaaattccttatatactttaccatgctagtatatactttaaaattttcttctgtgtaatttatcctactatcccccataaattcaccccattgaatttaaaatatttatatatattaattatatcacatgcaccgcttctttttttaatattcagatttataaaaaaaatactcgccattaagcgagtaaatatatactttagtatgtaagaagaaaatttaaaatcttaggttagtttaattataccacaaattccctatattgtacttaattgaactaaataaaataatcatttaaattaacttagctaaattatataaagttctagctccttcacctgtagctccttttgatttataaccaaaatctttagagcttacactagttcctgctatatccatatgaatccatggagtatttcctacaaattcacctataaacaatccagcagttatacaccctccatctcttcctgggctattatttaaatctgcttctttaccttttaaaacctttttaaattcctcaaatacaggcattctccatattttttcacctgataaacttgctgctttatctaatttgttataaaattcatcgttattagatataataggtgtagctactgtcccaagtgcaactactgcagcacctgttaatgttgctatatcaactactttagttacattttcattatttatagcgtaataaactgcatctattaatgttaatcttccttctgcatcagtatttaatatttctatagtctttttccccattgaatttattatatctcctggtttatatgcatgtcctgatattaaattttcacatgcagcaactacagcaactacatttttattaagtttagatttagaaattccacacatagcacctataacagctgctgctccacccatgtcagttttcatatcaaccatagaatttgtaggttttatagaataaccaccagaatcatatgttagtccttttccaactaatcctagtatttcattgctctctttatctccgttatatttcatgactataagcttaggttctttatctgagcctttagcaactgatataaatgcttccattcctaatttttcaatatcttcttttccgtagacctcagtttcaaacccatattccttacctaacttaataacttcatttgctaaagtttctggatatataacatttgatggctcatttactaagtttcttgatattaaagctatctcagcaagtaattctccttgttttatataatcattatagttttcatctaaatttaagtttatatttttatccacactttcttttttgtcacttttatacttatcaaaagtgtattctcctaacttaagtccttctactaaggcttcaatttctctataatttagattttcttttatatttaaaaaattaatttcttttatattagatttttttaattttttagatatattaccacctaaatttcttatatcatctatagatatttcattttttttacccaatccaactaacattaaatctattaacttatcctctttaaaaattttgcatatatctattttagaatacttagcttcaaagtctttaaaaaaagtatttaatacttcattttttaaatctacgttattgtcttcatatacgaaaaatacacttagctataaaatcaaataaatatctttcaccataaaaataagtataactgttcttaatattaaatactctagctaaaatataaattgctaataataagatataaaaaataattttataattttcttttccttcttttttataagttaatattccttttaatataattaaaggtgtaagtatagataaaactactactaccttattcataaaatttaacatattgaatcaccaagaaattttaaaaacttctccttaacatctttatatctatatctgctaacaggtacttcttctccactttctaaaattgcagtgtttaactttatattttctacataacttagattaactaaaaagcttttatgacatcttacaaatttgcttagttttaagtctttttctattttttctaggctataccttacatcaaaagtcttatttattgtatgtattaacatattctttttttgaacttctatatactttatttcatttgattgaatcttgtatgtattagacttattttttattaatatataattgtttttgttttcaatctctttgatacatgttaatacatgtttttttaattcctctaattctataggttttaatagatatctataagctcttacttcatatccatcttgaacataatctattaaagaagttataaaaattatctccattttattatctacttctctaatttttcttgcagtatccatcccattaatttgtcccatttgtatatctaaaagtaatatatctatttcttttaaattactttcaagcaactcttctcctaagctatatttttgtatctcatattctatatttatattttttaatatattgtgaagataattttctattagactttgtgtttctttttcatcttcacaaatcgctatcctaatcataagttcccccctatgcctactagtttatatattcaaatatgactttataccttatgttttaggataacatttttaaactatttttatcaatacttaaatctagtttctaatattgaaatgttttttagtttcaaattctattgcttttctttaaaagcaactatacacttaaataatgctactattgaaattatacatagtattcctaaattcactaattccattaaaagccatatatccccaccaaccaattttataagagacatattataactatcagctaaaaacttatagtgaaaaaataatctccctgataacattaaactcgttaaacttaataaaaatataacaactgaacttgcttttttcatatcacatactccttatcatcgatttttaaattttagtatttattataataatgggtgttacctttacaaaagtaacacccatgtgctttatgttcaatatatacggtgtaagtggtatttatataagcgcaactgtcatattttttattacttaatctttagtggtatatatatttttaatgtaaatttatttttttcatctataatttccatatctccatcatacttttttagagattcttttatacttgaaagacctataccatgaagaaatgaatcctttttgctactaattattttattattttttattttgatttcatttgacttgctattttcacactttatcacataataagatttaactatagttcctcttatatttatatgcctatcattttcaacttttttacacgcttctattgcattatctatcatatttgcaaatatagctgatacgtctatcatttctataaaatcacatttttcaaagtttatatcacaaaacaaatctatattattttttatacattctgaatgtttgtcacttaaaattatatctaatattctgtttccactatcaaatgtactctcaaaacccttaagctctttttttatactgtctatgtactcatttatatcttcattttcaatttgcttaatgcaagatatatggttattaatgtcatgatgtaattttcttactttcatttgagattcttgcatatttaaataatagttatattgcatatctaacttatcattgatagcttttaactctgatttagatttcatactttttattaacttatttataacttttactaaaaatatattgcaaaatatcataattactggtactgtattttgaattacctttataaagctagataatccaaaattcaccttatagtgtgtgtaatttgatacattatttgcaataatgttatataaatctaaaataagatttccacccacaaatacaaaaaatatacttatagtatttataattatgattaagattttttagggtactattatctaatattgactgaagatttatacccataaaatttatcaaagtaacagtcattacttcagttaatatcttaattcccaatattatcgctgttaaaataaaacaacgttctattttaacctttgaaaatatatgaagtataatagcaatagaaatatataaaaataaactactaattcccaatggtaatgtattttttaaaaaatatattactaataaatatgttaatatcatataaattaaatttttacgttttacattgtttaaagctatgcttgcagatgaaaaaatagctatagcttcaggtatacccataaaaatcagatctgatatacttattttaatcgtcccccttaccctttatacttttttgttatgttttttaatattaacatatttacttatatttttctatatttcgacataaatttcattttaaacttttatacaaattttactaagcttaatttatgcagcttaagatgtcttattattattcttttaatattatacgtacctttatatcttatttctaaacatacactacattacataaaagccttggcaaactaacacagcttcaacttactattatcataaatttcataatccccatcctttttaataaataaactgaaataaaatataaaaatcgcaataaaaaaagacttgagataactcaaatctttttttattgcaattgaaattaaaataataatactaatcctactatcatagctgataatgtactaactaaaaatccacctatcatacctttaaaagctatgttagatatttccgttcttctttctggacagaatactgatatacctgatatacatatacctatacttgatatatttgcaaatccagctaaagaaattgacataactaaagcacttctaggatcaagagtttttattatagttcctaagtcaccaaaggcaataaattcatttaaaactatcttagtccctaataattccccagcttttaatacatttgatggatcaagacccattaagaacccaagtggtgcaaatacgtaagatagtatttgttgtaatgataatcctattactcctaatgccccattaactaatgcaactaatcctgttatagcaattaatgctgctcctattccaaacgccatttgcataccattagtagcaccctctgatatagctgacattatatttgtgtgagcaccctttctatccataacaacattctcaacaacctcttcttgttgagtctcaggtattaataacttagaaaccattatactacttaatggaactaatgcccctgctataagtaagtattccataggtatacccattcctacatatcccattaaaactgtagctgacatacttcccataccagatattaaaactagcataagttcacttgtagtcattacatgtaaatacttacttacaagtattggagattctgtttgccctaagaacatgtttgcaacagcaacaaaactttctacattactagttcctaaaactttttgtattgctccacctattattttaactacaaagtttataactcctaaataataaagtgctgatactaatgctgctataaatactatgtttccaagtactgatatagcaaatatcattccattactagtattagctaatggtccaaatacaaaagttaaaccttctactccataatttaatacattagttacaaaatcagaaactaccattacaatgtttcttcctaaaggaaacttaaccaggaaaaatgcaagtacaaattgtattagcaaagcctttcctataagtttcttatttaccgacgatttgtcagtagatactaggtaaagcccacctaataatactatgattcctaaaatattgaatattattgacatagatttctcctttttctttagttttatttattatatatattatacactattttcgacatttttctaccactttttatcattttttataatttaatttacatatatcactataaattattatttatgatatatattcttctcattttttaagtttttatttatattttatgtaaaatgggattattaaatcccatttatatatttaaagcttccagctttttatttaaaatgtcagtgatcttttttatctacttttaatctatttgacataaataaatctatattagaaaaagcatctacacttttatctggtttgtatattattatattttttaatgtataacctattaatacaatatattttaaagtttcttcagttgatgcagctactataaacgctatataagataaatttaaatattcattattaatcttaattttaagtagtaaatcttctattgctattgctggaatacttattaaaattccaataaaaaatagctttgctaagaattttataggttccttttcatatttatctttaaaatatatccacattaaaaacgcaagactaggtgctatagatataattaataaatttaatttcatatactcattacctttcttattaaatacgtttctaatatattatttccaaatctcttaacaaaataatctatttattcatactatgtattaacaacatcattttaattaagaaaggagtttttttatgcaagatggttttttaactgtgagtgtagttgatagtactaacaattttccaattgttgatgctactgttaatgtttactctatggatactgaagatcaggtatctaggcttatatttcaaaatttaaaaacagatatatctggccaaattgtaggattaaatctagaagcacctgatttaatttattctcagcaaccaagtgatgttagaccgtatagtcaatatattgtagaagttataaaagacggttatgagacaacattaataaatggaactcagattttagctactgttatagctgagcaaggcattagaatgcagcctcttcaacgaagcagacgattgtactctagacaaaatgaaataataattgatataggtcctcatactttatggggtaattatcctccaaaaattccagaaagtgatttaaaaccaataccacctccaactggtttcgtagttttagataatcctgttgtccctgaatttgtagtagttcatgacggtatgcctgaagataaaaatgctcctaattattgggtttatttcaaagattatataaaaaacgtagcatcttcagagatttactctacgtggactagagaaactattttagctaatgttgtagctataatatcatttactttaaatagggtttttactgaatggtatagaagtaagggatatacatttactataacttcaactacagcatatgaccataaatatatacatgaaagaaatgtgtttgatactataagtgttgcagttgatgaaatttttaatacttttataaaaagacctcctacagctagacaaccattattagctcaatactgtgacggagtcaaaactcaatgcccaggtcaaatgacacaatggggaagtaaagatttgggagatcaaggacttagctatgaagaaattataagatctttttatggaaataatgttgtgtttgaaaaagcacctatagtaagtggagttcctgtatctttccctggagaagttttacaaatagggtctacaggaaaagacgtaagaactattcaaagtcaattaaatgcaatatcaaatggttatcccgctattcctaaaattaaagaagacggtatatataatgatgctactgctaattcagtaaaggaatttcaacgtatattcggtcttcctcaatcaggtgtcgtagattttaaaacatggtatgaaatatctagagtttatgttgctgttacaaaaatagcttcattaaatccaacaatttaatttatttaatttaaatagtgtagtaaaattactacactatttaaatatgtctatatatttttcatttaatatatggcttatgttatttatatctatcttaaattcaggtatacctgctgcaaaaggagcaatttcatataaatcaaaatatataactaacttatcatcttctatataaaatttttgattattagaaatacttttaaagctatatgctccatcttgactctcttttattttctctcttattatttcatttattacctttacataatctgaactttctttaaataaatctcttaaacttaatatttttccatcttctatatatatgttataagatttattttcataaaatccgtgggctcccccactctcctgataatatttaatcaaaatacttaacatattatcactatttttttttacatcaaaattaacattatatataaatggttttatatactctttcggtgtatttgaaagatatgatttagcatctttttctacactataataagctttcattatatcattttttattttttcatttatacttttttcaatatttattctcaatccatttacaaccatcattataatgatgaaataatatagttgtaggaagttctttattagttaagtagtataaaatatggatagtaccatctatatattttatataaggaaatgttatactaaaatttttaaagtcgtaatgtattttatgtaaaaatgaaaatttattactatctttgttaagttttaaaatatttatatcattatcagtaaaaataccatatatattatcattagaatctatatcaaaatgataattagaaaagtctatatttaaatgagttatattttcagacatagtgcatgaatcactatttttgaaataattataaagcagtccattttcaggtttaacaatcaccatatccttgttagattttctcaatatataagcacattcattaaaaaaccccataactacctccttaaaaatttattttataaatatatattaatttaaaagatatttattctattaagaatcgattaataaaataccaattaagtaacaattagcaaaacatatgcatattattaattaggcataatcaagagcctacattttaaaaagacaatcaaaggggaggacaaaactcaatgaaggatttaatgagatctaaaaaaatagttaacaaaagagtaatacagcctactcaaaacactgaaactagtagaagttatgtagaagcaaatgaattagatgaagatttaaacagaggatgtaaatcaaacggatgtaaaccacaatgtcatccatatgtacaatgtgatgatagagatgatcataactgcaattgcaatgatcataatcatgatcacaaccataatcataatcacaatcatcacaattgtggatgcaatacagattgctgcaattgccaagatgatgattgtacagaaaattgtttcccaaacccttgtcaagaagagtgtagtcatcctttaataccacctaagttttcaacatcacaagcaaaattatatccaatagaaactgacagaatatttgatactataatgtttagagtatttacagatggaaaaatgctaaatggtgatgatttaaatttcagatatgaattaggaaatttatgtggtcctctaccatgttctgtacaaactaatgtaactatagaaaaagtttgtataaattattctagtataactataaatccaggaactacatcattagagcaattagacattgaaaaagttgatggtaaaaaagaaaaatgcaaatctgtttttgagtataatgtttgtggccaattaaacagatgttgtaatgatagatgtttaggtcaaaatgtaatgtataaagaaaaaggattaaatgtagttgtacacgacttagaaatagaattgacaggtagatttggatgttctgaattcacagctatagctacaccatatagtaagtgcgactcaaattgtgtagtgttctactttaatactttatcaagtgatttagtagttccagctgatggaagatcatttactttaagacaagatttccaaactcagttaacagttgattgtataggcaaaggcataataactcaagaaataataaacaataagccatgtttcgagttagacatacctaatggaatagacttagtgctttgcctacaaaatatagttagtgtattgataaaagaacaaatagtagttttaggtggacctacaagaatacaacctagactagtagacacatttggaagtgtttgtgacttctcacaattcacaggaagctgtgataatgatagaagacaaggaagctgcgataacgatagaagataaaattaataagttatatacactaatatgaataattataaaaagggcattgataaaatcaatgccctttttataattattcatatcttatactattacagtaatcaaataaaacagtactagattttacattagaaaaatttacccaacacttatttgcaagatcaaatgccatagatttaaaattatttgattttattagattgctatatgaacatacaatataattatttgaaatattaattgtatatattgagttgttaactttacgtacatcttcaaattgatattctaaaagtttataattataaaagtcataatttatatgatgtatattatataaattttgacttttagtacgctattaaatatatattcaaattcatacgatgttgttcctacattacatatatctccaccttttgtataagtattttcaatatatatttttgtatctatatctaaatttttgaaaaatttaatactattatttaagtatttttctttatttttttcaaacctatttgttatcacataccctacatgcatattaaaatattttacatctatattaattaagttcttgtttagttctaatataaactttatccaagactctcttatataatctatattttcacaagtattaagttccataggaatatgtatacctatacttatattattttcttcaaattttttagcatatttaataacttgcttacattcatctaaattgtcaattcctatctctatatgatttatgtatttattacacttgcatatatcaatagctttacttatttcatgaactaatgctggtatacctattttcatatctatacctctatgaaatctttcctattttattaaatggtagcaatctaaccataacttttcccattatatcactttcttttactattcctacttgtggatctctgctatccatactattttctctattatcccccatagcaaatacatatccttttggaatagtcatatctatatctccttctgtttttgctccatgtatgtatttttcatcttgaagctttccatttatatatactttattatcagttatctttatatggtctcctggaactgctataactctttttactaaatcctttgcttttccattatcttgtaataaatctgtcttaaaaacaattatatctcctcttttaggctctttgtgatcatatgcaattctatttattatcaaataatctttttcttctagcgtaggatacatagatgatccttgcactagtgttggtctaacaaagtgagttattataagagcaataactaatgatacagctattattttaatccactctattatctcctttttaatgtttttgctcaaattcttcatctccttcatgctctacatacttagataaaagctctataattatatcatttatatgctcatactttttagtatttatccccaaatctaaaagttcacatgccttaattaaatcatgtacaacttccatagggcttccatatatagcttctatatcttccctactaacacctctgaatccgtggcctactggactttcatttcttaaccttattaagttttcaagtttttctccatttaatatttctaaaactttatccatccgcttagtttgtttaagatatctctttatatattgagttacaccatgtattaggttaccattatatatattatacttctttttaagagtatatagtatatttttcttagataccatatgcccatgcattgacactacatattttttatcttctttggaattaacaaatatatatttaaataaagcttcttttaatctgtaaagtcgacctaaaaaatctatgtattcctcgttaactatctgaatttttatattctctattaactctgatagtatgtcttctggatctccatcatttaaattttctaagttagatataagatttttaatctcttttctttctaacataggttcacttaaatttttagcaatactaagtgctgtcttaaagtcaaaattagtagcatatttacatgaatttaataaatcatataaatctccactttctatacctgcctcaattaatatatctaaaaccccatcataatcatatctttgtaagaacttgcatataactaattcctgacttttatttatatatctcatctaatcactcctattgattattttctttttcttcttgttcttaatcttataaatctcttccttgcataatcagtataaatatctactttatctaaacttattttccataaatatatcaaatataaaagaaataatactgttgcccaagttgtttttatcattaataaaaaatcgaaaattccatgaagtattattggaataaataagattttaaataaattaattttatttgtattcttatttttactattaaatttatatatagataaataataccccatagctatagaaaacattattaaaacaattaatattaaagtaattaatttagtatttttgtcttttcttaaatcataatcatttataatcaaaatacaattcaaactaataaatgcagatattatatatatataacttaacattttaaagttaaaaaagtttagaaaaaatattaaaactataattaaattaatacttatattttttttgtttttatgagaagttagacaaaatatactagctattaaaagtgacaaattcattatatatattaatttatcaaccataacttattccccctatacatttatggttatacttttttaaaagtatatatcagcaaactctatatgcattttttcccacataggtaaattgtagttatttacttctattaaattttcatcacttatatttaagacttcttttaaagatatcgtgaacttacttccttttccttcttcactttccacattaatattacctccatgtagatttacaaaagccttaactaaggacaatccaaccccacttccttcagtatttctagataaagttttatctacttgtccaaactttgtaaatataaaactcaatcgatctttcggtattcctactccataatctttgatacttatatttgtatattctttatcctttgttatctctatatctatcgaatttttaatatcactaaattttatagcattagatattaaatttaatattatacgctccatcttgtctatatcaacttttaaaacacttgaatctatatctgttttgaaatttatgctaacacctttatcaaataaataatcatttgcatatctaattatattttttgtaaatttaattatgtcgcaatatacaaaattagttaaacatgaaccattttcgacttctacgacttcattcatattatttatcaacctttttaatctgtaacaatttcgtttaacaagattattataattatctatatgattagatttatatttattagcttctaatattttatttataattataatattttctataggatcttttagacatttagatgtattgattaaaaattcatttttcacgtgatgttgaacatttaccaaatctagttctttaatagcttctaaaattctatcttcatactctaaaggtcttattatgaccattaattgattttcttctttaatatcttttatagttattcctattgggtagctataatttttattaacctcatatcttttagtctgtccataatattcattagagatataatcatttataaatttatttatagaatccaccttaactttttttagaatttttatcatagatctattttggtatacgtattctttactttccttgtctataacaattattccgtctggtaaattttgagccaatgcttgatatgtttttttacttccttctaattgctttaatgcagcttccatatcagttatatctacaactatacttaataatgcatcagaatctttgacttcaatttttgtagttataaattcgatgtacattccatctatagttttaaatttattaactgattttttaactttacctttatttacaatatttaaactttcatttaatttcctaatactagatttatctatcttgttttttatatcctgaaaacttatattctcattatttttatcaatattaaatatattcattgcagaatcattaatataacttataccatcaatgtcatggattatgacaccatctattaataaatccataagctttctatatttttcttcactttcttttatttgcttttggattaaggtgctttgagttatatcattaaagatgcatatttttaattctttatcttctcttttttccttagtgcatataaacctatatactttatcttcatagctatataaattgatagaatcatatttatttgattgtaaattatttatcatatttaaacactcttgtccatttttaaaactttcacttaaatagtttaaaatatttactttatttaaatttatactttttgtattccaagaatgtttattacaataaattatattgtttttttcatttaatataactataggcatatcagattcttctatagctttatttatgtcttcttttatttctaatacttatatatatccctataattaaaaaaattaaagttatattatttaatttttttacattttgaaatatatctctaacttcctcaaaatgaatttttccttgagctgatgattctaatgtaggtaaattaaaatctaaatcactattgcttgtattataatcaattaaataatcataattaagctttatatcttccttagtcatattacttaactttggaatatttaaataatctatattaaaataatataattgcttaaaattaactgtaaatttaataattgaagttattataaacaagcttattgataatgaaaatatcaagtttaaaattctacttttactataccccatatgttttacctaaacaattttagttgtgaaatcttctatattccacacatcatccactatatccatataaaattcaggttcatgagatactaataaaacagttcctttgaattctcttatagcttttttaagttcatctttagcttctacatctaagtggtttgtaggctcatctaatactaaaaagtttattttctttaacattaacttgcataatcttaccttcgcagcttctcctccacttaaaactctcatttgactagttatatgctcatttgtaagtccacatttagataaagcttgtcttacttcaaagtttgtaagtcctggatactctgcccatatttcatccataggtgtattgctattttctcttgagctttcttgttcaaagtaaccaacctctaaataatctcctagctctactttaccatcaaatggcttaattattcctagaagagtttttaataatgttgattttcctataccattcatacctcttaaagcaattttttgatttctctctaaagtaaagttaagaggttttgttaatgcctcattataacctaaaacaagttcatctgttttaaatacaaatctacttgatgctctagattccataaatccaaatgtaggctttattttttctttaggtctttctaacatttccatcttatctaatttcttttgtctactgtttgccataccacgagttgcaactcttgctttatttctagcaacaaaatcttctaatttctttctttcttcaacttgcttttcataagcttgttcttcttgtctcttctttatatctctaagtctttcaaattcatcataatttcctttatatctattaagctctccattttccatatgataaattacattacatgtatcatttataaatggtatatcgtgagatactaatataaaactattttcatattcttgaagatatcttgttaaccactcaatatgctctacatctaagtagttagtaggctcatcaagtattaatattgtagggttttctaaaagtaactttgtaagtaatactttagttctttgaccaccacttaaatccgtaacatctctatctaagcctatttcaccaagacctagaccattagctacttcttgtattttcgcatctatcatataaaaaccactattttctaaaatagtttgtatttcagctgttccatccattagttttgtcatttcagtttcatcagcttcacccattttatcatacatacttatcatttcttgttctaagtcaaacatgggcttaaaagcatctctaagcacttctcttatagattttccttttgttaatactgtatgttggtctaagtaaccaactgttactcttgatgaccattttatattacctgcatcaggcattaatttctttgttattatatttaaaaatgtagatttaccttctccattagctcctataagtgctatatgttcaccttttctaagtctaaaagatacattttcaagtatagttcttgcaccaaatccatggctaacattttcaactactagcatctaaacacctcttcttattttattatctatatcataatagcttctttctttaatcaaatcaagtgatacaagtaatttcatgtattttcatatatatttaataacgaataaaagctctctttaattaaagagagcttttattcgttattaaaataattatgtaatacattatcaaccaatagtagatcccaaggaaaatgaaattgtaggatttgaagcattaatcagatgtaaattaaataatgaaattataatgccaaatataattatagataatattgaaagatatgatatgatgggtgaagtatctatatggatacttaaaaaaataataatagactatgaagaaattaaaaatattgagaatctatcagaagagttttacatttctatgaatatgtctttaaaagaagttgaagatgataacatattagcacaatttaaagaaataataaaaaattcaaatataaaagagaaatctatatgtatagagattactgaaaacaattcgtataagaatcaaaaaaaaacagaggaaaatatagaaaagcttcgggagtatggatttttagttgcactagacgattttggagtagagtattcaaatatatctatattaggccaatttaaatttgatactgttaagcttgataaatattttattgacagcattcacgaaacacctattagtaaaactgttatagaaatttttgattatttatcttgtatgaaagaaaaaaatataataattgaaggagtagaagaaaaatctcaagttgattttataaaagatacttcatctagtaaattttatatacaagggtatttttacagtaaacctttagaacttgaagatttaaagaactttaaattaaatataaactaaaaagatgtagcttttaaaagttacatctttttagtttatatttaatttttgattttaaaagtaagaaatgataatcaatttcacttgtgctataatataaaatatgaaaggagcttatattatggaaaatgtgaataaatttcaaagttttataatattatttatggtttttataggaataatattaggccagatagatttaattcaagcatactcagaatatttaataatgccttctttaatggcaatgctatttttagtatttatacaaattccaataaaagatataactaaatcatttaaaaatatgaagtttacattaacatctatttgtataaattttatatggacgcctatcttagtatttatacttggaagaggatttttaggtaataatcctgatttattaataggttttgtaatgcttatggtaacaccgtgtactgattggtatttaatttttactggaatagctaaaggaaatgtagcattaggagcatctattttacctttaaatttaatacttcaattaattttacttccagtttatgtattcttaattggtcaatcaagtgttcaaatggatgttttaaatcttttaaatggagtaattgtaagcttgataatacctctttttggagctttaatatatagaaagttgtctataagtaaaaagggaatagattattttgagaaaaatatagtttcaaaagcctgcgattaccaaggttactttttaaatatagctatagtttttatgtttgcctcacaagggaaaatacttcttaaaaatcctcagatacttttacaattattaatacctgtattattattttttataataaatttaattgttggtcaatttgtaggaagaaaactaaatttaagtcatgaagataatgtagctttaaatttaactacattagctagaaattcacctatagctcttgcaatagctgtagcgacatttcctaataaaccactgatatcacttgcacttataataggaccattaatagaactacctgtactttttatagtatctaaaattttattgaatataaataaagaagacatactttaaattaattttttattttaaaactaaaagaataaatattaatttaagatttgacttaaagattaagggtatatttataattataaatcactacagattggagatgttcaagttgaacaaggatttaaaagaaaaagaatatgaaaagataaaaaaagatgaagaactaatggataaagaattattaggtaagaaaatactagaacaaaatcataaagattttgaattagaagagcaattagatgcattaaaaaacttatttttaatgattctaattcaaaatataaaatacaaaactgaatatgaagtaatttcaactatgtacatggtttttataactggatttataatattttctatgattggaattaacgatattcacagtaatattgaagatgatttattaacttatatgagtgaaaatatacattagaaaataaaaaggaaaactaacttacttaaaagatagttttcctttttatatttaactttttattttagatatgaaattttcatcattagaaaaaatatcaacacctctatcatcatataaaaagaaaatatttttacttttattatccataataaaaacagagcaatctaaaactgtatcttcacatatatcagaaagaattattttttcaaaaagcaatttaacatctattttattcgtattccaaacatatcttgtaccgttgaaattttcatcatcatcactccacttaaaatagtaaacagagcatttagctgaatctaaacaactttctataaactctttttcacctttattataactgctgaatttgtcttcaaataaaactgttaaatcatttgaaaatccgcattttttccataaatcgtatgcacgtttaacacataagtctacatattcaggtctacaaatagcttcatcattatcataaatttcataataaggagattcatcttcagctaaataaaatgaaatacgacttttagttttatttaggtaattgataattaaatcatttttatataaatccattaaagtttcatcctttactaaaatttaaattataatatacaatcatttaaactcttatccaattataacattatttataaaatatatatttaaaattaaagctaaaattagaggaaaataaaattagaaagtaaattgtatataaagtgataaattatagaacttgtaattataaacaaagggggggaatcactttatatgataaaacacctaggaactaaaacgatagatacagatagacttatcttaagaagatttgaaataagtgatgctaatgatatgtttaaaaattgggcatcagatgctgaagtttctaaatttttatcatgggattcacataaagacgttatggttactaaatcacttttagattattggattagtgaatatagtgatgataaaacttatcattgggctattgaacttaaagaacttaaagaagttattggggatattaaggcatataatttaaaggataagcgttcttcttgcgaagtaggttattgtttatcaagacagttttggaataaaggtattatgagtgaagcattaaactcagttattaagtatttatttgaggaaataaacttaaatagaattgtagctatgcataatactgaaaatattgcttcaggtaaagtaatgataaaaaataatatgaaatataaagggactttaaaacaagtaggtaagttaaatggtaatttttatgatttaaatctttactcaattttaaaatctgaatggaaatcttaagtattaaatgttaatgtcagaagggaaactatccctcgtttagagaatgctaagtacaatcctttacttgaattatcagtctttaatttttaaatggagggttatattttgcagaagtaacagaacttggagatttaccaaatcttgaaatagaggaaattcaatttttttataacttgccaagtgaattaacttatccagaaattcagccttgtttacttgataaagtaattaaatacattaatgattagcaaaaaatatatattttaatgctataggagggattagcatagaaattaaatataccaatacattagaagattataaattatcatataaagtagatccaaaaataaataagcgttcttatatagtatattgcatatttttaatagttttgttttctatggctatattttggggactaaaactaactttagatataatatcagaaccttatttaatacgttattactatctttatttcataattatatttattgctctattaattgtgtcttactgataaaatagcatctttttttatagtgaatatggtaatggatgaaaaaaagtataaattgtataaagctaatattaaagctttgatatatctagtagtaagtgtggtatctgtgatattagttggtttattttttaacaaagtaattcaaggaataatacttttattatgttatgtactaataagaaaatgtgcttatggatacaaaaacaaaaattacataatacgtttagcattatttttaggtatatttatattaactatatatataagtgactatgaagatataactacttataaatctttagttggaacttttacaatactaagtgttgttggagtgtttatactatctccagttaacgatataaaaaatccaattgaattaaagaaagtatctaagtataaaaatatatcaagggtaatttctttaattgtagcaatttttacactaggaattttagaaatacataatttaaatgaatacgctgcatttacatctagtgctttattttggagtgctataatgttagttttaggcactataaaaaattacataagatattaaattaattgttatttttatattaaaagggtagatactaaatactgaaaactagacaaaaaaatattataagaatataataaattagaaatctaattatatagaggtggattatgaaagttttaaagtatttattgatttttatacctataagtattataggagaatttatgcatttgccacctacagtgatgtttgttttagcagccttatcaataataccattagctggacttatgggagaagcaacagaagaaatatctttttacactggacctaaaataggtggatttttaaatgcgacttttggaaatgcaacagaacttataatatcattttttgcacttaaggctggattatttgatgttgtaaaagcatctattgcaggttctgtaataggaaatatactacttgtacttggggctagtatgttgtttggaggattaaaatacaaaaatcaaacctttaataaaaaagtaatagaggtgtcttcaagtatgttgttatttgctgttatagggctttgtatacctgcaatatttacacatacaatagaggctaatctactaaatacaagatatgaaggtttaagtgttatggtagctgttataatgtttattatatacatactaagtttagtattttcattttttactcacaaagatatatatttaatagatcatgaggaagaaggggaagctaagtggtcacttaaaaaagctatattagtattggcttttgcaactgtattaatagctattgaaagtgaatttttagttagtggagtagatgctataacatcaactttaggcttaagtgaattctttgtaggtataatattaatacctattataggaaatgcagcagaacattctactgctattgttatggctatgaaaaataaaatggatgtggcagttgaaattgcaattggttcaagtttacaaataatattatttgttgcaccagttttaatatttttaagtttactatttactcctatgagtatagtatttaatcaatttgagttagtatctttaattgtttcagtacttatagtaaatagagtatctaatgatggagaatcaaactggcttgaaggtgtacaattattatctgtttattttataatcgctgcaggatttttcatattatagaaatttaaaataagactacattaatgtagtcttattttgttataatttaatagtatgatacttaatattatagtaaaattacaaaaagttttaagggggattgtgacaggttttaaattaatataatattaataaataatatttaaaaaatcttaatgggggagaggatttaaataaaaaaactatcaaagtattatctaataataccaagggtatatgtagaagttttataatgaaagaaattaaatatatttaattagtaaaaaaataataatattatgtaaacttttggatgaaatttactgatataaaaaatatgcaaatattaatcacttagtattatattataagttataatagaatactaagtgatatttcttttattatgtcaaaatattaatatataatagtgattactaaaattttcttaagaaaggaagagataaatgaataaaaaaacagcattaattacaggagcatctagaggaataggtaaagctattgcaactttatttgctgagaatggatataatgttttaataaattacaataattcagaaaaggaagctctagatttatataacgagttaaaaagcagaggatttgcagttgatacatataaagcagatgtttcgaaaaaagaagaagttaatcttatggtaaattactgtataggacagtttgaaggaatagatgttttggttaataatgcaggaataagtaaaactaatttgtttacagatataagttatgaagaatgggatgaggttataagtacaaatttaaatagtgtattttatacaactaaaaaggcattacaatatatgattcctcagatgagtggaaaaataataaatatatcatctatatggggaatggttggaggttcttatgaagtacactattcaactagcaaagcagcaattataggaatgtcaaaagcacttgctaaggaacttggtccttcaaatattcaggtaaattgtatagctccaggggttatacaaactgatatgttagataatattgaagatgatgcgcttgaagctttaagacaagaaacacctcttatgagacttggaacagtagaagatatagcaaattgtgctttgtttttagcaagtgataaatctaattttataacagggcaggttataagccctaatggtggatttgttatagtataaaatttgggagaatattaaaatggaatatagttttaaaagacttattcgtctaattataggcttatttgtttgttcagtaggaatagttttaaccatacattcaaatttaggattatcgccttgggatgcattttatcaaggtttatcaaaaaacttaggtataacaatggggcaagctagtgtatcagtaggaatgataattattattgtgaatataatattaggcgagaattttggagtagggactatattaaatatgatacttataggtgtatttatggatatacttatgttaaataaaatagtgccaatatctaaaaatataataactggaatcataatgatatttataggaatgtttataataggtgtaggttgtgttatgtatataggtgcaggttatggaagtggaccaagagatggaatgatgatagcacttcaaaaaataactaatagacctgtaaaactgataaaaactattatagagatgtttgcattaatatttggatatttacttggaggaagtatcggtataggaactgtgataactacaatatgcttgggattagttttacaatatgcttttgatatttgtagatttgaaacaactaaagttaagcatagatacataattgacgatattacatatataaaatctaaattactaaatagatcacatgaaacatgtattactaaaaatttagaagaaaatatagatgattaaaagaaagcttatgctttctttttttatttatatataaaaatgtagaaatagataacacaattgcgaaaattgatacatatagtataaaaagaaaggaaattatataaggaggatttaaattgaaagtttgtataccaataaaagatgaaatacaatttcaactatacaatgatataaataatactccaaatataattatattcgatacagggactagagattgatatagatttaagctttaatatagataaagctgtaaaaaaagcttttttatacacaagacatgatgatatattcacaaatgtaaaaagaaaatttaatcttcgtttaaaagataaaaataaaataaaattagtatcaacttataatgaatataaactaagttctattataaataatatatgtaaagatatagatatagaaaaaactgatgcaactataaatataaatgataatggttctattaaaagaactaaagcaaaaaatgggaaaaaggtaaataaaataaaattaaaagaaactatctatgatatgatagtaaataaaaatcttagtgatataaatataccagttgatataactacacctaaaatatccacagaagatgttaaatctataaatacaatactaggtcagtttagtactacatttaaccataccacatcaagaggtagcaatataaatatagcaggtaaaagtactagtgataaattaataatgcctcatgatgaattttcatataataaatcaactggacctagaacatggcataacggatataaaactgcaaaagtaataataggtggaaaatatgttaatggtgaaggtggtggtgtttgccaagtatctaccactatatacaatgctgctttaatttcaggtatggatataactgaagttcataatcatacatttgcatcaagatatgctccaatcggacgtgatgctgctgtttcatatggatatactgactttaaatttcaaaatcctctaaaacatcctatatatattaaaaatatagttaataatggtgttattacatccaagatatatgggtgtgatgaagatagagaaaaaatatatataaccactaaaactatatatgaaaaagataaaataaaagtagatacattaagaatatatttagatgaagaaggcaataaaattagggaagaaattgtaaataaaaacgtgtataagaaaaaatagaataaaatgtgctcctcaagtttgtggggaataaaaagttgaaggcagttattcgaaaaataattatataaatttaaagggataaaggtttaaaacctctatccctttatttcttgaaccttgctatctattaattgcaagttatattgctcaattatttgatttaatagctttttatatgttaaatttccactttgatcagatactgtactatatccagaattttgaagttcttgagcttgctctatatatgtaggtttattaaaaacacctttatatctaggattttcacttaaaaacttagcatggtcttttatagaatcagcttttgatttataggctctaaattgatcgtttataacttgattataaaattcactagtttctatatttacagaatcacctttccaagaagaatgagcttttatcccaaataaattattatatttagaagataattcggattctccccaattggattcaagtatagcttgggctatagttatagatggcaatattttataatttttataattatctattgcactattttctatagagtctataaatgccatatactttccatcgggatttaaccttgatggttttaatccataatattttaaatcgcctatatatttattaactcttttaatctctcttttattaaattttaatttagaaagtacgttttttaatggttctattttgtatgtatatttatctttgattataaataaattagcaatttcttttatttgattattagatacatttttaaatttattatcatctaaaactcctattatactagctacatacttccaatttacctgtgccttagaataactaacttgatcagtacattttataaacttttctacgtctatttcttttttatttatttctcttaaattaaacattacaaaatatataataaatgttaaaataaatataaagcgttaattttttattaacgctttatatttatttttataattgatttatatattccttcaatttactttttaattcttctctctcatattcacttatatatatctctttagaattttcaaatataccttgatttgcttttattatttctttactagcttcactataaatttttagtaacctattttttatatcatcttttatactttccttaaaattttctatatcttttattatttcattacttaactgttctttcttcaatttatcatatataactttacctattccacctgttaaagtacctgctaaaagtaatggtggacaataagtaagcattgcagctcctacagttaaactctgagctgatgttcctaaggctgctgcatacattgctacagcactccctgatgtagctccaagtatagctcctgttcctattgtagctagcatttcatttatatttatattttcttcatttaattttacttttggcaattctatattgtaatttttataatctatagtatctataaattctcttatatttttatttgttatatagtttacttcctttatacactcatcccattctttaaaaaacatttcatctaattctaattttttatcatttataacattatttatataattatcatttatatattcatttgttatatctatacttttatttattctgcttatttcttcaaataaaaatactttatctatccactcatttatttcaaattccattttagcttgtatataatcaaatttattctcaagtaattttttatgatttattatttcagattctaccatttctaatgattttaaataatcatagtgataaattttttccttatgttttaaggcttcaattgaagattttacactttctatttttagactgtcatttttgttgctaacttcatttaaaaattctaaaagcttactaaagttatctttcaatatctgaggataatctattaccatatcattttctttgaccatagcattcttacttatagtatgttgatactctaaatatgatgatattataaaaaatttatctatatatacactatattcatcattaatataatctaaaatttcttcataatcactttctaataaatctgctttatttaatatacctactataggtttaccataagatgaaattaaatccacagcttctttaatatcctcctgccctatatgagttgagtcaaatacaaataatatcaaatctgcactttgtatatattttatagattttttttcattttcttttgttatactctttagccctggagtatcaactatactaatatttttcaaaatttccgaattaacgcctatatttacacaattacaatctatatcataactatattcactgttatagtgtaaatttattatatttgatgtggcttctaatacatctacttctgaaacttcttttcctataatagaatttactaatgtagatttacctgatttaacttctcccataataactattttaaaagttgtaaatggcttatctaaaagtatatccaagttattcataacatcttctagattatgaactatgatttttttaaacggtatattcctttcctttgataaataatttctaattggagattctattaaagtatattttatttcctcaatataactatttaaattatccattgtcatccccccatttttttaatatactatctatattatttatatatattaaatgatcttttattaattcataatctgtatactttcttctaaatgatgtattccttttattaattaaaatctgttatttagcagatagattagcaatgaaaggatggcaaatacctgcatatccattacctataaacttagataaaactataatacaacgtatagtatgtagagcagacttaagtcatgatatggctgaattattcataagagatttaaaagcagctataaaagatttagataatgcaaatgtattagtacatggtaaaaaagaagaaaacaaagtatatggatttactcactaaaataaagtgatatgttttattcagcaactggtgctatattattttcatcagttgctctttttatatctaagaattcatcattaaatatttaattattggaaaatgtagtttattatttgtaaatttagtaaagataagttttacatatgaaatataattcggaggtaatagaaaatgaattactatattagtatactttttagagctataccactagttatgggagccatatgtttatgttatggcttttatgtaaaggatttaggtcaggctatgggatctgaatttgtagtagcaggtcatgttttaatttttttaacagctatatgtatagctttatttacaacagcagcaactataataagacaacttataaataaatataataacttttataaatgggcattacctatattaggatatttatctgggatatttacaatagtttcaggtattgttttatggcaaatgggaatttataaccctccatattttgtttcaggaaatgtagttttcggactaggattaataacttgttgtgtttctacagtagcgacagcatctactagatttatgttaattcctaaaaatggtgctaatttaaaagaaggagataaaccagaaggtgcatttaaagaatctacagtaaaaactcttatatcaataccaataatatgtactgcgattggactagttagaggtatatatttattattctcatctacatcaagtgatcactttgttgcaggacatgtacttataggtatatcactagtatgcgcaagtttaatatgtttagtagttagtattgttagacaaatacaaaatacatttacagataaagaacgctacaaatgggcaataggtgttgcagtactagggacaatagatattttatggggaattgcgatactttgtatagctaaagagccagcatggatagctcctggatttgtactaattggcttaggaattatatgctacagtatactaagcaaagtattattactaggtatggtatggagaaaatcaaatccactagcaaaaagagttccattaatacctgtattaacagcacttacatgtttatttataggagcttttctatttgaagctcagttatttaatatagcttactttataccagctcgtgtaatgattggacttggagcaatttgttttacattattctctatagtttcaatactagaaagtggaacatcaaattcaaaataaaaattaaaaaattattaataatgtgtttaaacaagtttaaatgaggtatatataaaatataataaaaagcaaaggaaaacttagtaatacgaagaaaaaaacatcttatgtaatataaattatctaaaatggatttaaataatttaaaactaattaaatttgcggtttattaaaaatacataatataatatatatgagttcatatatataaggaggcttttaaaatgttatttggaagaaaaaataaattaggagataaatatgatactccagtatttgggacaacagaatctggctctagtatacctaaagatgtattagggaaagattctattgctccaaatgtagcttacagactaataaaagatgaattaatgaacgaaggaaatgcaagacttaattcttaagttattaaatttaagtcaagttcaaatcatgaatactataaaaaggaataatttatataaggatttctataaaatcacaaatattgcaaatttacacatattgatactagttttaattagattatattcaattattattttaggtaaaaatgaatatttaaaaaacttaaatttagagatagttatatgtaccttgttttttataattgaagcagtgctagttacttattttaaaagaaagataaatgatatattgcaaaatggaaaaataaaaaatattaaatttatgagctcagaacctagagtgataaactttgataaatataaaaatctaaataaataagggactattctaaacagtccctattatttgtgtgacaaaatgtgctattttatctgaatctatagagtttttaaacttagccatattatctttcataaatgatattctatcatctaatttttgctttactaatgcatccaataattcttttaaatcactttcatcgttatatataatacctatgcctttatctataataaatttggcattttcaatttcttgtccaactttaggaagcataacgactataggtatttcgctttttatggcttcaaacaaagttgcaccgcctggttttgttattaatagcgtatgctcttttaataaagatggcatgttagttacaaagccaagtacatttatatttttaaggggttttttatcagttaatttatcatatagttttttatttttaccgcatacaatagtaacttctaatttatcactatattcatgtattaattcatctatgtagtaaaaaaaatcagtttccatatcaaatagacctctaccaccaccgactataagcagtttatgtttattagaggttaagttagaatggttattaaattctttttttacaggaacacctgtgaccttaattatattaggatttatacctttttgtacgtatctgtttttaatttcatgagaagcgacaaaatacatatctgtactagggtaaatccactctaaactatctacgacatcagtaactacagttatagcaggaactttaaaatcaggatttttagatttaaaatgatcaacacaagcacatgccattggaaatgtagatattataaggtctggattagtatctaaaatatactcagataatttaggtgtatacatcttatatgatacatcatgttttgaatcaaatgacttttttagatagtaataataattataaagtcctggagtatattttgtattagcctcataaagtttaacaagtggtttgttcattttaggaagactagcacttataaagttttgtataaccacattatatgtaggttctttttcaagaatgtaatctctaatagcattagcagcacttatgtgtcctgcaccaaattgagctgtgagaattaagatagttttattggtattatccaatatatcacctcttctttataaatttagctgatgatagtattatacatttatataattattaaatcaaatatatattaaatatatgcaaaggagtgaataaatggaaggaacaggtataaaaagtaaggaaaatttatataaagattttgaattaatggattcatttagaatagtaatatattcaatagtaggtatatttatattttttatacctataaatataaatggacatacaaatacaattttatatcatatgtacttttttatacaagaaaagtatatagaattaattaaaatatatatttttataatggtatctataggagcaatattgccaataataatagttatttttataactccaaatagctattgcttaaataatacaagctctaaattgcctaaaataactattgtttcaccatataatgctcaacaatatataatttctaaaccaactataaaagctacatttaacagtaataatatagataaaaattctattaaactgtatttaaactataaagatgttactaaagattgtttaataaataataattctatatcttataaacctaaaaagaaattaaaaagaggtactcaaatagtaaaaatacaagtcaatgatttagagaaaaataaatcaagtttagagtggtattttaatgtaggtacacctaattacaatcattattatggactgattcattctcatacatcaaatagtgatggtcatggtagttttgaagatgcttattatagtgctaaatttaatgcaaaattagacttttttgctataactgaacactctaatatgctagataatgacgtaaattctaaattaaatgatgcttctaatagtaaaaaatggaataatttaactaaagtagctaatgattataattctaatggtaaatttctagctattaagggatttgaaatgacttatccatatgaaaatataaaaaatcctataggtcatataaatatatttaataccccaggttttatatccacaaataacagtttatattctgatttaaataatttttataaagctatttctaaagaagataatattatagctcaatttaatcatccatgtgatacatttggaaagtttaacaactttaaatatgatttagatgctgataatgctatctctttgatagaggtaggtaatggatataaaaaagatattaataaaaatagattagcatttgatgaatatcaaaaagctttagatctaggctggcatctaggacctactgccaatcaagataatcatataacaaattggggagttgcaaatgaatttagaactgtagttttatgtacagatttaaatgaaagtgcattttatgattctttaaaaaatatgagagtttatgcaactcaagataaaaatataaaaatagattatactataaacgatgaaattatgggctcaactataaaaaatgcatctaatttatactttaatattagtgtaatagataatgatattaaagataagataaaaaaaattgatgtcatatctaacaacggcaaaattatagcatctaaagattttaattctaatttagctaaactagaatttaaactaaataacttaaaaaattcttattattacgttaaagtttatcaaaataataataaagtttcagtgactgctcctatttggattgaatttaataaaaagtaatgatgaaagcttatcctttcatcattacttttatataaacgcctactccattggtagtatctgttgttattacatgtgataatgcacctattatttttttattttgaactataggtgatccactcataccttgtactattccaccatatttttttaataattttttatctattattttaaaattaaaactttcaatatttccattatcatttttattgactttagttattttaattttatatcttttatttttttcgttctgattgtgtttcataataacatatgcaggaccttctttaatatctttttcatctgcaaccttatatgtttttttctcttttaaatctgatttaaaatttactttaccactaattccatattcatctattttaaatatattaccttttgattttggtattttatttccatttatatttccaacatatggagataaatggtactacttaagatcaaatggagcaatggcagtaggatgggaactaatagagggcaattggtattacttccataatagtgggaatatgggtgtaaatatagtggttgatggatggaaaattgatacaaatggggttgctacaaaaatcaattaaatttttttatatgtaaacacttaaaaaatttaataacatattaaattgaggtagaagactataatatgaatgatttagttaaatgttaaatatacgttattatcaaatttgaaaatttagccaaataaagatatcccttatgataaattcaaatcaattataagggatatctttattttgggagtattatacataatttttagaaaaatagtataatttattggattttataaaagaaatttaagtattaaaaaaaaaaatacatatgttaaaatataaaagaatgattaaatatgaaaatataagtgttattagaggagagtatgtaaatgagaagaaagttaaatagatttacaaagtatattgttgcttttggaataatctcagctacaacggctgtaggaaacatagttcctataagtgctaatggaaatatagaatcagagttttcgtcggtaattgaaaaatataaatctaaagatattatagttgaagatggagtatctttaagaaaaggtgaaaaattagatttatcagataatccaaactgggagatgtcagataataatactgtaaatattgaaaatggagtagtgacacctaaaaattcaggcacagtgtttttaagccaggaaatagatgataaagtaaagattaaagaggtatatgtaccaaggcaaatacgtagctatagttttgccgttaagccaaaagaaaaaagaaattattataaagtatttgtagatccaggccatggaggtaaagataatggagcatcaggtaatggaaataatgaggatcaactaaacttacaggttgctaagagagtagaaaaaaagttaatagataaaggtatagaagttaaaatgagtagaagtagtgatgaatttatatctttagaagatagatctaaaatggcgaatcaatattcaccagatgtatttatatctatacaccaaaattcagcagataattctagcgctaatggtatagaaacttattatcatacaaaaaagggcgaatatgaaccttatgcaaaggaaatacaaagccacgccatagatgaaacaggagctagggacaggaaggtaaagaatgccaactttgcagttttacgagaaacaaatatgcctgcggcattatttgaaagtgggtttataacaaatccaagtgaatcagctaaattagctagtcctgaatatcaagataagttagctacaggcattgtaaatggaatagaaacatatttaaaaaaaaatatacaacttaatggagattccgaaaattctgatagactagaaattataaatacaggaacggtaactgctacatcactaaatgttagaagtggatatggaactggatatgacgtaatagggatactatcaaaaggagataaggttgaaatagtagaaagtaagaatggatggtataaaattaaatacaagaatacgtatggatatatatctggaagctacataaaattagatacaattgtcaaacctccaagtatggaattaggttggaatcaaaaaaatgatgaatggtattactataagagtgatggaacgatggcaataggatgggaacaagtaggaggaacatggtattactttaataattcaggagcaattttcttaaaaacaagatttaatagatatgaataatattaaaatacttgttaataattcaaatatgatcggaaaatagataatttctatccccccttatttatcacctataccccccttgtataggtgatttttttatttattttttaatttaaatgaatataaaattgtaatttgtaaataattataatgtacgagaaaatataaatatatctctccccctaataataaaaaaatacaatggtttaagttcatcttaaacacattgtatttttttattttaactatattctattttaacttttgaaccatttccagcttcacttggactaactattaatttcactggtactctattttttagttcttcaacatgacttattataccaacacttagcctatcactatgaagtctttctaaagaattcataacaatttctaaaagttcactgtctaaagatccaaaaccttcatctaaaaagaaaaattcaagtggagcacttcctttaagttgtatttgtgatgataatgctaatgctaaagatagtgatgttaaaaaagtttctcctccagataaagtatcaacacttcttcttattccaccattgaaatcatccctcattacaaaatttaaagttgaatcaatttctaatgcatatctacccttagttatatcctttaatctcttagaagcttctatcgctatatattttaattggcttgttgatacatattcaactagcttatttccttgtataactttatctaggtcttctaataaatctactttatgctgaacctttttaaattctttgtttatgtcttctattttatctaaagcttcttttaaattatttgcatgtaattgttttgcacccttatttgaatttatattctcaatcttaattttaatatcagctatattttgctttaactcatcataactttctttagttacataatcttttcctatcttgccttttaaatcttttatttttaattttattctactacttttctccttataatctgatatttcatcttttaatttattaatgtattcttcatctaatatacatctttttactgcataaatcgattcaaatttatattcattcaataaattatttaatatcatttgttgattttcatattgttctttagagttttttaagcttccttctacattatttttttgtgctagatgttcttctatactctttaatttatcatctttttttagatttaagctactttcttgatttattatatcattaatagtaacttcaacattttctagtataatttttgcagatttaccttttgttgtagttattaactcattatacttttcatctcttatctttttcttttcttgacctaaatctttaagcctagatgattctaaatctttttcatgaatttgtttttgtattaattcaagtttttctatactctcacttttttctttttgcttttgatctaattttttatctacgtcctctagtgtcttttcattattatttatttcatttactttagattttatatcatttatctttagtatactttttaaatttaaatacttatcttttgtaacattatgcttattttctatttcatctatatctttatctatattttctagagctttttttgtgctttgtatatattcatccaattttatatattctttttctatttcatatttattttcttttaattgcacaacttttttatcttaatataataaaacatctattgattttgaaagtgaaattgaaattgaaatgggtaaataaaatctacgaaaaatatttatataactactcttttattaagtgctaccataatttttatggtagtattttttttagaaatacataagtttttttacagtacaaatttagttattaagatagaattgataataatttattataataataaacattaaaatgccgaatttttacaatacaaaataaatgggtaatagtattataaatttataacattaggaggtaatgacatgataaataaaataggaaaaataactttatacgttaataatcaagaacaagcgaaagagttctggacaaataaactaggatttgtagttaaatttgaacaacaaatggggcctaatatgaaatggttagaagtgggaccaagtgaaattgaatttactacttttgttttatatgaaaaaggtttaatgaaatctcaaaatccaaatataaacataggacatccttctgtaatattaagtactagtgatatagatgctacatataaggaacttaaagaaaaagaagttgaagtaggggaacttatgaagatgtcttatggaagtatgttctcatttaaagatcaagacggtaatgaatttttaattagagaagatagatattaattaaaggtagattaaaatggaaaagtttaaagcagaaattaaaaaaatagaagctaaaaatggagcttatgtagaaatcccatttgatgtagagaaggtatataacagtaaacgggttaaggtaaaagcaacttttgacgattatgagtatagaggttctatagttagtatgggtggttgttatattataggaattactaaggatataagaaatcacattcaaaaagaggctggagatattatagacgtaacaattgaaaaggatgaagaagaaagagtagttaatcctctagagaaattattagataaaataaactctgataaagaaataggaaagttttggaatagtttatcattttctatgagaagaaagtgtgtaatgtggatagagagtgctaagaaagaagaaacaagattaaaacgtatagatacaactatagaaaagttaaagaataaagaaaagttataaactaccataaatttatgttagttttttatttaaattaatattataaaaagcttatggattaaatttaaatcaagttgtataataaagaatatagttgacattatagttgagaggattgattaatatgattaaacaagagaaaaagtctaaaaatttagttatgaaaagagtagcaatatttatgataatattagcttttgttataacagcgatagcaccattagctaattttataatgtagataattagaaaaaggtgatgatttgattgataagtcataaagcaaaggcagaaatattattagtattatatttgataatagtactatgcataatgcaatactatatacagatatcagtatataaaagcccaatgtggttgatattttatggtttgaaaattataatttgtataaaaaccatatctatgtctttattgtggtattgggaattactgcgtaatgagatataaatttatattaattatttaacaaagaaagtatcgaactggggatcaaggagttgcagtccactgccttaccacttggctatgtcgccgtattggggtggataatgagagtcgaactcacgacctccagagccacaatctggcgctctaaccaactgagctatacccaccataattggtcgaggtggagggactcgaacccccggccccatggtcccaaaccacgtgcgctaccaaactgcgctacacctcggaattaatatttatataaaagtggtggaccttcagggactcgaaccccggacctaccggttatgagccgggcgctctaaccaactgagctaaaggtccactttatatggtagcggtaacaggagtcgaacctgtgacctttcgggtatgaaccgaacgctctagccaactaagctataccgccataatatatggtgcccagaggcggaatcgaaccaccgacacggggattttcagtcccctgctctaccgactgagctatctgggcatttggcggagagggtgggattcgaacccacggcccctttcggagtcactggttttcaagaccagctccttaaaccactcggacacctctccattattggtgacccatccgcgactcgaacgcgggacaccctgattaaaagtcaggtgctctaccgactgagctaatgggtcattatttatttggcaggggatgcaggactcgaacctacgcatgtagcagtcaaagtgctatgccttaccgacttggcgaatcccctatgaatgtggtgagcgcacagggattcgaaccccggacacacgccttagaagggcgttgctctatccagctgagctatgcacccacattatttttttggagcgggaaacgagattcgaactcgcgacttcaaccttggcaaggttgcgctctaccactgaactattcccgcatagtttcaattggtgcggatgaagggagtcgaacccccacgccgtaggcgccagatcctaagtctggtgcgtctgccaattccgccacatccgcattaattgttaagttggtggaggatggtggattcgaaccaccgaagtcagtgacaacagatttacagtctgccccctttggccgctcgggaaatcctccacgttggagctagtgataggaatcgaacctacaacctgctgattacaagtcagctgctctaccgttgagccacactagcatattggcgggaataacaggactcgaacctgtgacccaatgattaacagtcatttgctctaccaactgagccatattcccgcgtattcttttttttggcgacctggaagggactcgaaccctcgacctccagcgtgacaggctggcattctaaccagctgaactaccaggccgcaattggtgggactaacagggctcgaacctgtgaccccctgcttgtaaggcaggtgctctcccagctgagctatagtcccatatgtttaatctggagcgggtgaaggggatcgaaccctcacagccggcttggaaggccggaactctaccattgagctacacccgcatatttaattggtgacccataggggaatcgaacccctgttaccgccgtgaaagggcggtgtcttgaccgcttgaccaatgggccttgtaatatatagaatataaagttattacatatgatgtaactcttaagagtaagggaaaaaatatatttaaacaagataaaagtagtaataaaattactatgttagtaaatactcatacgggattttcagaatctataactaaaattcctaaaacatctaggataaatatatctaaaaaatatataaaaaaatctaacatggatgaagatagtatgctagaaagtatgaaaaatgaaatactaaaattacttaaaaacataataattaataataagggacatattcacgatataaaagttatagatattaaaagcatatataaaccatactggataggaacttataacggaaagttagttttattagatgcataaaataaaaaagcagatataaaattttatatctgcttttttattttaattactttttatagattttgaattattatttatagaattatttttctttgtaaggttatctaaactttttagagtatagccttcttttttccaatgagttataacttcatctaatatatctgtgtttgtcttagaattaggatgaagtaaaactatagctcctgggtgtgttcttgagaatattttttctttagcatcgttatgagaaggttgtttatcctcataccaatctacatatgcaaagctccaaaatatagtattatatcctaaatcttgagtatatttaagtgattgctcactaaattttcccataggaggtctgaagaattttggcatatctttaccagttatctctttatatctttcttcaactgatattatttctgttttaaatttttcaaaatcagttataccagccattgatggatgactttttgaatgattacaaactaaatgtccttctttagccattctttttattaattctggatttgtttttaaataatggtctacaacaaagaaagctgcagttgcattatgtttttttaaagtatctaatattttttctgtattaccactttcataacctgcgtcaaaagttaggtatattactttttcattaggatcacccacataataggcatcatattttttaaagaaagaagcttccttaataggtgttggttgttttttatcttctctcggattaaaataccagttgtattcggttgtatttgaattaggatttaatatttgggtttttattttatcaaatatgtcaaactctccacttattaaaaaaccagctattataaatatagcaatgataaaaaaagaatttcttttatgtgcattattcatattatcacctctatttattaaacgttaaatatattttttacaatttatataaatataatctatgaaaaaataggatacaaaagtaaatttttaggcaatatataaacaagtatttaaagatagaaaggagaagaaaatgaaaaaaatattattaatattgttacttgttattttatatagcaatattgatataaatgggtattgtgatgattactatatagataataaattaaatcgatttatggaaaataaagttgactcaagatatatattactttatttaaattacaattataaaagtagaaatgtatttcgattataatcattattataataacttcattttatggattaaaaatctataaaagtgcaactaactatggtgggaaacttgcatgggttataaaaagattacaaagtgaaagagatattaaattcgaaaaaaataatatctataaatatggagtaaaaggtatttttgaagatataagtaaaagatatgaattacctaaaaaattatacatatcagatgatttaagtgttaaatttaaaaaagatggtacaattacgtattttgaaacctttatttatggtaaagataaggatggaaaagaagtaaattatttaatatcttatgataaaaataaatcaaaagatattaaacttatattaaacggtgttgtaaatgctacttatagcaatgataaattgcttgatcctttatttgaaacagttgagtatatttctataaaaaatacagttaacaaatggaatgcaagtgagtttggattaatttataaaggaaaaagaaactgggaaagtaatagagaagggatagttttaattaataaaaatggaaatgaagtacctatagagttagctggagataaactagttggatatacagtttcaatatatgtcccaggaaaagaaaatgaaataactcctgttagatataatttattaattgattcatattggtttaagttccaaaatactaaaaaagaagatgagttaaaagagaataaaaaagagtttgatattgcaactggaaattcaaatagtaatgatgaattttatttgtatgatggagttagatataagttaaatgtagaagataaggcaacgggcagttttttctattcattgcaacaaactactgatggaggtagtaactggtttgttttaaatgataatccatttaatggacctactggagaggcttctggaatatactttattgatgaaaatatagggtttataggagcatctagaaatggtggctcagaaggtgagttatatcgtacggaagatggaggaaaatcttttaataagatagagtttgaaaataaatcagttaagttagataatggagattctattagtccttttgattttcctaaagttccttatgaaaaagatggagagttgtatgtaaatgtagaacaaggagctgatggagattataatggaaatagtagtttactttataaatctaaagataagggcaaaacttgggaatatgtaaaagaggttaaaagtagcaattaaaagtactttattataaatagaaaatataataaattgtcgatttttaattatttttgatgaaattattcgatagaaaaaataaatacaaaagttaaaaaagtatttattatatataaaaaaaattaaatataatcaacctatattgtagggggagtgaaaaaccgtatcacaagtaattgatacggtttttactatataactagaattaatattatatatttagaatgctaagatttgtatagattatatctatataaatgttagtattctaaatatttacttatgaaaaaagttgacaatctaattaattctttaaaaagaatttttataattaacctactgtttaattttcaaagttcattttatctttcgtgtttgcccttttctcaaggacaagtaatactataccatctcattttaatatcgtcaatacttttttaaaaactttttttattttttatttatatgttaaattaaccatatattttttcaataaataattagtataattagatctataaacccaattatactaactattttagtctctactaatctacttgagtaagtaatcttttagttatatccattaatttcatttctccaagttcttcatgagttatagctaccacagcttttattctatcgtctgaattatcccatttatacgatctaacatttaatatagccccttctggcattaattcttctaaatctacaccaatttcatctgttaatgtcatatattcatcgaataaatcttcattttccatttcacttatatcgtattcttcttttattatattatttagttcttctacatctatgcttatttgatatgctatagtatcttctctcttagaccctttacttaaatccttatctactctaaaaggactttcattttctattattgatcttatttcttcgctatctacaatttcattcccaaatagtatgtacatatacaattctcctcatctatattgattattttgctatagcttcaattagacaatctttcaatgagtattttactcctttttctttagccattctgataagatatgaatattttgatttctttgattctaaatcatatatagccacatctactaattctggatcactaacatattgaaaaaagttttctgcatttttaatttctaactgagctgcttttatttcttttatgattttttcgttttctatatttgtttttttactttttattctaggcataacatcctcctgtattttacatatatacctagaatcttgacaaatattacttcacgtatacatatagttcatatttttatgtatatattaactttttaatgtgattttgacaatactatatattaattataaactttattaaataaaaaaacatctaattcaatgaattagatgttttgcactggtgggattaacagggctcgaacctgtgaccccctgcttgtaaggcaggtgctctcccagctgagctataatcccggatatatatggtgcgcccaaagggactcgaacccctaaccttctgattcgtagtcagacactctatccagttgagctataggcgcaatttgtatggaggcgacacccagattcgaactggggatcaaggagttgcagtccactgccttaccacttggctatgtcgccacttttacatatataaaaaaatggtgatccatccgcgactcgaacgcgggacaccctgattaaaagttatatattaatctactataattttctagtaatatattactaaaataatagtttgtagtaaagtattgatttttatgtaagcattttcaaaacttttgtagtataatgtaatatgtatttttattttaacttattaaggatttattagggggtaataatgagtaaactactagcatcagatattgatggtacacttcttttaaataggaaaatccatcataaaagtnnnnnnnnnnnnnnnnnnnnnnnnnnnnnnnnnnnnnntactggaagggcattgtgtgaattagatagtattataaatgaatataaattagatgtagatgcatacgtgttgtgtaatggtgcatttatattagataaaagtttaaatattatagaagattttaagatagactctgatattgtatataaaatttctaagtatgtattaagcactaataattttacactttctgtacttgatggatataaaagttatttaattaaaagtaaaaatattttaaaagctagaaatttatttaatttaaacagcttaaaaaaaatttataaaatgcttattaataaatcatccaacttagaacttttaaatttaaatcatttgaaagataatgatttaaatatcaatattatgagtatatattctttaaatgataatgttgaaaaagctgaaaatttaaaaaatcatttaaatgatgaatttggcgagtatataacagcttatagaaacaaatactttgtagatgtagtatttaaaggctgttctaaagctacaggtatagaaaaagtatgtaaaaattttaatctagccgataataatgtgtatgtaataggcgattcttggaatgatttaagcatgtttgaaagatatgataattcatatacttttacttatgctgaaaaaactttacaaaaaaaagccaataaagttatagattcatttcattattgcatagatgatatactgagttaataatttaaaaggagctattaataattattaaatagctccttttatgtgtttaaattttcggtgtacaccttttatcctcctactacctaccttttatagattttaaaatcattctacttcatagtctggtgaataatcgtaatccaagtccatttcatacccaaaatattccacaactatataattttccatatttactatctccttataatttttcattttgaaatttattaattaaatttcatcatatttactataaacttgataataataatataaatattttttatgtttatagttcatatttatattattattgaaatttaattatatgattaatcatcaaacttttaaatttgatttttaaattattaattaattcatctaatctaatttataatctggtgaataatcataaattaattcttcttcatatttcatatttattttcaaattattagaatctaaagatatattttctaatgatacatctttaaaattacttttatctattattacacttccatcattaaatttaacagatatattgctatctttagagaaccaatcttttataaaactatttaatgccatatcaactatccatttatatagtttcaaatctagcaattttacttccttaacatttaaaattaaatctttatttttatttaatgatggaactacctcaacttctataggtgtagtaatatttttagttactttatagtttacttttgcttttactgcattcttatttatatttatatcaactttacttattttatcatttttagtttcctttaaaaaataatttactccatttaatatagacttttgtggaactaaaaattcgcctttaacacccactgggttgtttattagttctatattatttgcttttataccagataccgattttaaaaactttattgttttattttcgctaatttgactttcttctattttatttatattaatattttgattttcaatatctttaggcttattatttataaatcctaaaaagaaaaacaaaatccctattataattaatactattataattattttcttttttttcatatatatactcccttaaactattaattttactatattataagtttaatacccttataaataaaaaataaactgtttaaagatttaactttaaacagcttatttttcgtcatatttaatttatcttggaggtaatatttctatccaataattatcaggatcagctataaagtatattcccatatctttattttcgaaacatatacatcccatttctttatgtaaattatatgctccatcaaaatcatcaactcttaaagctaaatggaattcattatctcctaaattatatggtctatcccagtctctaagccaagttaattctaatgtatgagtagttactccatctcctaagtaaactaatacaaagcttccatcttctgcttcatgtcttcttacttctttaagtcctaatgctttttcatagaaatttaagcttttttctaaatctaatacattaaagttattatggcaaaatgtaaatttcatattaattctccttattcacaaattattatatcttaattatattaataataaattatataatcaagcacttacaaaaaagttaacattatattatttaatactgtatttgtaaattatagatgatattaaatatcctataaataatccatttataaaggtaactacaattcttcctattccaaaatttttaaaaactatataactaaaaataatagttaatatttgaaaaattatagctatcatatgatacctaaatataaattttacttataataaattattgagattatgttattaatttatacctatattattcatataaattagtttttaccaaaataattcaatactattatttttttaaaattgtttcccatatcatgttcattatttttaagataataatcttaatctatttaaacgaatttctaactatgtaattatatactgcacctatttttccagaatcatttttatatttgcatactcccacattccatttatttactaaactgttaaatcgtccagtttccttaattaactctatagataatttatttagttctaattttatatcatttataaatttaggttcattacttattcctcccccaattaaaatgacttctggatctataacaaacccaatattatatatacaaatagctaatctccttatccatcttctatatatatttagaacttcttcatctttattttttatcatattaaaaacatcaatgccgtctaagtttttataattgattctttttttgtcagcaatttctttgataagagtgattgtagatgtatctctatttaaagtttttaatctgtatttatcatataaattatcaataatcatatatccaaattctccagaaaaatagttatttcccttaactaatttattatttatatacaaagccccacctataccagttccaattgtaatacatataaaattttcacattccattgcatttccaatccacttttcagccaataatgcacaatttgcatcattttcaacttcaacatttattcctagttcatttattaatatatcttttatatttaatctatctaaagctcttatagatcctccatctttaatatatccattttctgaatctatacatccaggtaagctaagtcctattccatctatacgttcaaattcattaactataagtttaataatttttataagttttgataaatcgtatttgggtgtttttatataatctttccctctttcaacttctgttccatgttcattatataaactatatttaatatatgttcctcctatatcaatccctaaataatttctcaatttattccacccccaaaacttgttgtttgatacaattaattttagtatatatatttataaatatctattctaagctaagttcaatcagtatataattttttattatttagctgtatactgtttatataattatattttttgaaaggagttttaatttctatgaaagatttcaaattaaaaaatcaattcttaatatcaacttatatagttgttttagcttttttgcttttaaatataaaatctattggaaatatattaattcaatcaatttctgtattaaaaccctttataataggtatagcttataatttagatgaattagaagaagctaaggatttaatattagaaggtataaacaatacagatgataaaaacaataaaataatatataaaaacttattgtacatactagaaacttcatcttcagaagaaacaaattcttatgcttaaaaatgtgtttaagtatataagattagggtatttaataatgataatatgtaggttagtttaaatttgataaagaaaaaggagtaaatcatatgatttattcctttttcaattttaactacattaacttatttcttttagaataatctttatgtctattgttatcataacttaattttgcataaacacttactgtatgtctacttctattgtgttttatttgtaaatcactaaactctgcatcatcagcattacttcttaagtagtttctaacgacatcctctgcagcttgatggtctacatcttcataaatttgaaaataattattttcacctatctcaagtgttaaatcataattaccattatctaatctatttctcatttcactcatattgtccattagtttacctccaagttaaataatgtagtcataattaagtttatccaaagtaaactaattttattatacttatagaagtttcagtattgcttttttaaattcattctcatttatatcttcattaaaatttatagagccaataacagtacaatatttattttcactgccttcatcccacataatagaatgatttaatatatctttacaaactttgtttaaatcaatccccatagcttccatgctaaatcttattttttgaggatatctacaaggtaagttatctgtatatgtacatttttcacaatatttacaacgaccaccatctgttaataatccattaaattctttttctaaaggtataagtatatcagataaaacttttcttaagtatgaatgaaaattatctatagttttttcttcatataaatttatatacattgctattactaaagagtatttaaaatctttagtgtaatcatcaaatctaggactatttggaggacatgtataacttaaattgtagtgaggacatccacttttacaaagttctgtaaagtaatcaaaatccatatattttgataatatttcatttttacatatattggcttttaaaattatatcattattatctttattaatatttaaaattatcatatttacactcctatagattatattaattaaatactaatatttcgtttttgctatgtcaatatattcatcttacaactttgttacattaaaaaattatataaaatggtataattatctatagactttaattctcaacgataattagcatgaatatggagggatgtaaggatggacccgcgtctgattagctagttggtaaggtaacggcttaccaaggcgacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggcggtctttcaagccagaagtgaaaggctacggctcaaccgtagtaagcttttggaactgtaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccattgacctctccctaatcggagatttcccttcggggacagtggtgacaggtggtgcatggttgtcgtcagctcgtgtcgtgagatgttgggttaagtcccgcaacgagcgcaacccttgcctttagttgccagcattaagttgggcactctagagggactgccgaggataactcggaggaaggtggggatgacgtcaaatcatcatgccccttatgcttagggctacacacgtgctacaatgggtggtacagagggttgccaaaccgtgaggtggagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggttagctaaccttttggaagcggccgtcgaaggtgaaaccaatgactggggtgaagtcgtaacaaggtagccgtatcggaaggtgcggctggatcacctcctttctaaggagtaattcattggtcaagcggtcaagacaccgccctttcacggcggtaacaggggttcgattcccctatgggtcaccagcatttgggattatagctcagctgggagagcacctgccttacaagcagggggtcacaggttcgagccctgttaatcccaccagtaaaactcttagattttatctaagagtttttttatttgctaaatttagttagcttaaaatattagaaaaacttgtgtataataaggatataaatacatatagaaaataggggagaatatgatagaaatagttttgtgtgaagaccaaattcaacatcaaaaaacaatagaaaaatttcttaaagagatattaggggaaaataacatcgagtataatttaaaaatgtacaaaagtggagaagaactattaaataactatcccaaaaatgtagatatatttatacttgatattcaaatggaaaaaataaatggaatggatattgctagaaagataagagaaatagataagaacaaacctgaaataatttttacaacatcacttgttgaatatatacaagaaggatatgaagtaagagcttatagatatttattaaagcctataaaatatgaagatttaaaaaaacacattttaagttgtatagatgaagttataaataaaaaggataaatttatattaattgaaaataaaaatgaaacttacaaaataaaaatagaagaaataacatatattgaaattcaaagaaaagatatgagtatacatacagaaagcaaagtttatgaaacgaaaatgactatggataaaatagaaaaagagttaaaaaattataatttttatagatgtcataaaagctttctagtgaatatagattatgtggaaaatataaaacaatatgtagctacacttgataataaagaagaagtaccggtaagtagacatagattcaaagattttaaacataaatttttacgtttattgggagaaaaattatgttagaaactgaattaatgtcaagattagttatagggacatcaaaatttgtacaatattttatttttataaaaatattagattctctagaaaaaaggaaatatgaaaaaaaatacttagatattatatttttgctaattggaattttagattccataattatatttaatagggcaactcaatattatggttttataattaatttaagatggatatcatttgttttatttacaaagttaaattataaattaagtaattttaaagtattatcatattatatgatttatactattgcatattatataacttctattaaactttcttcttttatatgtttttgtatataatttaaaagatgaaataataagtttattagattctaagcaaaatagtgcaaataaattatctactttaaatgcaaatatagaaaatattgaaaaaagaactgagactataaatacagagataaattacatagaaaaaaatatatgtgataaaaatgaagaaatattaaattataatacagataaagaagagaagctaaacttaatagaaaaattaagacaagattatagtgaagttgataaaaatataaattctttaaaagaagaatataaaaaagttgaaaaagatattcaacattctaagttaaaattaaatgaatttaattctaagttaaatatatatatagatatggaaaaacactatgaaggatttaataaaggtgtaaaagaagttttaaaaaataaaagtttagatggcatatatggagcattaggacaagttatatcatcttctaaagaatatgaaaaagctttagaagcatcactaggcagttatatgcaaaatataataactaaagatgagaacagtgcaaaattagctataaattatttaaagaaaaataacttaggaagggttacatttttacctttaaatataattaaatctaacaagatagataaaagctcaataaaaagtaacaccaaatacataggaatagctagtgagttagtcaaatttgacaataaatataaaaatataatagaaaatatattaggtcgaactatagttataagtaatatggatgaagctataaagtttgctagggaaactaatcatagatataaagttgtaacattagatggagaaatacttaatccaggaggagctttaactggaggaacaataagaactaatggaaatatactttcaagaaaaagacttattgaagagtttaaagaaaagatagaagtagagaaaaaatcattagatttattcgatggaaataaattaaaactaagtaatgatattaatttacaatcagaaaaaatagaaaacataaagttagaattaagcgaaaatgataaaaagctagtatttataaatactagtataaataaatcaaatgatgaattaaaaagcttagaaggtaatttattgaaattacaaaatgaaaaaaaaggactagcagaaaatttagagtatattttaacaaaaacaagttctttaaaagaagatatagataatatagataaaaaacatatatctaataaagataagattgataaattaaatttaaaaaaatttataaaaataaagatttaaacgaaaataaagaaagaaacttaaaatgtaatcaagaagaaaaaatacctagtagagataaggatgcttatataaatgatttattaaaactaaaaaaattattagatctaaaagttattgatgaaagtgaatttaaattattaaaacataaacttataagtaatatataaataaaaaattgttaggcttaagttagtctaacaattttttatttattaggatataatataataatggtaaataaggaggcagatagcagatatgggaaataaaataaaagattatatatatggagagtttgaaatagatgatgtattaatagaacttataaattgtagtgcagtacaaagattaaaaaatatacatcaagtaggagcaacttacttaattaataaagatttaaatgtaactagatatgaacattcggttggtgtaatgttattaattaaaatgttaggaggcagtttagaagaacaaatagctggattgcttcatgatgtatctcatactgctttttcacatgttatagattttgtattagataataatgaagaagattatcatgagataatttttaatgaagtagttatgaattcagaaatacctaatatactaaaaagatatggatataactatgaagatatattaatgaatgaggaaaaatggactatacttgaaagaaaagctcctagattatgtgcagatagagtagattatacattaagagatatgtatagatatggatatacaaataaatctgaagttgatttatttgtaaaagatatgtgtatagtaaatggggaaattgttgttaagagtatagataaagccaagtggtttttagatttatactataaagaagttgtagatttttttatgagtccattaaatgcttatgcatatgataaattagctaaagccataaaatttgctataaatactaaagaattacatatgaaagatatcttaaaaacagatgctgaagttatagagatattaaagaagtctaaaaataatgatttattaaatttagtaaactcattaaatagtgatataaaagttagaataaatgaaaataaatacgatatacatataaaaggtaaagtaagattaatagatcctagtgtatatataaataataaagttttttctttatcaaatttggattacaatgtaaatgagataaataataaagttaaagatattataaataaaggggtatatgcaataaattctagatttaattttaaaaaattcacaaattattttttacatatacttagaaagtaaatcttcttacattagatacaaattcatttgaatatataaaaaattatgtaaataaaaaaataaaagcacttaaattataagtgcttttatttttttatttacatatatttattttttatttattttatttttattgtctataccgaaaaattcttgtgcatctttcatcaaattgttaaaatcatttcttgttgtattatctacatttaataaatcatttataccttttctaaattctacctctgatttttgcattaaattatttggtacttcatctaattttttagttctagtttttagttctgctattaatttatttccttctgctatcaatttatcattcatatcttttactttaggatcttctgtttttactctttttaaagaatctacaaactcttgtaaatttttttcactatctttatatgctttttttaatccttcaagatacttttcatttcctgggtaatcttttgtttctttttctaccaatatttcattatatccattataattttctaatctagcaatgttgctttcatataatttaccgaattcattcttataactttccatactcatattaccatatctattatccttagtttctgttgttgattttgttactctattttcatctgtttttttcggcattttatttgtacatcctaccgtcccaaatgatagtaatcctattaaacctaatgctaagaattttgaatatttcatattatacctccaaattaattatttatttaattctatatctagataatttcttatactttctatagaattttcaaacttagtttttatatagctttgtatagatacatttttttgtaaatatactataaattctgactttgccattgaataattatctagtggtatgttatctatctctttaatctctacttcaatttcttttattaaattcaaagtattttctattaattcattatttaatttagtaagatcaatatctttcgtaactaaattattcattccgtttttaacctcgactaattgttgattttatacatttaatagctttttacattagtaaatcaatatcataaaatagttttagtttatctttagctgttttattgtattctctaaaattgcttgttaaaaatcttatctcattcataaatatacgttgattgtataaaaagtcatttataccattagataataaagttgaattatttacatttatctttttgttaataaattcatttacaaccaacagctcttttaattcatcatctgattttatatttcttactcctaagtcatataacttattaactattttttcattaaatttaattgatttttcaatatcacattttgtaatactactcattttatatggtaatataactttatttgcatataaagctattactgtacctaataccacaaaagttattctttgaatagataaatcagttatatcagttcctattgatgctgcccctagtgcagatatagttgtgcatatcatttgatatttatatttactttgataattactaatgtatccagctaaaagaataataatagctctccctgaagtattagttattatagaaaatgcaatttcaaatataataagacctattatagttcctaaaattctttcttttcctttagttttgctagattcaagatatggttgaacaatagaagataaactaaaaactagccatttaccatattctatattaaatgcactaactataaatacacctatacttgtaactattgctcctctaagtgcaaatgtaaacttaagagattctttgttcatatttaattttaaatcatttaatctgtccattatatttgtaacaaaataattattatatatttgtttaacactattttcttttgtatcttttaaatcttttgctaataaacttactgcatcttgtagttcaagtattaaataatagtttgaatcaatatgtttttctttgtatgaaaagttttctagattttttaatatttcatcaatggttattttttcatctacaaaatcatttatattttttaatttatctaaaatttcatttaaaaccttgttgtatccactatttgagcttttatttctaattcttaatatatattatactattatttttctaattttttaagttcaaaattatttagttttaaaatatttttttaattaagcattctacaactaaataaaagctatagtaataaagtttaatttccttaatactatagcttttatttatattattaacattttttatcgtctttaatttctgattcattattttttaatttttgaattttttctaatactttaggtgttatatttaaaatgctatctaccatatttatactatggtctaaactcataagccttgtttctccattttctacaactacaaatgctacaggttgtagagatacagctcctgcactacctcctgcgaaatttgtatcatctaaatctctttcttctctttttttatctgagcagtctcttgaatattctcctccacctataccaaatcctatagtaactttggatataggtacaacaactgtatgttctgctttaattggatctccaataatagtgtttgcatcaattgtagttttaattgaatcaagcgttgtgtccattagatcttttatagagtttgtcgatctcatctgttctggcctccttaccatatttaacttttttatattttctaattttaaaatatatatgaatcatgccttttataaaaataattatatcttttatagttggacttacatgtagtatccctttatgctttataaaattttggttatagcatggagatacttttagatatattttatctgattcaaagtaattacttacatttccataaaatatattaactaaaacatatataaatgatgtaaggtgtatattttcacttccataacttaaattagaatatatctcacttattctaacctttctaagaattttatataaaactattaaattttctaactctattttttttaaatcaagttttttaagtctacttttatcctccttatatttatttttcttcttttcatgtttttcttcgtcacttttacttataggataaatagtctttgttatattaattaaattaaaaaagttacaaatatcatttattatttttttagttatattatttatactatctaaattttcttcatatacaatctcaatagagtcaatttctattaaagtatctacaactttcatatatatgtcatttaatatatatttactgttggtattaaattttaactcaagttttgcttgatgctttatagaaactactttttcttttataaataaaataaaattttcaaaatcttttttattgttaagtggctctacttcaaataatattctaaaaaataaattccatataaactcgcagtttaatttaggtattataaaatttccaagtctttcacaaaattcatcctcaaattttggaagtttaccaaatcttatttttgaattaaaatcaatgtctttttttgaaatttcatttattcttataagcccttgtattgtattatcttccttaaaatctacaccttcatcatttttattgaaagaatagtttattatagtttcacaaggttttttaaagtctattataaaacctatattttcttccattttttcagcaaatgtatcataagctatttttgctaaaaacttttccattgatttttgctttgatgctttatctttaattgttgttgaactaaaagttttagaaactgacaacaattgattatcaatcattgttaagttgttttttatagatgctaatacatcacttaaaaatttatccatcattaaataagcattatttttgtaaataacattatgctctatatcactccaaaatatgtttaccattgattttatttgtatttcaaaactaatttttttatcactatataaaaataatccatctattctatatatttcaaatccatttttttgctttcttggctgttctttatcaagtcttattcttatattttcattttcttcattataataataaatattatcttctgttttattaaaataattttttaataatttatatatctttctttcttcttctataaatctacattctaatctaacacctattaagtccgataaa
